United States Patent 8,216,786 (GENETIC POLYMORPHISMS ASSOCIATED WITH CARDIOVASCULAR DISEASES, METHODS OF DETECTION AND USES THEREOF) - sequence listing, part 10

SEQ ID NO: 1261 - DNA, 796743 bp, Homo sapiens
gaagagaaactgctagatcatatggtaattctatttttaattttttaaggaactaccatactgttttccacagcagctgcatcattttacattcccaacctggaacaagtgttccagtttacccacatctttgtcaacacttgctattttctattttctttaaaatttttatagtagccatcctaatgggtgtgaggtagttcaacataagtttatatttctcttaggtaaatatctactcatgggattgctgggctgtatggtaagtctgtgtttaaatttatattaaactgctgaaccattttccaaagtggatgtaccattttacattccttctagcaacactgagaggtgtaattgctctgtagtcttgttagcacttgatattgtcctattttaactttagccattctagtaggtatgtggtagtatgttaagtgttcaaattttgcctatttaaaaattggattgtttgtcttattatttatttatgtgtttgaattcaagccctttattatatttttttttcccagtctgtggctttgtcttttcattttctttacagtgacttttgaagagcagaaatctttgtgcattttgtgtcctatgtaaagtctctgcttagccagggtcacagagattttctcctgttttttcttttttgcagaaatttaatagtcgtagattttgtctttaggttcacaatccattttgagttaatttttgtgtgtgatgtgaaagaaggttgaggttttagtcttttgtgtgtgtgtgtgtgtgtgtgtgtgtgtgtgttttgtatatagatgtccaatttttctagaaccatttgttgaaaaaaaatattttctcagccaggcgtggtggctcatgcctgtaatcccagcactttgggaggctcaggagggcagatcatctgaggtcaggaattggagactagcctggccaacatggtgaaaccccatttctagtaaaaatacaaaaaaataaattagctgggcgtggtggcatgcacctgtaatcccagctactcaggaggctgaggcaggagaatcgcttgaacccaggaggcagaggttgcagtgagccaagatcgtgccattgcactccggcttgggcaacaggagtgaaactccatctcaaataaataaatcaatcaatcttttctccattggattaattatcatggcacgttgtctcaaatcagttgaccatctgtgtgtgaatctatttttggagtctatgttcaataaatttaaaaggagtttattgattttcttagaggcagtttttggttgaatcaatttttattgatcctgtttttaaattcatcagtttctgttctgatagttactatttcgtgtcttctgtttactttgggtttttttttcttctagaaacagaggccactgatttgagaccttttgtcttttctaatggagttgagtgctgtagatcttccccaaggtcctgctttatcagcatcccacaactttttatctgccatgttttcattttcaattactttaaaatgctaatttttcttttgatttatttagagtatagttcagaggtcagccagatatttgagtgtactttgtaccagctttttaagtttctcccacctgttccctttccctctccattcaattttcagctgctctggcagtcttgaacaccaatgtcactccacggtctaatataatagctgcttgctgatggaccttgctctttgttgtgaactaggggaattccttcaggagaaaagccaaataaatgtggatatcacccagtgtgattttcttcattcaagagctatatctcctgcagtttctgcctgctcttagctgttctgcattgccttcaaagaattgttttttcaaattttgtctaaggttcgtaattgttattggcaaaagggtcagtctgatacaactgtaacattaccagaaattggaagttctttctgcatatttttatatgtagtcttttccatttagtttaaaatattttctttttattgtgatttctgatttttttctcatggaatattaagaagtgtgtttcttaattttcaagcacagggagattttctagttttctatctctctatctatctatctatctatctatctatctatctatctatcatctatctataatttccacttatattccactgctgtcagaaatacattgtatgttattattctttgaagttttttgaaactttatgtcacagtatataaccacgttttataaatatttcgatgtgttgttgaaaaaggactttattcatttgttgttgtaatgttctccatatatcatttagataaaatgttaattgtattgtttaaatcttttctattctttctgatttttgtctgccttttctctcattttctgagagaaatagcagttaaaaatctattataattgcaaatttttctatttctccttttatttctgttagatttttgcttcacatataggagatgtcattaggtacatgcagatttataattatatatcttactgttaaatcaaaactttcatctttatgaaatgtccctatcactagcaatgctttttggttttacaaaagcatttattgtctcatataaacataaggacatcaccttttgttgcatggcatatctttttcttactccttttaatttcttatattttagatatttcttttgaaatagcttttaattgaactttcttttatcttatctgacaaccttcatcttttaatcggagcatttattccatttacatttagtgccattacaaataaatttggttttaaatctattatcttgctagttgctttctgtttgtcctgttcttcattatctttgtcttctttcttgctttctgttagatgaagcgtttttgttatgattccactgcctctccattcacttaaagaatatactcttttaagtattctttcagtggttaccatagagactaaaacatgcatccttgacttatcaaagtttaatgtaaattagtagttttacctctttcttgaaaatgtaaggatgttaatatatcttccatttaccagctttcaatatgtatggtattattgtaatgcatttttaattatttacctattttaaattgcaagagacattgttattattagattatatttatttagagtttcccacataattacccttcacgttgctttttattctttcctgcatctctcattgcattattttgattgttcattctttctctccctgtctgtcttcatctttcctttcactgtctcctccaattttctcagcctcccaccacccatgcacttgtagacatagttgagttccaagacattaggtgcatacgtggtgaaattctactataatacatttcagttgctgctggagcaaccccacgtacttgtcttaaagttcaatttaactaatttctcctatgtgaggtcaatcttttccttttaaaaacctaacaaggtgggtatgccttggggcatgcttagtctgcattaaatatgcactaaatcacggcttggaagaaactggggtggcaagagtcaagtaattaactcaaaaataaaatcaggacactatccctgagggtgagaggatcttcaaaacgtgttatctgtgttgaatttcatgtgcatgcattctagaaggcacgttgcatttaggtagaaatagcaacaatttaaagctaactttgaaacttctcaaaaggatgttatctaatatataagctaacatgaggaggaaatagaaaaacaatagcacttggaccagagaccatctgacataacatcagacaacagggagtttcaggtaaacttagatttcacttaaatccaaagtcctcattttatagatgagaacactgaggtccagagaggctgagtgacttgtcttctgaggtggataaaatcagtggaatagcctgttgtgatctccaggtgtgactgttcattgggtctagagttggcctctatgattctctagttaccttttaacccactttgctatttgaggtttcaaattatatttttgatgtttctggtacagggggcagcatcttctactatgtgcatctacattggatggcagtggagcaacacagattgttttctgacaaaaatcagccaagtactaggagaggcaggactttagaagtggaggagatggagaaggaagcttaggttactatggagtgtgcaaaaaggtcctgtggatttagataccaccacacacaaatggtatgtaatactcacttgaagacaaatcagccagagggatctaacagcattgacccattctctggtcttctagcatccatcatagttttgtgctccttttccatgaaacacagctgttgttggaaggtacctgcccagataaggactgcatttcctctagcatccagatgggaccaaatgactgctggccaatagaagtgagtggaaaggactgactccagttccaggttgggcctccaactgctctgggcacgtcgatggaacagaacaccacctccaccccaataccaccaattcaactttacatgaattataagcgagaaataacttggactgtgttaagtcattgagtttctggggtttaactgttattatagttaagaatgactttaactaatatagtcaatgacatctaactggagttatgaaattcaatttctacttagagtaattgaagcaaaggttgtgggggaggggaggagggcagcacaccatgaaatcagagatccccagtacgtgttagttcatcagtcaatcagtcttaaggtcagggtgtagtgtgggcagcagttgcctccctctccccacagaacaccctgagaataggaagttagagtagtcgcatcttattacttacaaaacattacctcaaaatgcaaactaccccctggacccaaactctctacaatcaccaggttccataaactataatctactctgttttctggaagaaaatattaacctgttaaaattccctgcacagagaggaaactttttctgggaggtattcctgaactcattttgccaacttccagatgaacaaaactaaagtttctttttgcttcttccaaaaacataaattatcaaataacatttataacttgaaaaagaatcctagaatattttcatgaataataattagaagagtaatgttcacatgggaagggcgtcttttctctgctgtgtgcataggaccctgggaccctgggatttaagtcatatggaacttggtcaactcctccaaaatgctcccagcgctcacaggggctgccttggtgtttggaaggaggtggtgccaaagcagttggtttgctggattttgactttctttttttaaagtggtatttgcaaatactaccccgagggcaatggttaatggatttgacctttgggtcatgggggccagggagcagcactcatagaagctgtgtgtgtgtgtgttgcggggcgggggcgggctgctgactggctctgccactcacctctcaggccttaggaatactgaagattctcacctacgattggtggcgatggtgggagtggtccttaaaactgctttatagaaaatcatagtggaggccaggcgccgtggctcatgcctgtaatcccagcacttcgggaggccgagatgggcggaccacgaggtcaggagatcaagaccatcctggctaacacggtgaaaccccgtctctactaaaaatacaaaaaaattagccgggtgtggtggctgacgcctgtagtcccagctactctgaaggctgaggcaggagaatggcgtgaacccaggaggcggagcttgcagtgagccgagatcgtgccactgcactccaacctgggcgacagaaggagactccgtctcaaaaaaaaaaaaaaaagaaagaaaaagaaaaaagaaaatcatagcggaacagaccaggatgaccactgatcggccaaggtgaacctggactcaaagttctacagcaaaggctgtccacaacactacttactactcactactcacaagagcttctagttggcatcctcaaaccagagagcagttgtactgggggtaaggcactgctagggttctctgtaggacacacatgagatgttaaggaatctagctgtgggcaatacagagatgagaaataggtggctacaatcagtcaggtgagaggtagcacagtgtagggatagcaggctttgaaatttttaacagacctgggttcaactcctagttttgccacactgtttttctgggtggtcttgaacaagttctttctctaatcctccccatctataattgggtctgaacacttaccataccacccagcactgctgtgagcattcaataaaatagcacgtctgataagaagaaggcacttgatcaaggaagggcagccacagaagccttcgtgccatggttagtggaactcagagagaagggttctgtatgtcccagttgtttgggccttataataataataaaattcattttagcactatctctctttggagtacttcttatctgcttttcaatcctggtatatcctaagaaaagattacaaacaattctaaaatggaaacttcacttcaatacagcagatttccctgggctcctggctgggcacagagtggctggcagaggggagtctgtggacgtggagagtaagttggtggaaacgagcactcagcaggggccaggctggggcagttgtgccgatgctggagagaggagaagtggaggaagccatgctaggtaaagtttatgccctttcttctcttgccttttccaagccacagcactattaattttggttgctctattgatatttcaaaatgttagtcttcccttccccttgtgtttttatcgtcagagggatccacctggttcacctttgcttctgcagagactcaacactgcccttttgttttcaaacataaagctactctcaatggatttccaaggtgaatcctgcagctgcatccatcccagacactggggccttgagtgcctgtggagcacacctgcagatgctgggcctcgccatgaccaccagaggctaagtggttagcacacgagtcctcactgccagggggccacagagactcccagtgctgacagcaggtgggagcctcttcaggcagcatccaccagcaacctctgccctgctggagagtgcaaggctttgagcccacctgcctagggaccgcccgcctgctggggaagggtcaggctgcagagggccactaggcttttgggaattgagcttctgggagccccaggccttagtctcactgtagcccagttctggtattttcaaacttttctccagcagagataatgctaataatcccacagctgcagcattgttcagggcactagaagaattgggactttctctccaaataacaatgagtatttcttctgagcctttgtgataagaaatgagaaagaagatcattcctagaggcagaagcagaaaaccagctcaacaataggcagaaacttttcattatacattattagtctttcaaatgagcatttctgccagcccattctaggtttaaaataaagtggcttttaagtctcagattattatggccacatcttgttttaggaaggaaatatctgatctggggcagctgcccgaccagctcttctgtgcttttgtccctgctcccagctggcaacctgctcccttgaagtgcattgtgatgctgcattttgccacaggctgtctttttgcgggtgagtgtgataggggaatccctatgacaagcaacccccacccctccaagggaaaaagccaaggtgtttctatggaatgtgattttatagtgagtttttctggtatcctttgaacaatgcgcatatttcttctgtgaaacagttacaaagttagaactgcaggactccagagataaatttcagtaattccctcttccttttattaactaaaaaataaacaaaacttaaatctcgtgagagcagcatttaatacacagagaaagataaaagaagcaggaattacccatattctgcaaggtttagtaaaaaaaaatcaacacttatttacagaaagtgtgtttgagtggagttctggctgttctgaatgagcagaacctacaaagatgtgaaggaggtgtctggacctgtggagccgctgagccttgtggctgagtgggcaggctctggattatttcgcgctcggcaacccatttccccgggtgcccctgggcgagccatggatcctctccatgcctcgtaggaaaaatggggataacagtagtacccctttatcatggggttactaaggacgcaaagcaaaccataggtccccagggccaggctcttagggacctttggttactcttgttatatcagggggccctgcagtcgcacctgtaccagtatgtagaagagacgttgatatctgcacacatttttaacagttgggggaacgaccttttagtctcatttctcttttcctctcttttcctcactttggcctgtcaatctgtttcttctttctcttatttcctaccccccgccccgcccccatcttggtacttcactttcctgccctctcagagctgaagcctcagtgggaggtgcctggtcccagagaaacgggtcccttctgggcagccttgcagggcggtctcagggtctgcccctctctctccagttgcttccatgctgagcacagccactgacctggtgcagcctggtcctcgggctctccctttcttgctcgctgtagtacatctgctgtatgctgttcctcctgtgcttaatgataagcatgtcaaaacccggtcccctcgcttcctggaattaggtagtcagcttccctctcccaaatccaccgttctccaagctcagaattctctccctcctctttggtctaatctcccttccatctctcactttgcagacttggcccaaatccttaactccgtgtgcgtcttaggcagcctccctagtctctgccctaggcaaccctgccttgcccccgccccattcctgtcctttcacaaacagcagaaattgtatcaccgtctcacttggaacagtgtcaaatctctcctccttctaacaaaagcatcattcctgtcatttatcctgagaaagaaaatcacatccacagaaaagaaagtcatttcagctgtagctcattggcaaagaccctcatgccccttgaatcatatagaacgtcctcatcccccacttcacacctgcccaactcagaagcttcctacctaccattccatagttttggccagatcttcattctctagattccctattctctcccaaaatggctaacaaagttttgttctagctcaaataggctacttgggaagaggcaaaaaggttagattcagttgtgtcttccagtgatgaccttgattcacacttttttcttcttttttaaaaataatgatttgagttaaccaaacaattaagggcttaccctatagagcccctaatattctcttaattttggagaggtctaatttgctttgtccagttggggtgtgtgtgtgtacctgatgtttcagtatgctttctctttgtactcaaactctccctcatagcaacatgaagaatgatgactactttttgttgtgcctaataaactgctctccactcaatgaatattgttacttgactcccattacaactctgggggaatctggattcacagaggaatagaaccttcttaccaaatctggagtgtgattgtaattttacttttgaagcacccgcttcccagaagaactgccagtgatggatgccactgtcaggaacccagatgcgcacgctcatacatcagccgggaaatcatacaaacagctctcccagcaggccagggctgacacacccattactcccctatggaaagagatgtgtcaaaaaactcagggcagcagcaagaaagaggcagagaagaaggagttgggagaggatgggtttttgtaggtccacccagtttttttccttcctcatcttcctctgagggcagcagcagcagcaggctaaggtttggatttgtggttataatgctgtgtgacaggatcatggggagttgtctggaaacatttctcctgggagtgtgctgtcagctcgttttcatagtgcacatgaagggaaacattctgctctatacacatgcctttatccttatataggtacaggtgatgtctacattttcctttgggatggatgtggcctacctaggctaagatcacgctatgacatttagtctctttggagagcaagtctgtgttgattccagcaggatggggcagcaggggctggttgctaggatgtctgaaaacagaggatactactggagtggaggagtggaagcagcccagcaggcccactggtagccgtgagtgtgaggatagcttatcggtagcggcaggccaaagcattgacattcttgaccacataaaagcccatggtgactggagggatgaccaatgtccggccggcccgaagggggcggggcttcaattctgggagggtcccgtcgtccaccatcactaagggctggccattcagttgcactgacctacagtgaggaaaaacagtatgggactcattattgcattataagggagccactgcaacaaagcctagccccagatggcctggcagtgtctgatacacacacacagctgacacttattgttactggctatgccctagattctgacctaggtgctttactttaataactcattcaaacatcccaacaacccccccactcccctgaggtaagtaactattaatatcattatccccattttatctagagtggctaggtgacttgtcccaagtcacacagcttggaggtccagggtttgaacccaggtagtctacctccatagacacatttagacaagtgaaaagtctgtgatgcagaagctggaatgtttcattcctattttttaaaaatcacaatatcagctcagtttgacttttccacctaaagagtttttacctgtggaatgatacatgggcttaagatgacttcagaaatctatttaactcatatctcattaatttacttgacagattagataactgacattaccttgcttgtctaaggttatacggaagggagacagagacataggtaacacctctactttttctaatttaagaatgagttttggctgggtgcagtggctcatgcctataatctcagcattttgggaggctgaagagggaggatcgcttgagtccaggagtttgagactagcctgagcaacatagcgagaccccatttctacaaacaatataaaagcaaaattagcctggcatggtggctactcaggagtttgaagtgggaagatcacttgagcctgggaggttgaggctgcagtgagccaagattacaccactatactccatcctgggtgacagagaaactctgtccctaaaaaaaacaaaaaatgagttttcatatttaatattaacagatgtttccatttagcaaaacagcaaagtaagtgataaagtaggcatttgtgatcacaattcatctatcttgcttttatcctttctgtatagccagccactttcaccctgagaagggggactacatacatagcaaacttagaaaagagaaacagctcatcttatgctggatagagggaaatgccacctatccttgacctatggtaccagaatccagataatgttccagctgttcctgacagccatgcacccaggtggaagcttagttttatgggtcagcagaaaaggccagaaacaggccaccagctggaaataaggttgtgagtcaccctcagaaaatcaacattgcatagtgatgactgtttctgggccttgcccaacctccagtgtgataacattgccgtgacatcatctgagctgtaaagagaatagaatgttataaattgatatagaggtctttgtttagtgttccttctgtgctatgaatgatagactgctttagagagagataatcagacccatgcccaatagagcagtgaattcccagagataagtgtgttgtaaattgctcccaatggagagctaggcagagaagagatccaggcctggccccacatgggtaagtttgggctaggtccagatctgataggccagagggagcaggccccctccctttgctagaatgactgagtgaataagtgagtaggaggcttctatatggagagcgaggcctgcctctggaaggcatggggtgggagaattgagatctgaaggtcagtgttgaccgcatcagatatgcaaggagcttttgcttccaaatatgagaagtgaccctctgtagtgaagacagcctactcattggagtggaaggcagggtgaggagagtggttcagttacaaaagaagcccagatgggtcttcacagtgtattttcattattttgtttcaggtgctatgaatatctatcacccagatataagcacagtcaaacacgagttcaataataccgattaatctttctaaggcatactcaaatttatatcaggtctctgctagaaaaccttcaatggtttctcccatatacagaattaggtgcaaacctttcttctgaagaattaggtaatgcccttttagattcagatgatcccacagtattgacatctttgggttctggggagtgcaaaacaacgtgtgattagcaaacctttaaaaatctatactaataaggagtagttgtcctggaacaggccctattctggtttctttattggttggttaaaaagctaagagtagaaccaggaagcatggtgaagattctctactgaaatctcgaattccaggagccaagttgctaactagctagatggctttggcaaatcccctaacctcactgccctgtagcttttgcatctgtaagaacgttatataggcaccaaagaaatgaaataagaaatatgaaagtgctttgaaagcataatgaaccatatacttaagatatggtgtttttgttgttgttgttctttttatttttatttatttatttttttgagatggagtctcgatctgttgcccaggctgcagtgcagtggtgcattcttggctcactgcaacctctgcctcctgggttcaaatgattctcctgcctcatcctcccgagtagctgggactacaggcatgtgccaccacacctggctaattttcgtatttttagtagagacggggtttcaccatgttggccaggctggtctcgaactcctgacctcaagcgatccacctgccttggcctcccaaaatgctgggattacaggcatgagccaccgtgtctgacctgttgttgctattgtttttaatgtcactgtggacagatgcacttgttggtccttatcatacctgactgctctgtggtactcacattttcaggtctccattctcaaaaccctctctccccttggctcccatgatatttctctctgttttcctccatttctggatggcgttttgttttcgtttttgtttttgtttttttgagagggagccattcccctctgcctgcttctcagatgctagggttcctagtgttttgtccctggactcttctgtccccacactctgcactcctcccaggttgctgctgctctcacccttgacttcggtcactatccacaagctgatgctccctaagcttgtatctctaccctacctacattctttctatgaacttctgtatctccacttggctgtccacaggaatttcaaagtcactaggtccaaattcaaaatcttctcctcaaactctgtccttatctctgctttttttttttttttatctttgtgatggtaccgccatttatccaattactgtacccagaaagcttggagtcttctgagacttctcccccaattcccttgtgtagggtagccaagtcaaaataattcgaccttatagtgtttttcaaatctgctccttttcctccatccactgctatctttttagttcagaacttgcctcctaacctatctctgtgccacattgctgacagttatctgttgtcactgcaccgcttcaaacttgccaacactccccttcccttacactttattgtgaacaatgacacccagctccagctacctctccagtctcagatcccgccagtcccccctccaacgctcactgtggatcgcagacctctgggagtgggcattggtagggggttgccagttattgtaagaatttcattaatatatgcatacacaaagatgacgaatgaaaaaataatgtctttcacagagatgaggtaaatatttctcaatgaaaatgtaagtagatattgttgggattgaaatacacaagttaattcaaaagtatagtaggctgggtgtggtggctcatgcctgtaatcccagcactttgggaggctgaggcaggaggatcacttgagtccaggaatttgagaccagcctgggcaacatagtgagacccccatctctacaaaaaaataaacaaaattagatgggtgtggtggcacatgcctgtagtcccaactacttgggaggctgaggtgggaggattgcttgagcccaggacattgagactgcagtaagctgagactgtgccactacacaccagtctgggtgacacagtgagaccctgtctccaaaataacaaaaaggtagaaaacatttttcaggccgagtgcggtggttcacgcctgtaatcccagcactttgggaggccaaggtgggtggatcacgaggtcaggagtttgagaccagccagaccaacatggtgaaaccctgtctctactaaaaatacaaaaattagccaggtgtggtggcgcacacctgtaatcccagctactcaggaggctgatgcagaagaattgcttgaatccgggatgcagaggttgcagtgagccagactgcaccactgcactccagcctgggcaacagtgcgagactctgtctcaaaaaaacacaaaaaaagaaagaaaatatttttcaaaagtaaatgctagtcagcagttttgggattaaaacataagttcatttaaaactgttcttcaattcccaatagattttttttgggggagggaggtatcatgtactttttaaggaatagattttgaaaggacaattactataatgtggaagaccgtgacatttgttgacatttaaaaggaacccacatgcttgaagaggccaagcccccgtgccctagcatgaccaaataaaatgacttgcagttttgcttccgagtcatatcattctgtgcggtgctccctccagctgtcttcctctgccagactaactgcaatggatccttgcagcgtctgtgtaggtgttgcctcctctggagaaccttctctgacccctaggttgggtttggagccccacttctggactctcttagcacccaaagttatttctaactgtggcccttattgtagtgagttacttgtttgatccctcactgggctatgaatcctcaatgcctaaagaggtgcttggcacagagtaggggctaaatattttctgagcaagtgaatgggcttttgaggctcttttgcattatttctgatcttcctggattgagtttctccagctctaaagaggctccctggaggtttgctgagtgtgtttacagatttcattaatgcgccaattactattgctcttgttggcttgtggagatgttagataagatctgaattatcactgattctctcagccactcactagatacctcattccaacctgacataagaccattgatcattgctagtgttttccatccttaaaaaagatctatgcgaccatctcttagctaagtgagcataagttaattttgtgaataaggttttgtgagaccttgagtcctcatacatccttatccacaaagtcccttcattataaagatgggccatgtgctttatcacttccattctattcttcctgcctatatttttcttttaatatttatcttgttacccagcagtcatatcatgctaaatataacaataatctttcatttagatacattgaacagcttgtaagcttgtaaacataatcacattaatgataaaattcaccaattatgcagcactatttatgcaaaaggcactatgctatgatttattttgactatctcatttagtccttacaacaattgaggcaggtgttagcattcctgtattacagatgagcaaatcaaagtttagaggggtctaaaactcacctaagccatacagccaatgagtggtagagctgagatttgcactgacgcccttaaccatagccctatctggcctcccttgtcacatgtgattgctaaagagccccaggagatacataggccagtattactattattgtaactttactatggggacaaggttagacaggttaagtggtctgggcaaggtcatgtggctaataagtggctaagctaggtctcaaattctggcttcctgaccacctctttctactatttcatgttgtttctccaattccagctggtgttcaccaggattatgtttctttctttgaaaaccgtccttatcatattttcatcatattctgagacctcctaaatggctcgtgactttttaaatcaaatgctgaatgatccagcctaggttgaactatttctcttaattccctagcttgcctgaactgctgagggtatttaaattatccaaatattaggacaactgcattttatcaccatctgtttttacaaagtctgagttattttccaatccctacacttgttttattaattttgaatgttatttaaaatgggattcaaagtgtcagtttggagtcaagccctctgctccccaggtctccatgggagccccttggcctggtcactcccccgctaccctccgcccacctgtctacagtctctggtcttcatgtcttatcactgttctcgatagccatggatatttaagcaaggtttcaactgttctgaggtgtcagggaagtaagtcagggagcatgtcctttttaaagcttgaagataattttctggactacagtctggcaagaggggatctttagtggggaattatgtgttttatcaggagcagccttgggagctggtgtgtagttcaggctggcatagcatattttggggccttgagtgggaggtgaagggacttaaagaaaattggttctggccaggtgcggtggctcacgcctgtaatcccagcactttgggaggccgaggcaggcggatcacaaagtcaggagttcgagaccagcctggtcaacatggtgaaaccctggctctactaaaaatacaaaaattaacgggcgtggtggtaggtgcctgtaatcccagctactcaggaggctgaggcaggagaatcgcttgaactcgggaggtggaggttgcagtgagccgagattgcaccactgcactccagcataggtgacagagtgagactccgtctcaaaaaaaaaaaaaaaaagaaaagaaaatcagttctgcctcacccaccttcagaacatttgccttctctgagactagtttctccatctgtaaggtgaggggtgatagatcagatgaaccctaagatcccttctggcttaaccgtttttcagttgggttgcctatgactaacagctagcctaaggcaaagttttatgccaagcccagagtgatcctgcataaacagaaatctgaccatgatattgacctgtctaaatattcagtggcttcccgctgatcttagaacattgtctgaagtccccatgcacaggccctattatctacttctccaaccgccaagaggctcactctagctcccgccccttccagctcccttccacccccacctcctttcattctttacggccatttatctaatcgcggcctaagcacaggggttttgcacacggtttccttctacccggacctttctccatatgccctcctcctcccttccagcttccttctcctggctaactcttacttgtccttcaagtcaggggtgctcccacaggacccagtacttcttggatctcagctcctgtcacacagtattgtgaccgctgagctgactgcttgtcagtctctccactagattggaagcccatgtgtcttactcatccgtcactcttctgtccgcccactcacacaggaggcgtcaataaaagacacattggatataaacacgtgggcaaaagaactactacctagaaggaaagactctggacaggaaggccagaaacccgttttagtccaggcttgggacatgaaatgtgcaggtctaggtatgtgaccagccgcttctggtctcagtttctggattgttaaatgatgagagagagggagagagggaagggggagagaaaggaggaggggcaggggagagataagtccgactgtgtgtttgtatgggcctgcgcttgagttatcagctccctttcctccagtgtgctttcctaggggccactagaggtcactcttgtcctacacaatggtgccaggacagtctgacttcggggtggcacccaggaagccggaatgcgtccgcctgcctccaaatcccgcactccagtctcaggaaggccgggagatgtgccctgcgcttggcctcccggaggaacaaatcacagaatcaatcaaatcccaaccagaacttcgttgcggtcccgttggcaagggtcccacctggaatgtggcctaatattaaggaaacgtgcgaaacgggactgcaattcctgcaggggtgccggcttcccggccagcgtgcagagaacggggggtcccagggcaggtgcggggtctgcggcgcccgccacgactcggcgctgggctctcccgggctccgggtccccggctgcccccggccgccagtcgggtcggccccgcacctgtttgtgctttgcaggctcccggccccctcgctgagcgaggaagctggtatgtgcagctgccctgcccttctccaggtcaggggcaggttagagtcccgaggaggcccagtcaggtttgaggacagaggggctttgcttccctttcctgctcggtggggagacggtgcatctggggcagcttgaacaggaagttcgtctgaaattgccttgagtgatggctaccacgctgaggaaggctgctcagaagtggcccctgcaggtggtgtcgcctggtaccccatgtccggctggaggaaaggctctaagaccgtcatgaccctctctggggtgctcccactcctcaggagtcacgggggcaattacttcaagtgtgtcctgaacttttcttctatgtgctttttgctctacctggaatccggtggaatctctcaaaagcctgttcttccctccaggccctgtcagaggtagcctcctgcttgggacctcacctgataacaagctgggagagcggcacattatctgcatctcccttttagcgtccctctcaggcttattttatctgtgtgcttgggtcattttgtctgctactgacttttcatttctcaattttcaatagtatgcggctcagtgcctttttgtccatgatagctgtttagttaatacttgttgagttctgctcaatcaactgctctaggagtcatgcctggctgtatgttccaatctcttcctctactgttgttaacagagaggactgtaagggatagagagagaaaatggggaaaatagtatcctgttcccttgcccttccaacagcccataccctatttggagttccttgtccctaagacattttgaggctgagaagtttatttgccctccatcctaccctctgagggacacgctgaaatggtgagcagttttgatctagcttctgtatcactgaccagagaaaataccaggaccctttatacaaggagagctgggggttttgtaggcaagttgttagggatataggcttttcctggatgtagtgtggtttgggggtcaggatttgatctgtattctatccaagtctgtgtaatagtgatccaatccataatggactctaccatgtgcttctaatggcttaaaataatttagcacacttggcagacaagatgagagcctgactaaggaacctggatttatactgatattgttaactcccagcagatgagggaatcatctgggggaagtttggaaagaaaatctgatcctgcagccatctcaaagctccatgtcataggcatatcacactcaaaccacaggacacaataggaaccagctataaaaaccatggagacttcagcatgtggttaactatgtccccctaccactgtaaagaattggtgccatcatcatcaacatttacaagtagtgtttaaggggcattattcatagttccatcgttcttttcattgtaccaattaaattacaatagacttactccttgtcttctaagaaaacactgaaatatgcaaatgtctgagcagacacaccatataaagatattacacaaagagcaggaagggaggaaaatcagacttagcctggatttcaaggccttctgcagtctgggcttattatgtgtttgtggcctttccctttgccccacaaagcatcctgtattccagtcacatgagatgatttgccacctcccaaacaaaatgagccttgaacttctgtacttccaaacccttagtgatctcatcctgttgctggaagttgcctttcctacagcctttcctagaagtatggcacatccttccagctccagctccacggccttcagccctgagacttttcagattcccaagtcagaattcatctctctctttctcataatcccatctcctatatttacccttaggtggtctgttttgtctctgagttacggtagcctctgtggagagggaccaggtttccccagtcctaattgtgtggagctggaggagagaatgtggggctacaaagcatcccctttacagcagtctacaggtggagtgaagacaggtaggaaggcaggtgtgtgtgtgtgtgtgtgtgtgtatgcacacatgttaacacacgttttaaacataacatgtttagttatgtttaacacacatgttaaggtgataaatacctgttttattaacttttgacaaagtattccccatgacatcaggtgtactggtataatctcaaaagggaaaaaagatgtctcaggtggtacaggctctgttccagatcccacagatatccaagtgcaaagtgtggggtgactctgaatcattgttgcaagggtaagcagggaaggctagtctgcacgggtattgctggtgtttggcagtgggtccacagtttaatgctccaggccccttgtctggaatgagcccacatcctgccctgggcttcctgatgcttagcagccaaagaaacaccaattcagggcccaggccccactatagggataagctggattagaactttcagttccttaaggcttacatttcttcatcacagcctctggaaggtgcaggggaagaagaagacgagggccatttcttctcagtcagccagaactgcccacatattctgctgctctctcactttagaatcaactgtttagaaatatgttagctctaccctaacttgcccatttacaggtgtttcgtctaggtcatctgggacagaatggaaatccctgcctacaacgagggtccctaagtgagtggaggtgaagaggggataccacagccttaatggacagctacgcagagagtttccagctgctgggagtgaactggaggaaaatatattctggatctgagaacaaacaaaaaactctcggaaaataacagtgaaaagcctagattcctaaacatcttggtttaaaatgtcaagtcgctgtaaaacataaaagcatttcataatcctctaatcggcacagtgatctccacattagtaatctgggagttaaaacaaaacaaacaataaaacctttgagaagccagcactcatccttccactcagtcacagagaactcccaggggctcatggcatgttcacacctttggcaaaatggcatagcgcctgaatgaagaatctaatctgggaaaaatcgaagatacaaatcatctgggatcttgttctagaagtttatagtgggacagtggttctcaaccttgaccacatatttgaatcacctggggagctttaacaaatactggtgccttggtcccaacccaaagattttggtttaattggctggggtgtggcttgggcattggggtttctaaagctccccaggtagttggaagtgcagccaaggttgaacaccacgggtagaagaaggggcggggatatgtttgtagctgggggtggaggggactcagatatctttctaactgttacattctgaatttatttcgaataaaaagagattttcttactttttgagtgccatgtcaggaggctacatttttttttaacctaaaaggaagatatgaactttccaaagacaagttttttgctccatagactgaagggagcatttttgctgtttcactggaactgcttcgctggatgtcttgccccctcccgcttgtaccttggtgggatgattatgctcctcggtgtgtaccagggatgttcatgtgtagcactttacaggatgacttaggaaacaaatcagatgaagcatcagcgctgatagccaactctgtgtttcttgaacactgaaaagaacaacttttttcttttcttgaaagtcagtttctataaaatcattcagatttctctcaagttctagactgtgttgcagagagctccttatagacaaagagtggttcaaattctcttcaggcaagaggaactaagggaatgaagaatgtgtcattcagtatcctcactgttgttttcaggtatgtatatacttatttatgtagctaacattggttatagctactatctcttaaattagcagaagggctaaaagaatccaaactcctctgggtttcaatgagtaagcttgcattaacaagatttgtgaggctcatttctctacatatttacttctctttctttttttctatatactgcctcagaaccttaagtataagtatttttataaatatatatatatactcttacatatatatttatatttccgctttttacagtgtctatttcggcctttctgaactggggcactaacctgaatgctagtgtttagagtaagtaccactttcctgttaactcacagccagctcgtaaatctccctgatcccaggcactttcttgccattcggtgctctcagcctctgcagcttgtctttcctgctgaggggctctgaatggcctttcaaaagggctgcagctgatgtggttgatctgcaccaggggggccttttgctccaggtcaaagatgtctgattctaagtcttgctttgtaaaaaattatcctattttttcctgatattttaacatctgaagccctgcaggggttaacagctttcctcacatggtcttagcctgaacgttataggcactgaggctccttacctttcaccatgcatcaaaacagattccgagtgaatcaaagaaatgaatacaagtgaaacaaaaaagaatctggaagaaaataaagatgcatattgatctgatttcaagaatgtaaattcatacacatataagtagaatggaagaaaggtaaacatatttaactatataaaagggaatatttctgtatgtcaagataatactctaatagttagaaaaatagcaaataaaatactagagaaaatatttcaatacatagatagcaatggaggaaattgccttatacctgtattagagcaaacttaataaaacagactaataccccaacagaaaaatagcaaaggacatagaaaattcataaaagcaatacaatactaacatatgaaaaatcttcaggctcattaatgctcaaagaatagaaattaacataagaatactttttttattatggagttggcaaagatgtaaaaaatgttactatattgtgttagtgaggtgaattgtaataacaaaatgttcatatttcctcctccatctcagacctcttcaactaagtttggatgaggtaagaaaattgaaaggtggtcaggcgcggtggctcatgtctatagtcctagcactctgggaggccgagatgggtggatcacctgaggtcaggagtttgagaccagcctgaccaacatggtgaaaccccgtctctactaaaaatacaaaaattagccagttttggtgacacgcacctgtagtcccagctactcaggaggctgaggcaggagaatcccttgaaccagggaggtggaggttgcagtgagccgagattgcaccactgcgctccagcctgggtgacagagtgagactctgtctcaaaaaaaaaaaaaaaaaaaagaaggcagaaaaagagaaagagagagagagaaagaaagaaagagaggaagagaaaattgaaaggttaatcctgtgagataaaattctaaaactcagtggattctaaggtgagcaatctgaacaccaggtcatttgaggaatggttgaaggatctgagagtgtttagcttggagactagagcttttagggtagatatatagaaaaattgataaagaagaagatatagattttctcttcttactttttccaaagcaagagtagaaagggcaagaaaacacctttggcctaatacatggaggctctttcctacaatcagagctgtctagtcctagcatgagccaattcctgagacgagccatcccatcaaacagaaactgaaaagctttttgtcggggatgttatagaagaaacctcttgacccgtatgagttctttgaaattttacctttataaagtcatcttttactaactatagaactttcatagaatggtttatttttgaaagaaactaatttaaatgatcccagacaagtgaagataatggaaacctgcagggagtacatctggttgaccagagttcaaaaaatgtaggtaccaaataatatcagcagtgtagaactaaaatacttagatgtcttgagtctgctgggataaatggacaaatggcctactggtcccagaaacaagtcttcatattttgtttttgagtgtctgagtcgtggtattgaattaatggggttaaggtttttcccaaagcttcttttacctgatctctctgtgtccagaaactaaacatggtgctttcaggtatcattagtgagagattgtggcgggtcaggtgggtggccagttcacccctcaggatttttcacattagccaagctctgaatccagagatgaaatatcataatatggtctggtctgttccaacagggacacgaagatatttttaaagtcttagcacctgggagttacttgagtattttcagaaccattctgtttggttaacatcaaatgacacctctctaaaggcatgcagttagatgccaatgtttttctttgatataggttttaatgagggtgaaatgaaagcaaaagttatatcccagagagatggaaaaaatgagcagtatgtggaaaaaggaaaaaaaaagatgtgcatttcttcacagaataggcaataagatttttggttcataggagccttgagatttttttcagctaaaggagaggctcatgcagatctgaaatttaaacattaatatggaacctattagccccaaagcagaaatactttacatgtctatttatggcaccacccacaggctgcttcctgttagttgtttgtttctagtgacagagatgagctcctttaggagattcttctgagctcctttaggagattctgagattcatctcagaatcccctccccaacaaccccaaaacaccccacattaaatagctcttgaaagccaggtgaggatatggcctagcaatagaaagatcaagggacattctgatccgaaacattcacattgaactttacattcagaatttccccctaatttgtctacttggaactcttgagcccttacagttatgggaccacaattctatttttttttttttttgagacggagtctcgctctgtcgcccaggctgaagtgcagtggcacggtctcagctcactgcaacctccgcctcctgggttcatgccattctcctgcctcatcctcccgagtagctggaactacaggcacccgccaccatgcccggctaatttttttttgtatttttagtacagacggggtttcaccatgttagccaggatggtcttgatctcctgaccttgtgaccccccgcctcggcctcccaaaatgctgggattacaggcgtgagccaccgtgcccagcccgggaccataattcttttaaaattttagttagtcattgcaaattagatcactgaagaagaagaagttatgtctgacacaaagtaggatcaatagaactggtgaatggatgaagagatatactttccagtttccttgggaagcctcccttgttggcatctttccctctgagaatgggctccgttaggtgtgagggagttgaaggtgcctgtgtatatggggcgggaatataacctattgatatagatttttatatacctcaaattaaacaaatctagagtcattgctggtttttaataatccctttgagaagagcataataaaaacagaagggaattccccacttcttctggaaaaaaaaatgtgcttttactagaattctgtgattgggagacagtcttagaagtagctcagagaagaacttttaaaagggtctgagcacttttacactgttggtgggactgtaaactagttcaaccattgtggaagtcagtgtggcgattcctcagggatctagaactagaaataccatttgacccagccatcccattactgggtatatatccaaaggactataaatcatgctgctataaagacacatgcacacgtatgtttattgcggcactattcacaatagcaaagacttggaaccaacccaagtgtccaacaatgatagactggattaagaaaatgtggcacatatacaccatggaatactatgcagccataaaaaatgatgagttcatgtcctttgtagggacatggatgaaattggaaatcatcattctcagtaaactaacacaaggacaaaaaaccaaacactgcatgttctcactcatagatgggaattgaacaatgagaacacatggacacaggaaggggaacatcacactctggggactgttgtggggtggggggaggggagggatagcattaggagatatacctaatgctaaatgacgagttaatgggtgcagcacaccagcatggcacatatatacatatgtaactaacctgcacattgtgcacatgtaccctaaaacttaaagtataataataataaaaaagaaaaagaaaaaaaaaagggtctgaggccaggcatggtggctcatgcttgtaatccagcactttgggaggctgcggcaggtggatcacctgaggtcaggagtttgagaccagcctggccaacatggtggaacctcatctttactaaaaatactaaaactagctgggcgtggtggtgcatgcctgtagtcccaactgctcgggaggttgagatgggagaatagcttgaacctggggggcagaggttgcagtgagctgagatcacaccactgcactccagcctgggtgacagggtgggagtctgtctaaaaaaaaaggggcgggacggtctgaattctggacttgtgaagaaaagttaatgaaactggtgtgaattagcctgaaggagaaaacttctgggtaacctaatactcttcaaatatattcattctgtaaggagcctatgatgaaatgaacccagacaatatcatgacagagtccagttatccatatgtatatccatcttatgtaattgtaattttatagtactggactgttgttgtagcacattgttgaaaaaagtgcactagagtaagggtcaggggaactggatcctagggacttctagctttgtcacttactagttgtgtgacacttgaataagtcacttaatactttaagactcagtgtcttcaactctaaaatggaagggaggcaggaattattctatatgcttcatggttctgtcagaaggttaaatgagataatggctattaaagtttttcattatctataaagttgcagccataggtacagtgggccccagtgttcttatacaattaagtgttcagacaggattgaaattgtggtcactcttttctgagagggctttaaatgtggggcatcctctggtccagatggcttggccacagactgaaggctgggggagagagccagatcacctcccagtgtcactccacctcaggattcttagcatccgcttgttccctcaggtcaatgtgtcagaacagaacagccaatgtgatgaaagttgcttccctctttcctaatttttggagtattttccctccaaatggaattgaacaaggcacataagggagaacactgggatctgatctaacacctgtttttggtttgctttttctctggaaaggtaagtcctttcgattttagatgtcagttggcttgtgaggccgaacttcatgttgcttctgtttgttgagagacactggagatatttatcaggtacaaatgattccctagagcagggctccctaacccctgggccatggaccaatcctgttaggaactgggctgcacagtaaaaggtgagtggtgggtgagcattaccacctgagctccacctcctgtcagaccagcagcatcatcagattctcatagaagtgtgaaccctattgtgaactgcacatgcaagggatctaggttgcacactccttatgagaatctaatgcctaatgatctgaggtggaacagtttcattcccaaaccacccccaagcccccaacagtctgtggaaaaactgtcttccatgaaaccagtccctggtgctaaaacagttggggaccactgccctagaggacagtggctattgctttgtgatcacacaaggcaatgggtagattctgtattttgcagatgcccccaaaatctcctctgacttatccagaatgggaaccattgttctggatgtgaatggggccatcttcttctgagaaaggtgagaaaccagggaacatgacaagggagggacccacagctggattttttctggaaaacaaaactagccagctactgccaccacttcctctagtcatagagcctctttgtgtggcctcttagtggcttgactttgctgatgaccactgagaacacaggctccaaaagtgaagaggaaacagggggaatggggaccagaagagaatagaatttcagagctcaaagggaagctataatctcttgtccaacccccgactgaggaaggaatcctagagcacctctgagatggctgctcacactctgattaataggctacctcctgagaaagcctatcctgacctcggtcagaccaggcaagcctttggaaaacgagctcattttgaagtgaaatctatctcttttaaattgcactccttggttttctgtcattttggagtattctaggccaaatctgtttaatttcacttggcagtcctctgaagaaagtcctcatgacttaccttacttttctcctctgaactaaatttccccatttccttcagctattccctgaagaatatgtattccagatgcagaatactcttgtttgtacacactgcaattttctaaaacttctgtcctatgggctagagagcacctactttttgtctggttcctagaataagaacagtctcttatataaggagttgggactggagtaggggggtcttacgattggttcattcactgagatgggaaacaagaaccttcttgtgaatgtggttgcctagaccatacataaatagtgaccccaagggtgcttcctgtgtgatacttgacataccttagctctgagttcacacagagttgccctttcagagatttcaaatcttcccaggcccagtggcaattctaagagaatgagaattaccccatgtcctcgagcaatcaaagaagtcttctggcctctccctactcctgaaacactagaccagaatacccaactggtggcttgaattggggcggggggcactgacttgctctatatcctcttcctggttcctccagacaggagcagttacacattcttctgctcccagaactttctatccccttctgagctaatatggcttcaagctgtagcaagaactagcagacacagaacacagagtctggccccagaggcttataaaagagagaaagagacaccaaaggctgaaatcacttcctagcattttctttcatccctttctgcacagtctgcttcactgaaaccacacccttcctgtgagacccccatcgcagaccactcagctctttagtagttgctgagcagagcactagatgtggtcttgaacatgtacatgacagttcctgtctggcagcttacagtccaccatggcacagcccaggatcgagccaatgaggtctagaataggagaggtgttaaactggcagtaatttataggcagaacagactcagaagaatgaagggcccaacatttcacagtgaattagtggcaggatcaggggctggaatccagttcccttgaattccaatccaaaactctctaatccaacatatgtaaaatcgttatgtgtgtatctgtatttatatttatagatgtatgcatatgcatgggtttgtggaaggctttatttcaaccatattttccaaattgagtctcataataatcccatttgacagtgaaggaagctcaggtttgatcacaaagataaatggtagcatctgaattcagatcctcaccttctaattccagttccaatgttcttccaattacctgacattattatttgagctcagtgggtgttactaaatccttcttaaggatccctgtagaatgaaattctctttgtccttgtccctctcctacatttttttttttttgaggcagagtcttgctctgttgcccaggctggagtgcagtggtgtgatctcagctcactgcaacctctgcctcccagtgattctcctgcctcgggctcccaagtagctggaattacaggtgctcaccaccacacctggctaatttttgtattttttttgtacagaaggggtttcaccatgttggccaggctcatctcgaactcctgacctcaagtaatccccccgcctcagcctcccaaagtgttgggattacagatgtgagccactgtgcctggctggtttcctacattcttaacaaagttgtaacacaactcctcactattatggtgatggcaaaagttgaacatatgacatatcgctagctagtgggagtcagtccctttagtcacccttaaggataggtatagaaagacaggggttaaggtatggccagctccaaacagcaggggaatcatcttggaggcagggacgtaggggtggggtaaataggtttagagtcctgcctgcatccttggttggagggaaaataagctcattaaaaaatgctacccttgactatcatcttctgtttcatccttttgcttttttgtaattcttagcatgactttttatcataatcctaacaaatgttttgtcaacacattatcttaaaagtctgaaaacattcctctttggaagaacattcttagggaaagcaattgtatccttcctctttctcaaccagccagatttctgagttgaggaaaaggaaggcaatggatatttattgagcatttactatatgtcaggaactttacacagattacctcatttacttcgctccacaaaagaggtttcacagacgaggaaactgacgctcacagagatgacataacttgcctaaagacacacagccagcaagtaacagagcagggatggacaccttggcttgttagactaaagcatttggccagtcccctccacacagtgcacacagtcttcctgacactgggcaggctcagctcctaagctcttcggttccagaggaccctaaccagaggaccctaatcactgctgcagagtcagcccttctgtcagaaatggctttgcagatcattatttaatggcagcaggagatttaaatgcactcatgatcctcagaaaatcacacccaggatgagagttttcaagctgcacaggaccttaccacatgtacaacaacccttgaaatctgaagattaggaaactgaggccaaaggattaggataaaataattttcccaggtcatatgattatttagtggtaaagcagggaccagaaccaggtctcctgcctaggatgaaggccaggaattcagcacactcatcatgaactactcagaagtgaagagaaaggggataaaatactcaatagagtcctgctgacataggtaggaccgggaagaaagaaaaacagacgcaatgtacatgtagccagaaaaaagagccagcatgtgaaccgagactgaaaatgaagatctagcgtgggctaaataagtcactcaataagtgacttcccagattgttttttgctcccattgcaaatacaattggaagccaaatgcaagccaccaaggttgcagtgaaacagtgaataattatagcacaaatatttgtgggcagctgttggagtgcaagccacctgctccaagtttacagctttgttaaacttggtaaacattaaaaatggaataggaatgcctccagtctgtgcagcatcccatacccttcctgagaggcctcactcggggagctggggtggccttgcccttgaccaggcccttctcactgtggcctagagttgttttgtttgtagagatccatgttgtcaagtctctaatagagactgagggaggcagggagtgtcacagaatcgtttatttgtagagttttgaaagggtcacagagccctcaaaatataatctctgtcctattattcagatgaagaagctgagatggagcagtgatgtgctcaagtcataaagttaggggcaggacagactctttatctctgaccttttgagcactaaactctttgtttagtgctccttcctgtaagccctgtgaggttaatagatggtaacaacaagggagtcagcattacagaatgttacagctgtgagggacatggttctcaactaccaggatgtttggttgctacatgaccatggggcactattggcatttggtgagcagcggccaaggatgctaaacagcttacaatgtgatagttgtgtataacgaagaatcatctggctcaaataccaagagtatccttgttgagaaatactttctccaccatttgactttacaactggggaatctaagatagggaggggcttgaacatgttcccaaaaggagtcagcagtcacctgaccccagaccgctctttgtcctactccatcccactgagcccttgagagaattagcagcaaccttggtgtcttcagcctccccctccctcagctcctgctgcacttgctcccgagctattttcaggttggcacgtacttggactttaggccctcctgcccatagggctgcagcaggtactggtgaaccagcttgtctctgagagtcccagccagcttgattttctttcttgatcgatgcaagttgatgataaaaagtgtaatggacccacgaacgtagttgtggctgagatccagagaaagagagaagtgaaagatggaaacaaagtggtcagttagatgcttctaaataatttatagactgtacaaaatatgaacagccctgaaaatggcacttaaaaacttggccaccatagaccctaaaagaaaggaaggccttgttattgtggtttcttgcaaagatgatagccacttcctgccatacttcttttgtttttgtttaaatttattgcaatgattttagaaaatataatgtatatattttatggcatatattaccatagtatggaagtaaaacatgctgattgcaaaaaaggaaaaatattgagaaacaaaaagaagaaaaagaaaattccccataaccctcatatcttgagatatgataatattttggcaaacatccttccagtattttttagtttattaatttgacaaatatttattgagtactttgacacattattactcagtttttacataactggaatcacattattcacagagatttttttccattaatgaacatcttaaacatattcccatgtgattctttttctacttgtagaagaatgctaaacttttcaatcatagaagtgtaacattacttaactaatcccctatgtttgcagttcagacaactcatgtttgaacatttttgccattataaattatgtcatgtgtataaactttttgattatttctgatggataaagtcctagacgttggaatcattagtccaagggaaacgtgtgttgtatgattcctcaccaaattttccagttcattcccagtggtgcacctccctgtgggaagattttttcttcctgccctactaagtgatcgcgtgatttgctttgtccaatgaaatgtgagtggacatggcaaaaacctctaggcagaagctttaggactcagcccatcttttgccatgtttcatttccctctgccagaagactgacaatgttcttgacaaaggctgttctattgaatgaagatgatgtgggcagaggtacagttgagccatgatggacaagtagtgtgaatgagaaataaattttcttattgaaagccttggagatttgggggctattcattattgcagcataacctcacctatcctgacagatacacactttttgatgccattgatattaactctctaggaagctttcactaattttgctcccacctgctctatatgagagcacctatttcctcatacccctaagaacacttccaatgtgttcttttaaaatacctttgtcaacctgagaggtgaaaatgggatttcaatgttgtattaatttgtatttttaaaaattaatactgacatgcagcattttttcatttgccatttcatttcttcttttgtaagctgaccatgtcctttgcctgcctgccttcctttcttccttccttccttccttctttttctgtccttccttccttccttttttctttcctttcttccttccttcctttctttctttttttctctgtcgcccaggctggagtgcagtggcacgatctgggctcactgcaacctccgcctcctgcgttcaggcaattctcctgcctcagcctccctggtagctgagattacaggcgtgcgccaccacgcccagctaatttttgtatttttagtagagatggggtttcaccatgttggccaggctggtcttgaactcctgacctcaagtgatcacccgccttggcctcccaaagggctgggattacaggcgttagacaccatgcccggacacctttgcctatttttctgttgatttataaaaactatttattaaagagcagtcttttgtctgcaaaatttcccccagttttctttgaccgtttcagtttatttacattgtattttaatatataaaagttaaaaaacttttatgtagtcaaatttatctttttgatttcttcttttgctgttttacctacctcaagattataaaactattcaccattttggaatctttttaaatgagcataagatcttcagaagtctgagagaactatatgcctacatgcactagcccttcagcatgtatcagcaaaactataatgatttccttctctctgtaggaaaaaatgcttagtttctaaggggtcccttagggccccatctggataggttaatgagaggaaacagaaaaaaatgacccagccccaccttcaaaggaggagttcagagaaactctaagtcaactttgcccagaggaaagcatcattccttatagaaataacacccctccatcctgggtcactcacctctgcttctaaaggtgctaattaagagttgagtgaccaaggacaggtcagtatggtgacatggagttttttatttttgtttttgtttagaagcacagtttccagggctcttccgtggagattttgatgcaatctatttgggattagggactgggaatctatacttaaaaaaatctttctgggatatttggcagatgaattgggtttgggaaccacttgcttagaacaatccattaagattatgagaagaactactgaagtatatcctgctggctgtgcgtcagaagattttttttgcatctgcaggagggtacattattgtgttcaaggcttttggatgcctgcatttgtgttctgataaattattaaaacgactctttcatccagttcctcctcctccggtccttcttaatctcctgcaacatgtgaactagcttttgtagctaaatgagttaggtcagaagagaatgccagttgatttaagcagacttatgtccccagaactctgaagaaggatgctggcagcctgaatcagtgttgaccatcattaaagaagaacatcgactctatcccattggtggggtttcagcttagcttagctatctgtaaaactgaggaagacaccattaattgcaggatctctaggcttcagagtgggagcaaaatacatgtggatgggtatcaattttgccagactgcagtaaattcttttgctagctaccatcaaacaacactctcaaaggccagcagtggaggaggagagagccacatgcttgcatttatgagtttctcctctgcagagctggggcagaatgagcccttggagactgcagaagagaaggtgggatgtggggaagtggtgggtgggagggagacctgaaatcacagcactgctgcagggaaagctgtctttttcaagctgtttggcagtggtctgatttccacttacatagttcccctggggaagacaaaccagtacagcccagagacccacatatagaggctctcagaactcatagcgccttctcaggtaggaattggcattaaagactgcctcagccatccctctccctgcttggcttatgggcaaggacattaagccaggcctttttgctgcaaagacacattcttggctggcgagtgcagcaccaacctgaaagtagtgtgttgagaatccaaattcctgaggaacatatattctctgaccacagaaaaataatcttggagaaaatggtgtctgaaggcttggcctgcaagcatttgctggccctctgaggttatcaagtccaggtggcttttggttatcttagtgaatgttcctttcaggagagaagttgtctgagaggaccatctatcttgccccatgtctcactcatgggtgagatttttttttcaccagcagagaatccatgtatctggagttcattttttctggctgttcttttcctgcctgagatttctctgtgttgccatgggaggaggcggaagtgagtcagggaaaggaggctggaattggaatatcctaaatgtaagaggtggggaatgtcatatggggaggtgcatcttgacttccagatagaaaacagtcatgttctagaaatgtctccagtgaagctgggaggctgggaaagggaaaggaggatgatgctttgcagtccacggtcattcccactgaaagtcaatgtgcttgaaactgggttgatccattgtctccaaatctaattcaaaggttttgggttcggtaaaagccaggccatgttttgccaaacattttttcccttaatttcaaagcccctgtgtattttaagggaaatttaatccacatgtttctgattcatttacacttaactcatcaaaatattgttttgtaagagccatttgatgtccaagaagcctcaggaaccatttttatgagtctttaaaaaaacttcttctgaaaaacaggaagtcatgttttgccaataataaatgaacttgaaccccaaaaggcttaattttccttcagcatccaccaggttccaattggttctgaacttggctaaggacctcatctccaccccagaaacatacgttgtttcagcagaatggctcataaaaagaggcttcctcatcaaaacttgattgttctctgaacaagaagatcgaggatgagaactgccattctgtcagtgtcctaatttgttaattctagaacagaaaacagaaaagcacctgctggtggtggtatgaggatctaactttttctcctaaattaatcataagagacagcactctacaagatcagaaatgacccacaatgcaaggggctgccatgacaggcggtgaggtatccacataggggttgcatgactgtcagggagatgtgaaatggattcctgtgttgaataggcactcggctgaatgatttctaagggctctttccaaatgtaacattctttgcattattaatgctgttatttgcatgtagatgtgataccgtagaacctttgaaattcaataaaataagtgcaaatatctggaaagatgcttgtcacacagcaagtattcaatacacactggagtgcaggggttgttattttaatagacactttctctggatgattctactcataagtttataccttctccccaatccctgttttgacctgggacaaatattttcagagtattcgtcaaggttgaatagtgtgaatccaccatgcccactctgggataattctgtgattttggcctattggccacagataaatgactcagcagtgcttccttaatggcacatgatttctcagagaggtgaacagatacttcttctacctttgagctgccctagctggacactgacacctgttgacatggaggagccctgcaacctcagccagctccgtgcattcactgtgggttttctttatgaatctaataggaacaaaaacaccttcaacccagttattatcattagggtcacatgtagaacggattatgaaagtcttttctttctgtctttttaacagagagtgagagaggttgtactgatagaagcccagtgacaccgtttctctagagaggttctggagtgactttgcatagaaattagaggagagctggtggtgtagacagacagtcttgaatgcagataatttcagtaacttgtttgaggtctcatgctatggaatggtagaattcctaaccactccaccataccatttccttctggctgatgtcgtaatatcaaaggggaagaaagctctaactctaaatcaacagtaacatcttgatgcccaaattctgcatttgttcattcatttgcaaacctttcctgggatcttcatgccagtcactatattagacaccaagaatacaaaaatgaatgagacactggccctgagttcatggtacactcagaatattaatgacaacttcccatgaggatgttaaagaatgaggatgaacactcgagatcacgtgaggaggcttctatgaggagacgcaaatcctgctaagcccatggctgcagatattttttcccccaagtcctcagattagcggtataaagaccacagactgatatgctttccaacagggatataaggtgccaagagtaatttttctatctcgagtctgggggtccaccttttgggtggttacctcagggccagggcagagacaaggaatacaatgtttccttgtgtgatgatcagataactccaggccaaggccataaagcagtcactctctgtcaggtattggattgagcttcctgttgagcaaaagggatgttgaaagcctctggcctctgcccaagccagcctcccctcatttacaataggcacttgtatctactgacaagacaactggcccctgccccccctctcctcagagtgattctttgaaaagtcttatcatgataaattaattggcttggctcctctctcatcaaggaagcagaaggagcatctgttgtaacctgaccactccaagctctttgtactaggtactccccttgatcagttcctgataggcctgggctggaatgaaggtctggctggaggcacttgcttaccattccctgccccgtatccccccaccaggttttctttgcattaagagaaagagaaagaattatattttccagggcagcctactctgccttaaacaggaagtgatgtaagaaagccatatttggccagatggattttgctttaggcaccccccacccctgattatagttttcccttatggtcttcatgtgtcaaaattttttatctgccaagcttatatttattgacaattaattttcctgtttgttttaaagacaactgtaatgacaaccagttcttcagatcaaaaagaggataaccccacactaccacattaggttgttgtccagagccctcagaaaaggaagcccagatttcacttagcctcttaatttttaaaatagctgaaaagattttcaaaacactggaaatggctctaaagctggcatgaccatctctgggcactcctttagttctggggacccccagcttgacaagcattggtctagggctaggtttctagcggcatatctctccagcatgcatcttagaaagggagatttattttctcaagctttgctggtggatcataggaaaagattttatacctcttgacttggctaaagcttaggcacacaaaaaagcctcatgggcattacatcaactggcacagagaaaatgctcaataaaaatgtgttggatgaataagtaaatgaacaaatggcaagaattttaggaaccttttatgattaatcctctaagtatgagaagggagcgtttacttggagtaaaagctatttaccagaaattatttgaaacctccaaagagcaggtatggtgattccagaggcaaaaagtttttgataagattagtgaatggagatgagtcttgaaggggtcccaaatggtatggggtgggagcccctcaggtggcctttctgccatctttctgaggacttacttgtggtggtttgtgcagtgagcataaatccttagtttgtcccggatcactcggccaggccgtggcttccgctggagcccagccacatgcacagccaagactttggggccgatcaggcgcttgtagaggagagagagccagtagtcctgaggagaatagagagggagagggtcagcgagagaacacatgctcaggtgttctgagtaaacatgacacacacacacacacacacacacacacacgggccagaaatcacttcctacctggagtcatgagtcatgaccaatgcagccctaagcctacaagcatggtcagccccatgaaacacgaacgtgggttgataatgaaatggacactgtctaaagtggcctttcaactaaactgggatgtgtaagtggagtcgatccacagcagcatatgaacaaatcaatcaaggattttcatatatgaaataaaaccatttgaggctttacattttcaactttcttttcctatgactttacttttatagcggcttatgatttctgtttaattatggaatggattatttccattccttagaattgttactaacatgatcatccaaactgtcattctccaaatattatcactgaagactactagtgcagtgggactgaggtgaagcttctccacataggagaccagagtccttgattccagagccagaaaggcaaacagaaaaatgtttgcaaccacggtgctaattcttggttatcctcaacagtttgacaataaaaagtgtaattctaaactaaaaagaatgtgatgctttaatcattccatgtgtaattgatttaaaaattttcaatctgtggcacacatttatatgagcttacaaaaacccaccttaatttctgttgcatttgctattatcatattttgtgtttgcatctgacataaatataaaatttacatttctgttatgcaagctcttaccagctattgtgaggtaatgacttcagtgtttataactcactgtataaaacagggcttcctaataacatttaggaccccctaccccactcaaattcctgaattcagtgaatatactattcagtgcatactcttcaatgccttaaagacatcaatcgtgatttattaaacttcatattttcaggcagaagccttctgataatcttttttttttttcttgtgtggtcatttataatatcagctgcttaaaaatatctgatgaactgcataaatcagaataaagtctcaaagcccctttgccactagaatggctccaaatctgccctgagtagtgtgctctaagccatgcacaaccatttactttaattttaagtggccttaggatggctgttaaatatggtctcctaatattaaaaaaggcaaataatcattatcaattatatagatggaaaaagtgttgtgggtttaagatgctcaaatttgattacaatttctgtgtttttgatgattactttatgaagtggttttcacattgcaagggaatttccacctttttcttactgatttgcaatgtactttcttttaaataataaaagtaaaaaactgtaagttagctaggattagcttactattttctcagtagctcctctgatatagtaatagggattattattcttattttacagatatgagaatgtttcaaggggtatctcaggtcacaaaactagtgaatggtagactatgaaagcaaatagggatccatttgcctccaatggctgtacaacgctttccttcatgctgtgaagtacaaagtcatattatataaagacacaaggcagctgaaaaacaaggaattcaacctaaagggtgggtatagaatccggaagggatccttagttttttgtatagaggttgccaaaatttaatttctgatttttacactcacaaagcatttagaacacaagaacagcaaatgcacaaaacacttctgtttctccaattccggctcactacagttctttcccatttttcttatccttcattccaatgtcttatcacaaacacccctgtttttatttaggtaatttgaaaaagctaaacaggctttctctcaaacttgcatttgggtatagccattacctttgtgtcgtagcaattttcacttaatgtgagacatgtttgtaagcaagccactcacatttggaaaaaagagatattatgtttacggtggctcacgcctataatccctgcactttgggaggccgaggtgggcagatcacgaggtcaggagatcgagaccatcctggctaacacggtgaaacccggtctctactaaaaatacaaaaaattagcagggcgtggtgatgggcgcctgtagtcccagctactcgggaggctgaggcaggagaatggcgtgaacccaggaggcggagcttgcagtgagccgagattgcgccactgcactccagcctgggcaacagaacgagattccgtctcaaaaaagacaaaaaaaaaaaaaaaagaaaagaaaagagatattatgtttattacgtttaattctcaataattatgtagagataaaaaataaacttatataatccccaccataattgagtggcaaactttagatttattaacttgaaacctgtctgcttttcaataggagatagctaaatgccatgtcactctctaaaaaaggagatgaggatacctgggtaaaactctaaagatgtttgggatagatatataaaagaagttgataaggttaattcctaatgaccaacattttttcccaatttttttttactgtggggagatccacataacataaaatttaccatcttaaccatttttaagtgtacagttcagtggtattatgtaaattcataatgttgtataaccatcaccactgtccatctctataacttgtcatcttgtaaaactgaaactctgtacccattaaacattaactcttcattccccctcccccaatctctggcaaccatcgttccactttctgcctctgtgactattctaagtatctcatataaatgaactcatagtatttgtctttttgtgactggcttatttcacttagcatagtgtcctcaaggttcatccatgttgtagcatatgtcagaattttcttcttttgtaaggctgaataatattccattgcatttgtataccacatttgaacttaatttgcagcctaacacatggcttatcctgcaaaatgtcccatatgcaatgagaaaaaatgtatatgctattgttgctgggtaaagtgtttggtgtgtctgttagatctagttggtttattatgttgtttaactcctctacttctttatttctgtattgttttcttatcattattgagaatgggatattgaagtcttcaactgttattgcagaagtgtctgtttctctttcaattctggcaactttcacttcatatttttttgtgatctgtaatcaggtgtgtaaacataatgttatatattattgctgcactgaaacttttattaatatataatttccttctttgtctcttataatcttttaaaatttaaaatctattttgtctgatattaataaagctgcccctactctcttttggttactatttttatggaatatatttttccatcctttcaatctgtttgtgtttttgggtctaaagtgaatctctgtgcagacagcatagagttggatcctgtttttcttttaaaatcttttctgccaacctctgtcttttgactggagagtttaatcaatttacatttaaagtaactactgataaggagggacatctgtcattttgctgttttctatgttacagcttttttgtacctcctttcctatatcactatcttcttttgtgtttagttgatattttttagtgaaatgtttaaattcctttctcattaccttttgtgcatattctataactattttctttgtggttactttggtattacatttaacatcctaattataacactctaatttgcatttataccagcttaactttaacaacatacaaaaactctgctcctttacagctctgtcctcacccttctcaattgtttgaaatgcttgttctccggtgccataaagaaatagcacttgaacataaatttaatttatttagtaaggccatttttacttcctgcagaaagggtacacctgcaagcagttttgccatgagagtatactgaacaaaggagacagggtcatttataacctgacgcatccaccctactgctatgtctggtttccattggctggaacgggacctcacattctgtatttgtcccaattggctagcaacttagaactgtttaaaagaggcaaaggtagaggagaacaaaggaaggaggaagtaacttgtggaatgctgagaaagataaaaacacttttaaataaggaagaggaacaggctatgacctaatgcttgcttggaccaatataagcatgccagggcaaatatttaggctaaattgtgggagctaagaacataaagtacattgatttctttattatggctagcagatatttaagaatgttagcacaggtctttgaataaattttgcttttaagagaagttactatttattcctaattagacagggaggaaagtctttgaagaggaacttctatttctctttttacatcaatggttgatgtcacaaaattacatcttgatacattgtgtgtccccaaaacataaactgataattcttttaaatacattattctcataaattatgtagaaacaaaaattggagttacaaaccaaagtaacaataacactagcttctagactaataattgtttttaaaagaggtattagtctgttaaaacatgcagaaaaaaagtttaaaacctattgtcttaataggagttaaaacctattattacaataatgccagcttgtatatttgctcatatacttaatatttattgagatctttattttttcatacaacattgaattactgtctagtatactttcattgcaacaagcaggactcccttaagcattttttgcagagcaagtctagtcatcacaaaatctctcagcttttctttatttgagaatgtcttaatttctcccctacttttgaagaaaaaattttgatggatataggattctttgttgacagtttttttttttcttttagcactttgcatatattggctcactgccttctggccttcaaagtttctgatgagaaatctgctgataatcttactaagaattacttatatttggcaattcacttcactcatgctgctttcaagatttgatttggcctttaaaatctgattaaaagtgtcttggtgtgggtctctttagattcatcttatttagaattcattgagcttcttggatgtttatgtgcatgttctttatcaaatttgagacgttttcagccattatttcattgattattttctgtgatcctttttctcttctccttctgggactcccacagtgtgtatattagtccacttaatggtgtcccccaggtccctttggccctgttcatttttcttcaatcttttttctttctgttcctcagactagataatttccactgtctttgaatttgctgattctctcttctgactgctccaatttgcctttgaattcctctaataaatttttatttcagtcactatatttttcagctccagaatttttttttttgtttctttacaggttttctttctctttactgatattccattttgtttatacatcattttcttgactgtttccacatcttcatttaacgtcttcaagagaattggtttaaagtctttgcttagtagatctgccatcaagtctttttcaataatggtttctatggatttatttatttttttctttgaatgagccatactttcttgtttatttgtatgctttgtaattttgttgttgttgttggaaactggacatttgaatctaataatgtggtgactctggaaatcacatcctcttcctccctagggtttgctgatttttagttgtttttggtgtgtgtgtgtgtgtaagtgtgggtgagtatgtgtgtgtttaattattgtaggctgcctctgtgccaaggatcagcctgaggtacaaacttaaggtcttctcaggtcttttttgagcctgcaccttttcttgggtatgcgtactttctacttttccctgtatacacagttgcttttgaatgttcctgtatttaatgtgtgaaaggaaaaagaggaaaaaaggaggagagtaaaaaaacaaaacaaaacaaaaaggcaccaatcttttaaatcccctacagtcacttcagccagagggggagaggcttacatcaatggagagaggtgcaacaacagtggttgcctgcctctttatctgcaccttttggtcagaagcagtaatcagagatgagagtagagatccttggtatttagaggatggggtattttttgaccactctgacttcctgcaagctgtatgcaaactgctccaggaacacatacacagctacctgccatagggctaagaggtggggaatgggtagtcactactgagctaagagctgaaattgaccaaaattaactgcaattcaccttcctagctttcccttgaaacttgcaagactttaatagaccttagagttctaaaacagttacatgagacagactctgccagtgcaattgttgtctgagtgaagagacagattcatgatgcttcctattctaccatctttccagaatcctctgtaacatagcttttaattttggtagtaacaatcctttagttgtatacagtataaatattctgttcaagtttgtagtttgacttttatcactttttatggttttttgacatggagaattaaaaaaaaattataggaaaacacatcaatatttttctcttggtttctttttttaattcttagtaagtccttcctcatataaggattagatacatcttcacttatatttcttctagttcttttttatattatttaaagatttaaacttttaattcattgaaaatgatttgatgtatactattaagtttgctattttttaagtagtctagtaattattttagtatcatataatgaataacctatccgtaagcccatccttatcacatactaagtaatagtaagtcttcacttaatgtcatcaagaggttcttggaaattgtgactttaagtgaaatgatgtgtaacaaaaccacttttttcctcatcaacattacaatgaaatgacattgagcaaaatgacattatttgaggatttgctgtacatcatttcacttaaagtcacagtttctaagaatctatcaatgacattaaatgaggactttgtgtgtatgtgtgtgcatcttatgatgtgggatattcatgatatactgataaacaatatatataattctgtgtctagattttctattctcttccactgaactctcaatttttaatcagtttcacagcattttcattattatcatttattttaatatctacagattcaagtctatttcattatacttttattattttgttcaaacttttcttatttaggcatatttatttaaagcatttttgaaattgatacataatcaatatacatattttcagggtgcatgcaataatttaatttgatcacaaatttgtaaatatcaagtcaatgtaactgagatttccatcacctcatactcatttgtttttccaaataaattttgaaatcattttcttttttaaaaatgtcaatattgacctcaagcagaatgagatcattttcttgtagcactgttgcagagaattttgaagctagcatgatttttgttctatgtataggtagcctgtttattttctagtatttgtgttttgctaggatgcttatagaagtcatgttttatccttaattttatgaactttggccagaaatctgtcaatatgagtttctgcattaatttgccagtattagggagagcacttttgatccgaaagacaaacacttttctttagcctctgagaactttctttaaatatagctttgaggagattggatcatcatggtggacgggaggcaggactagattgcagctccaactcggacagacaaagcagcatgcggaggctcgcatcgtgaattttagctccagatcaactgcaagaacaaccagcaatcctgagaggacccacagaccctctgaaggaagtggactgcttctgcaggacctgggagacaccctaaatactgtgctggtatccatggctgagggacccatagatggttcccatcacaggactctgcagacaacccccagtaccagctcggaactgggtagacttgctgggtggctagacccagaagacagacaacaatcactgcagttcagctcacaggaagccacatccataggaaaaggaggagagtactacatcaagggaacaccccatgggacaaaagattctgaacaacagcctttagctgtagaccttccttccctctgacagagcctacccaaatgagaagcaaccagaaaaccaactctggtgatatgacaaaacaaggccctttaacacccccaaaaaatcacactggttcaccagcaatggatccaaaccaagaagaaatccctgatttacctgaaaaagaattcaggaggttagttattaaactaatcagggaggcaccagagaaaggtgaagcccagtgcaaggaaatccaaaaaacaatacaagaagtgaagggagaaatattcaaggaaatagatagcataaagagaaagcaatcaaaactacaggaaacattggacacacttatagaattgcaaaatgttctggaaagtctcagcaatagaactgaacaagtagaagaaagaaattcagatctcaaggataaggtcttcaaattaacccaatccaacaaagacaaagaaaaaataataagaaaacatgaacaaagcctccaagaagtctcggattatgttaaatgatgaaacctaagaataattggtgttcctgaggaagaagagaaatctcaaagttcggaaaacatatttgggggaataatcgaggaaaacttccctggccttgctagagacctaaacacccaaatacaagaagcacaaaaatcacctgggaaattcctcacaaaaagatcatcacctaggcatattgtcatcaggttatctaaagttaagatgaaggaaagaatcttaagagctgtgagacagaaacaccaggtaacctataaaagaaaacctgtcagattaacagcagatttctcagcagaaaccctacaagctagaagggattggggccctatcttcagcctcctgaaacaaaacaattatcagtcaagaattttgaatccagcgaaactaagcatcatatatgatggaaaaatacagtctttttcagacaaacaaatgttaagagaattcgccactaccaagccaccactacaagaactgctaaaaggagctctgaactttgaaacaaatcctggaaacacatcaaaacagaacctctttaaagcataaatcacacaggacctataaaacaaaaatacaagttaaaaagcaaaaacaaaaaccaaaaaaaccaaggtacacaggcaacaagcagcaggatgaatgcaaaggtacctcacatctcagtactaacattgaatgtaaatggcctccatgctccacttaaaagatacagaactgtagaatggataagaactcaacaaccaactatctgctgccttcaagagactcacctaacacataaggactcacataaagtaaaggggtggaaaaaggcatttcatgcaaatggacaccaaaagcaagcaggggtagctattcttttttcagacaaaacaaactttaaagcaacagcagttaaaagagacaaagagggacattatataatggtaaaaggccttggctaacaggaaaatatcacaatcctaaacatatatgcacctaacactggaactcccaaatttataaaacaattactaatagacctaagaaataagatagacagcaacacagtaatagtgggggacttcaatactccactgacagcagtaggcaggtcatcaaaagacagaaagtcaacaaagaaacaatggatttaaactataccttggaacaaatggacttaacagatatatatagaacatttcacccaacgactgcagaatacacattctactcaatagttcatggaactttctccaagatagaacatatgacaggccataaaatgaatctcaataaacttaagaaaactgacattatatcaagcactctctcagaccacagtggaataaaactggaaatcaactccaaaaggaatcttcaaaaccatgcaaatacatgaaaattaaataacctgctcctgaatgagcattgggtcaaaaacgaaatcaagatagaaattaaaaaattattcaaacgaaatgacaataatgacacaacctgtcaaaccctctgggatacagcaaaggcggtgctaagaggaaagttcatagccctaaatgcctacattgaaaagactgaaagagcacagactgacattctaaggtcacacctcaagggactagagaagcaagaacaaaccaaacccaaacccaaaagaagaaaggaaataaccaagatcagagcagagctaaatgaaattgaaacaaacaaaaaatacaaaagataaatgaaacaaaaagctggttctttaaaaagataaataaaattgatagaccattagcaagaataaccaagaaaagaagaaaagaagattaagaaaagaagagagaaagtctaaataacctcattaagaaatgaaacaggagatattacaactgacaccactgaaatacaagagatcactcaaggctacttgtgaacacctttatgcacataaactagaaaacctagaagaggtggataaattcctggaaaaataccctcctagcttaagtcaggaagaatttgataccctgaagagaccaataacaagcattgagattgaaatggtaatttaaaaattaccaacaaaaaaaaaagtccaagactacacggattcacagcagaattctaccagacactcaaagaattggtaccaattcttttgacactattccaaaagatacagaaagaaggaaccctccctaattcattctatgaagccagcatcaccctaaaaccaaaaccaggaaagaacataaccaaaaaaagaaaactacagaccaatatccttgatgaacatagatgctaaaatccttaacaaaatactagctaactggatcaatccaacaacatatcaaaaagatattctaccatgatcaaggggatttcatactagggatgtaggaatggtttatcatatgcaagtcaataaatgcaatacaccacataaacagaattaaaaacaaaaatcacatgatcatctcaatagatgcagaaaaagcacttgacaaaatccagcatctctttatgattaaaactctccagcaaaatcagtatacaagggacatacctcaatgtaataaaagccatctgtgacaaaccacagccaacataatactgaatggggaaacgttgaaagcattccctctgagaactggaacaagacaaagatgcccactctcctcactcctcttcaacatagtattggaagtcctagccagagcaatcagacaagagaaagaaagggcatccaaattggtaaacaggaagtcaaactgtcactgtgtgctgatgatatgatcgtttactttgaaacccctgaagactcctccaagaaagctcctagaactaataaaataattcagcaaagtttctgaatacaagattaatgtacacaaattggtagctcttctatacaccaacagcaaccaagtggagaatcaaatcaagaactcaaccccttttacaatatctgcaaaaaaaaaaacaaacttaaaaatatacctaaccaaggaagtgaaagacctctacaaggaaaactacaaaacactgcttaaagaaatcacagatgacacaaacaaatggaaacacatcccttactcatggatgggtagagtcaatattgtgaaaatgaccatacttccaaaagcaatctataaattcaatgcaatccccatcaaaatactgccattattcttcacagaatttgaaaaaacaattctaaaattcatatggaaccaaaaaagagcctgcatagccacagcaagactaagcaaaaagaacaaattgagaggcatcgcacactacctgatttcaaactatactattaggccatagtcaccaaaacagcatggtaatggtataaaaataggcatatagaccaatggaacagaatagggaacctaggaatcaacccacatacttacagccaactgatcttcgacaaagcaaacaaaaaaataaagaggggaaacgttacacttttcaacaaatggtgctaggataactggctagccacatgtaggagaatgaaactggatcctcatctctcaccttatacaaaaatcagctcaagctggattaagaacttaaatctacaatctgaaactataaaaattctagaagacaacattggaaaaatcctctagacattggtttaggcatggatttcatgaacaagaacccaaaagcaaatgcaataaaaacaaagataaatagttgggacttaattaaactaaagcgcttttgcacaccaaaaggaacagtcagcagagtaaacagacaatctatacatctgtcaaaggattagtatccagaatctacaacgaactcaaacaaatcagtaagaaaaaaacaaacaatccatcaaaaagtgggctaaggacatgaatagacaatactcaaaagaagatttacaaatggccaacaaacatatgaaaaaatgctcaataggcctggtgcagtggctcacgcctgtaatcccagcagtttgggaggccgaggcgggtggatcacctgaggccaggagtttgagatcagcctggccaacatggtgaaaccccgtctctattaaaaatacaaaaattagctgggcatggtggcaggcatctgtaatctcagctactcaggaggctgaggcaggagagttgctggaacccgggaggtggaggttgcagtgagccaagatcgcgccattgcactccagcctgggtgacaacagcaagactccatcagaaaaaaagaaaaagaaaaaaagaaaaaaagaaaaaaaagagtaaaagaaaacactcaacataactaatgatcagggaaatgcaaatcgaaaccacaatgcaataccaccttactcctacaagaatggctgtaatcaaaaaatcaaaaaacagtagttgttggtgtggatgcagtgaacagggaacacttctacactgctggtgggaatgtaaactagtacagccactatggaaaacagtgtggagattctgtaaagaactaaaagtggaactaccatttcatccagcaatcccactactgggtatctacccagaggaaaataagtcattatatgaaaaagatacttgcacacgcatgtttatagcagcacaattcacaattgcaaaatcatggaaccaacccaaatgcccaccaatcaacaagtgaataaagaaactgtggtatatttatacaatggaatgctactcagccataaaaaggatgaattaatggcatttgcagtgacctggttgagactggaggctattattctaagtaaactaactcaggaatgtaaaaccaaacatgttctcactgataatgtgggagctaaggtatgaggatgcaaaggcataagtatggttcagtggactttggggacttggtgggaagagtgggaggggagcaagcgatacaagactacaaatagggtgcagtgtatactgctcaagtgatgggcacagcaaaatcttacaaatcaccactaaagaacttactcatgtaaccaaataccacctttaccccaataacttatgggaaaaaaatcagtgaataacttatttagatttttttggattaaggtagaatacgaaaggtgaaataaataaataaatatagctttgaattcgtatttctttctattgctccaatctctgcttcaggaatctattagatctctatcctcagttctgcacatcatctcctttctgattattttttaaacattttgtttttcactctgcaagaggttgtctcaagtttgtcttccacattgctatacctatttttttcaggactatttctgttatttactatgttcaatgaacattttaattgttattataattttagtttccttgtaatcttttcttgtctcctttagctcaccttattgtctgactctcatttaaatttttttccattttatgtatattatgtatgtgttttccatatacagcagactatatgtaacttacatgatagttctgaagcacatgagaacctaccatccactgtaaaagctactgtaatagggccaggtgcattggctcatgcctataatcccagcactttgggaggccgaggttgccggatcacgaggtcaggagatcaagaccaccctggctaacaccatgaaacctcgtctctactaaaaatacaaaaacaaaattagctgggcgtggtggcaagcacctgtagtccccgctattcaggaggctgaggcgggagaatggcgtgaacccaggaggtggagcttgcagtgagctgagatcgcaccactgcactccagcctgggtgacagagggagactccgtctcaaaaaaaaaaaaaaaaaagctaccgtaatacccatactgttgcattgagttatgtgattcttttctttgccattatttccttactttatattttacagctttatccacatatctactcataagcaatatattattcagtgtgttagctttataaaaatggtacgtaatttcctgtgtcttaattttttcacttaactttatgcttctaagattcatccaggttattacatgcacttacagtttgttcctttttaattttgtataatacttctttgtgtgaacatcctacaatttatttatctattctcctactgatggatatgtgtgtccagattttgctattataagcaatgtggttttgaaattcttgttcctgtttccttatatacaagtaagaaaatctagaggaatgttactccaactgtgactggggaccagcagcaacttcatcagctgggtgcttcaaagaaatgcaaattaacggacttcaccccaggcctaatgatttagaatctccagggagtgaggatccaaaattgtgcgacactccaggtgattctgatgctcattaaagtttaagaagctcgttctagagtatatacctaagagtggaattgctgtgtcatatacaggtatatgtatgacactttacaggataatgcccagttgtttcccaaaggtgattccagctattccaactatactccctccaccagtgtccgtatggatctcctcttgatttacatccttgcccacactcatcactttcagacttcttaattttctctttttgtgtgttaagaagtccttccctataactagttcataaagatattctatattttctttttaaacttttaaagttctttttctttcatggataagtctttaaccaatctagaattggtctggggtacttatgagataggtatataatttcatatttttccgtatggatagtccaattataccagcatcatttattacatcatctctcctttctttagtgatctgaaatgccccgtgtcctgtattaaactcccacatattcatgagtctgtttctggacctctattctgccctgtttctttgtcctgtactaataccacactgttttaattaccattgttttatattgtgttgaaatctgatagagcaagtcctcctttcttagaaatggctttgttaatcgttagtctttgctcagttatagacacttcggcatcagattatctagtatctaaacaaaatctgttggaactttggaattgcatagaatttataattcaaataagaagaatttacctttttatgatactgagtctttttatctataaagatgaaaaaaactgaaaaagaactccttccaagtagggaatctttattttctctttgtgctttgaaggtgaaagttcccaattatgtactttttctctattaagaaatggtcctagatcttttataatgaaaataaatctttaatggaggagaaaatgtgaaaaccttttcagtttagagaattaagtcaaaaaacattttatttttgggagtttgctattaaccatttagtagtatgcaaagcaataaggaaaatacagtgttaacccccaaacttgtcctgttggcagattcactgattttccctttctttctccttttctttctttttttttgagacaaggtcttgctttgctgcccatgctggagtgcagtggtgtgtaaccacagctcatcgcagcctcgacctcctgggctcaagtgatcctcctgcctcaggttcccccagtctcacaagtagccaggaatacaggtgtgcaccactatacccagctaacttttaattttttttgtagagacagggtcttgctatgttgcccactctggtcttaaactcctgatcactcctcaagtgatcctcccagcttggcctcacaaagcactgggatttacaggcgtcagcttctgaacccggcctgattttccgtttctagagagtgctttcaaagtgcttctacgtttttcttctccctacctacccttttgatattctatgaaaaccatttgtgatagatctcttcatttccatttccaaaagtgtacattactggacagaagccttcattttttactcccatccccaattcaaggatagtgtaaccaggtaaagcatgtgacataggtaatagctgtatgcttctcgtatactgtaggcaaatgtttgctctttttgcttttataaatatctgtttaaaattagcgcatgcatattgcttaagcacacatatatttgtaatgaagttgtgtgtttatgtgtatacgaataggttaataaacataaaatttagaataatggttaccttgggtgggacaggagaaatcagggaaatggggtagtaaggtaactcataggttgatgggagttattggtaatgttttagttttggggtggagtggtggattcacaggccctgagtgtattattttgctttaaaagtaacatataggcacagataatgttttgtatgtgtcaaataatatatttaaaacataatacatgaaaagttttatattatttgtttatcagagcttcctttaggaagacgacgttattgacccaggtataggctgccatctctgaattgttttacccaaagagagaagagtttatgatgatttgctgttagtttaccatgtcttccctcagggcaatggagggttttggtttttaagttggctgatagtgggttgaaagccaggtgaatatggaattttcaccttttcttagctccatgtaccattttcagactcctttttcatccttgcatttctctcggttccctatctattctagctatttttttcaaactccgtcctccccctctctatccttatcatgtccttatgtaatccagctctcagcagaatcaaattagagttccatgctcacctccttcctccctttgttcctccttcttctcttctttccttcccttcttccctccccatctttctttcattttattatgaatgggttccatttttataatcataaataaaatgaaacaaatgaaatgactcctgaatatttcttaaggcaatgacatgaaaatgcataaaagttatctttgtgcagaggataggaaaaaaagaaagaatacacagacacatctaacaataacaacaacaaagacattgcctagaagatggaaggtaatgaaaagtttgcagacagtaagagtcattaagaaggaaggcaaatacaatgttttttaaatgtctataataaaaaaaaatccaaaggaaggcatgcattacaatttacaagggacaaagagagacacagacagacattctttaaatgtattagacgtgaggagaggttgaagaaaaatagtgtccatttattagttggaaagggaaaactaatagcagatgacactaaaaagacagaggttttaaatcttttctttttctttagtatttgtcaaaaagtcaattgctgtctgaaagctagacaaagtagtatatggagtgagttgaaccaaaataaataggaaaagagaaactgacagaagtttacagaatttgctggattaattgctcaactatgtgttccccgaggtctaagactcactaccgattcctatagcccagtgcctagtagagtgcccggctataggaggtgctagaatttaattatggaatgcctactatgattaagttcttggcatcatgaagtttctaacctagcaagaaagacagtccttaagccaatgagttaaacaattacttaattttcgtagtgctaatggtaagaagaagtagggcaggactctatgagagcagacattagaagatgtgaccatgtctgagggccagggaagaagtctctcatgaaggaacatttaagatttgaggaaaagaagggaggggacataaagtgtttggggcaacagaaagagcatacgcaaatactgtgagatgggaaggagtttggtgtgtttgagaatttgaaagcagaccaattcagctggagctcagcaagttaaggcaatagtgggacaagatgagggtggtagggcagatcatagagacctaaggatttcagaattcatcttacaataaatgagaagccattgcagaattttaggagagaaaacggcattattcaatttacttttagcaagttgactttcacagctatgtagaaagtaaattggaggaaaccacttaagaggttagtttagatggcgcggtggctcatgcctgtaatcccagcacattgggaggccgaggcgggtgcatcaaaaggtcaagagatcaagaccattctggccaacagggtgaaacactgtctctactaaaaatacaaaaattagctgggcatagtggtgtgcacctgtagtcccagacacttgggaggctgaggcaggagaatcacttgaacccaggaagcgggggttgcagtgagccaagatcgcgccactgcactccagcctggtgacagagactccgtctcaaaaacaacaacaacaaaacaaaaacagaagaagaaaaaaagaggttagtttagatgaaagatgatagttttgattaaagtgagaaagttaacttagaagagaggtttgggagatatttaagagatagcattgataagatttggtgattgactggatatacagaatgagcataaaacaggattcatagctttttttttgctttctttttttgagacggagtcttgctctgtcactcaggctagagtgcagtgtcgtgatctcagctcactgcaacctccgcctcctgggttcaagcaaatctcttgcctcagccacccgagtagctgggattacaggcgcctgccatcgtgcttgcctaatttttgtatttttagtagagatggggtttcaccatcttggccaggctggtctcgaactgctgacctcgtgatccacccgcctcagcctcccaaagtgctgagattataggcgtgagccaccgcacctggcttcatagctttttaaatgctcaaatgcttaactcgggaggttgggatggctgctggtagtgcagcaacaacggcagcatttctcttctctcctcatcctgcccctcctatcccaacctcagccataaaagcttagtgctatcaagctctgccagggacacacacacacacacgcacacacacacactttgttaactgaaactcagatattagctcaagggtcattttcccagggagcatactaaaagaaaaaagaatcaaacaaagtaataatattaactcacgaatgtgcattatgtcttccttaaatttagttctgaagtttttttaatcacatttactgataaatatgaatctaatgcatatttttgaaatgttttgtctttacttacttcactcactatttctcaggcttcctatttccaacacctatagctggccaagaggacccttgtttcagaaggccaagccccagctctctttcagtcatacccctttccatggggcaagtccacaggaccaaggacttatgcccacctagagctagcacccctttctagaccatgctctgaatactcaggcccctgaatcctctgctcagatcttatccctagctttttgccaggatctgcatgggctgcaacctggagtctggcttcctgagagcaaaccagtagagtgtgcactgctaggccagaaaggtggcaaagggaacctgcttatggaggtgtgatcaggcttgggtttgtgaactggactgtctacactgcaggcccatgagacttttgatgatacactacagagccaggggtgagaaggggaaactgcgttgtggccctggactctgaccctaggctctgaccaactcaggcacagcagtgaatatgttagctagtcctttcattctacaaacattttctgagcacatattcctagtgcgtaaggtttcctgtgcagcctgggggaatgcaaagatgaacaagacatccttctgtcatggagggccgcagggccaaagatgcatgtaaacaccctctgtgaaatgaggctgactaaagtatcacatgagcgggaaccacttgtagtactttgggaattcagaagaggaaattattttttatagctggaggaatttgcagacaacttcaccaagaaacaaaagtggagaggtaatttgcttagaattgaaacacatattcaaattctacaaagttatgtattgactctaaacttcagtttcctcatcaggatttaatgagataatatatctggaaacatctattacagtgcctgatacataaaagtatttaatgaagtatttaatgtgttgctgttttttttttgtttgtttttgttttttgttttttttttgagacagattcttgctctgtcacccaggctggagtgcagtggcacgatcttggctcactgcaacctctgcctcccagattcaagcgattctcttgccttagcctccagagtagctgggactacagacacatgccaccacgtctggctaattttttgtatttttagtagagacagggtttcaccgtgttagccaggatggtcttgatcgcctgacttcatgatccacacgccttggcctcccaaagtgcggggattacaggtgtgaggcaccgcgcccagccatgtgttgctgtttctttttattaattaaaatatattttttacctcatgaaaatattccactatgtacacaggtatgcttcaagttgtcccgaaaacataactatggtgtgtgtgtgtgtgtgtgtgtgtgtgtgtgtgtgtgtgtgtttgtgtgtgtgtgtgcgcacgtgtgtgttgggaaggttcaggatggttggaaggaagtttcttgagatcagggcctgtatctttgcattcccagtgccatagacattgggatttaataaatattctttgattgaataaatgatcaaattaagattcacctcctgaagctgttgagaatgaaataactgcaaggttcaaaggtcatggttttcctgggcactgacaggtcttgctgcaggtgcatgagcttgtttaatctcaacagtttttgcttctgggaattataaatgctccgaagtgtgatggcaaaatgacaaatatttttccttcctgaagcctgttgtgtggtttccaaagttgtaaaaacctaattaattctaataggcacaaatgctaaaccagtagctactcttcatctagatatttgaccttggagagccaagaagaaatggagtggaacattaccattggtttttgcaccagatgtggcaggatgccagagctaatgtgtgagggaaagagctctgctgctccaacttcctccacagagagggagctgcaaggcagatccagaaagttttcatgtgacttaagcatctttggaaattttgaaagctactatttcccttgctgcccctctagaggtaatgaaataccctccaatccattttttggctactttacttaaaattgtcgaatggtggccgggtgcagtggctcacgcctgtaatcccagcactttgggaggccgaggcgggcggatcacgaggtccggagatcgagaccatcctggctaacacggtgaaaccctgtctctactaaaaacacacacaaaaaattagccgggcgtggtagcgggtgcctgtagtcccagctactcgggaggctgaggtgggagaatggcatgaacccgggaggcggaggttgcagtgagccaagatcgcaccactgcactccagcctgggtgacagagtgagactgcgtctcaaaaaaaaaaaaaattgtcaaatggcttcccatttcttgctgggtaaagtaggaagatcagtgctttttaatatgaattgtctccttactgattcacctttctctatctggcctttcatgcttaaggatgttggtggttttctcccacccttcaaggatagggcctttctgtttctccacttacctcccactccactcctcccagacccattccactcccaccccccaacacacacacacacacacacacacacacacaggcacactttgttaactcaactgagatattagctcaagggtcattttcccatggaagccttcttggaccacccacatcccttgcctgggtgaaatcacatttctgtatcatatgttctcacagaaccatttctttctcctgggacacttgattcaatttgtatttacatatttattggtgggattatccagttcatatgtgtctttccttctagactatgattttcataatgatgggattatgttttctcacagatgtatccctagagtctaacacagcacttagaacataagggttttcaataaacggttgtaactatgagggccttgaggtatctatgttccccttgtatggcctcctgccccttgcttctcttacccagtcttatctatggctggactttaggtaataaactttgaaaaaaattacagaatttttatgttttcagcctcatcaaacccagatgtgagtaatagtgggaggaggcattagctcagttggggttccacggagcagccagtggcagcagtgagaaacatttaacccaatacaatgggggagatgctcaaactagagaattgagtggaatggagacccgtgaagccctcaaccttgaattacagtccagagggtcatcacataaggggcaccagaagtcctggagcatgaagtcagaattccaggtgtgctgcaagtgaaagcaatcataaacttgcacacaaaattacaaaggaatgccttcatctgctcactgtcaaaaggtagatgatgttgtctgggctcaaaaaatcaagggcagaactgacaagtttgctgtaaaaaaatgacaacaatatgcttttggtaagagctattttttggcagaaatgcatttgaactattcttgtttcaacaacttggagagtcagatcatgaaagtctggtatgccagtgaaacatttcctagtgtttagtatcaataatgaattgtcaaatggtacagccactaggtaaaagtttggtggttcctcaataagttaaatatagaatcatcacatgatccagcaattccactcctaggcatatacccaaaagacgtgaaaagaggaactcagacatacttgtacatggatgttcacagcagcattattcacaatagtcaaaaggtgaaaacagcccaagagtccatcaacagatgaatggatcaacaaaatatggcacatatgtatatatatatatttatatacatacataaatggaatattattcagatgtaaaaaggagtgactttctgaaacatggtataaaatagatgaacctcgaaaacatgctaagtgaaataagccagacacaaaaggacaaatgttgtatgattccacttatatgaatgatctagaataggtaaattcacaaaaagtagaataaggttaccaaaggtggaagggggaggcaagaatagggagatattgcatatggttacagagttgttattcaaagtgataaaaaaattttggaaatagctagtagagatggttgcataccatcgtgaatgtacttcataacactgaatagtaaacttaaaaattgttaaaacagcaaattttatgttatatatattttaccacaataaaaaaagaaaaaaggaatgaatttctggagataaactttcttgagagtaacttggcaatatgtatcaaaagccttaattgctgcatacccatttcacttcttataatttatttttaggagataatcacagatttgttcaaagatttatttgtaagatggttgtagtgaccactgctggttttcttctttaatatcctccttctggtcacagcatctggattttctttcaggaaatcatttggctgtggttatatactttgttttttttttttttttttttttttttagacagagtcttgctctttcacccaggctggaatgcagtggtgcgatctcagctcattgcaacctccacctacctggatcaagcaattcctctgcctcagcctcccaagtagctgggattacaggcacccaccaccacacccggctatttttttttttgtatttttagcagagacagggtttcaccatgttggccagactggtctcgagctcctgacctcaggcaatccgcccgcctcggcctcccaaagtgctgggattacaggcgtgagccaccgcgcccagcccgttatatactgtttacttaggttccctggtctcccttgaggcaagcaatcatattgaactcgctggactttctctccagggaatctgaaagctgggtggtgtggtcaagccgactgagagtggctggaggtgatttattccatggagtggaactttaaggagactgatcttaagacagggtaggatccaggtaccatgggtgccgacatctagatctcctgtgttgccctggatcctacccttttcaagccggctgctttaccttttcttctctgcttaagctacctacattcccttcctccttaatttttttattaccaaagaatcttggttcaatgatcattatagcattatttttaatggagaaaaatcttgaaagcaaagttcaataaatcaattaatgagtaaacaaattgtagatccaactatggatactttgtagtcactagaaattatattttagaagaatataatgatgtcaaaaatggtcattacagtgtgcagaataaaagcagactctaaaatagaattatcctgttttaaggggaaataaaacatgtctctgtgcagttaaacctgaaggatatacatataaatgaaaatagttgttatctctgggtagcaggattacagagcattttctttttaagaatattttctaaactttcaggaatgaacatttaaaatgaaaaaaagttttcattttttaagatatatacacatatttctgttgataacttccttattcttaaaatgggagatctgattatttctcagctttcaaagtcatattgttttaaaaatggatctgtgtttctaactgccttttctacagcactacaagcacctcgtatgtaaaatacccaaatatatcaattcctccctctccccaccagctccactgaaacctcctctaggaagcctccctgaactcccaagtccaggttagggtttcttttgtactccaccctgtggattcctgcagttctccctgctgatctccatcccttacagcacggttcacactatatgtgaattgcctgtttacctgtcctctctacgagacccttcagtggcagaagggtccgtgtttgttcataacaatgtcagtgaacatttctagagtacttaagatgtgctcggcccttcacatatattatctcattgaattcaggaaacaatcctataaagaggtactgttgtttgtcctattttacaaataaagatattgaaactcagcgacagaaagcaatttacacaagtgacacagttgcagcctcagcacccagcacagggtctaagtatgtattcggtgctttataaataaatatttgttgaatgaatgaatgaatgtactaaaattatgtagctaaatctccctattgcagttttctgaatctataaataaaaaacgttgccagaattaaaagtgcctgatgaaatgggtaaaatgtcagtatgtagccagaaggggaaaaacatcttatctcactaattggtgacttcactgtgaaactctcttaaaaattcagagccactactgcctagagataaaaatcagtcccattttttttctgtctctgaatgcttctgtgagaattactaaaccaggagggtacacttcactggctgaattacatgcagggaaaggcaagaggtaaaagcgcttctctctcacctgaattgcccccatgctgccctgtatccctctttgctgcacttggaatacctgaacagagccagaacaccagatgtgaagctcattgtccagaccttcacactgtgagtaggggcctgaaatacaaagaacaaacctgggacaaatgtgataatcaatgaagcactgctttgaaaagaaaaggaacaggctgccaaaatctcaattttaagctggaattcagcaagcagaaaagttgagtgataagaaatctcctgcttttcactaggattgtcaaagttcctaaatttaccaggagctccctgactctctgagtggttcttagtttcaggggttatttttatccaggaaaatattgtaggaataatcccttctttcgaatcccaggaacctgagagaaagcatactatttcccagatcctaagacccagagcagggctttcatcctcaacactatcgatagcttgggcctggcaattctctgttgggtgtggggtggggggggcgaggcgagggggtgcattgcaggatattcagcagcagccctgtcctgtcctatgtcagtagcacacccctcatgccccacccagctataacaaccaaaaatgtctccagacattgctaaatgtcccttggggagcaaaatcacacttcccacacttcccatcccaccccttcatttggagaaccgctgatctagagtgtggcaaatggaaaacactggttcattcccttcccatagaacatcagagagtacctcgtaaatacacacgtggacacatgatgcttgtttatttacctggagtggaagaagggagaaagtgtcccattaacctaacatttcatgtttgatggtgatatgtaagaatgtctaatcttttgttaatcctcacttaagaaactttttttccattcacccagccaactaaggtttccaagcatggaatcttagtctttggaatggagctggttccccagaccattttggatttctggatgtttgtgtacatccctagtagatagaaaagcatggcgtttggagtcaagcaccctggattgaaattccagtgaaaacttttatttacctgtgctcactgcaagtcactaaactgctctgagatccaagttcctcaaccataaaaacctctcttatttgactgcggtcaaaactgaatgagatgaagccaagagatgggcctggcacaggcctggttgttacaaccagttcctgcttataaatgttttcttccttcaatgcttgattattacccaagaagtaacagtaagggaaagcttccctcccagtgtctagtaccccagaatattccttcagctcttcccaaaacatggtgagaagaggtaacactgggtgagaagaagtaatactgggataatcagggaaggcttttgaatgtgacttacagtttttgcctggagttggtcagaagcaacttggcaggcagtaattaaagactgagtttggatggatagggctttttcagggagagtgtccacccatgggtgagaggtctgctggtgcagaggttttgtttcattctgaagacctcttctacatcattctgcaagctataatgcaagtgacagtaattagaagttagatgtggattctagttcaacttcagcactttctagatgagaccatcaccttgggcaaaaactttccctctaagcctcagaatcctcatgtataaaacaggatgggccaggtgtggtggctcacaccagtaatcccagcacttcaggaggctgaggcaggtggatcacttgaggtcaggaattcgagaccaacctggccaatatggtaaaaccccatctctactaaaaatgaaaaaaaattagctgggcgtggtgtgcgtgtctgtaatcccagctaactaggaggctgaggcaggagaatcgcttgaacccaggagatggaggttgcagtgagctgagattgtgccactgcactccagcctgggccacagagtgagactccatcccacgaggaaaaaaaaaaaaagatgatactttagcctatctcatcaggttgttgtgaaaattaacaagataatgcgtgcaaagagatcggcccagttcctggtgagtagtagacactgtgaaatattagctgatgttatattaataatcatcttctgtaaacgcctgcacaatatgagcacatctgaatatattcttgaaaggataaataatagggaaacaaggtccaagacagataagacagaactcaaacagctgaccaatcaaaagaacaagctgaggataaagtaccaatgggggaaaaatgcagaaaaaatgaagtgggcaaaaaagacaaaggtcaaaagtgaatagtgcaactttctgtgaaagctggggaccacttatgtatgtgccagaaagtctcacattcgggctaggagcaaggccctacattgaatagaaacaaacagatagatattagaagggctttttggctagatatcatcatcatcatcatcattcattaacatttgctgagcacctgtgatatattggacagatagaaataactaagataaagtctcacaccttgaagagctcatagtttagttggcccacagccaggaaagtctctgtaagtagagtttttgagctaattcttaggtcccatgttccttctttcactgacacatcctttggatgttggtgggcaaaggagtacaagcccctgtgggcttcagcaagccctttttctccccaaatgctcttgccctcttttaccacctaagctttcctgcaccaaaagtatttctacaagtcaggaaagttaaagtgcatgtgctgtgcttaaagaagaggttttataataaccactgccttcttggcaggctgcagaagctgagccagtggagaaatctctggaagggcagttggaagtaactggctgactcctttgcccagggtgggcatcatgctagcatctttctggctacaaagagtagaatcaagtctgtgaagtcaggtggagacctaactgcagctttaacaggccaacagctgggtcaaccagccacagagacattttcttgacagtcactctggtgggcttaggggattcagaaaacaaaagtgaaggtggtctccacccagacccctccaggaaagcctgtggaacattgcattgtccacaagctattttgcagctgcttcaattaaagaattaaactgtatctgagtagcagcaacatacatgagagccaaattggattcctccttggaaaataagctacagaccacatctttattgtgcagacactcattaacaaatatgtaaaaaaatacccgtcagagaaagatgttttcctgctttggagactttaaaaaaagcatttaattccatctggcacgcatggctgaatctgaaatggctacaatgtgtgactggtgggaaagcatgacaaaaggagttctgtctatcaatccaccctctgcagggcagctatacccagaactccactgggttagggagaaggggccattcctgattctctgaacagtggggacatgttttctatgcttgaggaaattctaagtttagggtcttttctgaggaaaagaaatgctggctgcagacaacgaggccagtgcctccatttctctcctcgctcgtgagcagttcagatgctagacaggctacaacatacagaccatgtacagagagacttacaaaccattcccaagaaatggtcccaagtaacctcacatttcacgtttttaagcgtagactatactgtctatgctttcacagggcccactaaacccgtggggacagcagaccctgctctccaaagtccaaactcaagtggagccaagcctcacagtaaagtgggcttcgaggcgcaaagtaagatctatcctttaagaagaaactgtatatctaatggcttttaggacattttcattgatattaggatttacgtgattaaaaaataatagttaactttgcaacttccaaagtgtattgttgtaccttaaagccaaggcataagtgtagaaatacgaataagaaagaatcaagctgggatggtactggtaccaaaacagatgtacagaccaaatggaacagaacagagccctcagaaataacaccacacatctacaaccatctgatctttgacaaacctgacaaaaacaagaaatggggaaaggattccctatttaataaatggtgtggggaaaactggctagccataggtagaaagctgaaactgaatcccttccttacaccttatacaaaaattaattcaagatggattaaagacttaagtgttagacctaaaaccataaaatccctagaagaaaacctaggcaataccattgaggacattggcatgggcaaggacttcatgtctaaaacaccaaaagcaatggcaacaaaagccaaaattgacaaatgggatctgattaaactaaagagcttctgcacggcaaaagaaactaccatcagagtgaacaggcaacctacagaatggaagaaaatttttgcaatctacccatctgacaaagggctaatatccagaatctacaaagaactcaaacaaatttacaagaaaaaaactccatcaaaaagtgggcaaaggatatgaacagacacttctcagaagaagacatttatgcagccaacagacacatgaaaaaatgctcatcatcactgatcaccagagaaatgcaactcaaaaccacaatgagataccatctcatgccagttagaatggcaatcattaaaaagtcaggaaacaacaggtgctggagaggatgtggagaaataggaatgtttttacactgctggtgggagtgtaaattagttcagccattgtggaagacagtgtggcgattcctcaaggatctagaactagaaataccatttgacccagccatcccattactgggtatatacccaaaggattataaaccatgctgctataaagacacatgcacacatacgattattgcggcactcttcacaatagcaaggacttggaaccaacccaaatgtccatcaatgatagactggattaagatatgtggcacatatacaccatagaatactatgcagccataaaaaaggatgagttcatgtcctttgcagggacatggataaagctgaaaaccatcattctcagcaaactatcacaaggacagaaaaccaaataccacatgttctcactcataggtgggaattgaacaatgagataacttggacacagggcggggaacatcacacaccgaggcctgtcagggggtgtggggctgggggagggaaaagcattaggagaaatacctaatgcaaatgacgagttgatgggtgcagcaaaccaacatggcacatgtacacctatttatcaaacctgcatgttgtgcacatgtaccctagaacttaaaggataattataaaaaaaaaaagaatcaactacatgggattgttaggaagtttaaatggtttcatatagggtttagaacagtggctgatatgtattagggtttgtaaacaaaataaactcttcaatatgcaaaaaaaaaacaataaaacaaaataatttaaaaaaaagaaagaatcaggctgtggagagatagagaatctttgttccccaccatccactataagagaaactaataggtactttgctgtttatgaagagcaaagaagagcaaagtgtgaggcagttcccggggggcgggggaaataggtcttgtggaataaggccatctctgtcagcaaatcttttttttgtttgttttttgtttttttgagatggaatcttgctctgtcaccaggctggagtgcaatggcatgatctcagctcacggcaacctccgcttcccggattcaagagattctcctgcctcagcctcctgagtagctgggattacaggcgcccaccacaatgcccggctaatttttttggattttttagtagagatgggcttttaccatattggccaggctggtttcaaactcctcacctcaggtgatctgcccgcctcggcctcccaaactgttgggattacaggcgtgagccaccgtgtcccgccttcgtcagcgaatctttgaaaggaggagatggacacagtgtagagaaaaggcagaagtcctgcatcttatcctgagtcttgcagatagttttgttgacatctagtaaggaagaggactggtaactaactggcaagcccacactgccaaactggatcattcccaagagaaaatatactagaaacaaaatgaaccaaagtggccatccatacagcaggatttttctgggctgcggcttaattcttcctatatggatgctgtcctatgaccagggacaacaagcagttctctcagttgggcacagcacccaaccattggaaaggttttgttttgttttgtttgtttgtttgtttgtttccagctatcaccttgtccttactattcagaaggtaattgtgggtgagtgacaggaacactttggggctggtactttgccaatttatattcttatgcttaatagatgtacatgggaaggcacagtaccaactcagtaactgcctttgatattttcatacacaactactcaaatattggaaacaaatcattacaaatctaaagagctttagctatggggttctacagactttgtataagaaaacattagttgatgagaaagtttgaaagaacagccaccttggcacagaaacccagtatgaaatagaatatagactcttggaaatgtgaaagtttttcaaaattcaaaggaaagtccaatttcagaaaactgcaggctggaagatagcttattgaatcccaaataaagacattactataaatttcattatgtaatttgataattctgacatttacaaatgcataatgacatcaatcttgaattgcacaaaatcaaactctcatacaaaataagctggatggaaaaattttccttattttgctctgatcaccattccgcagttttaagggccagtagttgttttaaacatataagtgggatactaaaaatgtatttttaaatttcctttatgattaggaattaaagtctatatagtataggttcactacctgatctctcacttctgcctcagtaaagtttccttgtcaactctaatgtaaatattggcagagtctcctcctatcttctctacctccttagccaaagatataaacaaaaatttcagatgttcttaacagaaattggaccagaaagtacaatagcttaggggcctttcataatatcataaaagatttcttttggcagagtgaaggatttctgctccacctgctttctcccagctacccaatccttgaaccctttctcagtcccagggtcaacctcaagacacgcaaccagtacagttgcacaaggccccatgctccaaagagccctgtgcttggcttaatgctctgctgttgacatcttgaaattctcaataattttatctttgaaccgctgctttgtaaatgaagtccaatgggataatgggacacgcgcatgagttgaggagctgtgcacaatatgcgtgtccaaagatccttgctgtcatattaacatatagtgttgcaatgccccgtgagcacacagttctggtggagccgtaatgccagtgggggacttcaatgatgctcaagtgcgtgcaagataagtatgtgtaagtagggagtggtggggctgactgtccgagaggccacactttctttcaccccagaactttttttgaatgcaggaagaaggcaatggtatttattctaagtaacacaaacaaccaaagagcctgatcatatcctttcttcctcatgttacttctctgtattagccaaccacttttgctgaaaatgataatatagaaggacagggaaagataaggcaactagttgttcttttttctttcagttcttccttacttattaatctgaaggtagaaagtattggtagaaagcacacatattaagtgagataagaagggttgagttagttttgtgtaatgtttctatggttttggtaagaacaaaatacatatgtgtgtattatacaagctgtgaaatacaagtttacataattttggtaattttgcatataacaaatgctcttatgttattagcattgaaatcttacatgcacaatataaagatgaatggtaacactcatgctaattatttaaaattttaacttttctttacgtagaacaatgttaaatagcacattaaaaataccatgacagatcaggagagagactggaagaaaagacaaagctttacattttgggacctttaatggcacatttatttatttacagatagaatttcactcttgtcgcccaggctggagtgcaatggcacgatcttggctcactgcaacctccacctcctgagttcaagtgattctcctgcctcagcctcctgtgtagctgggattacaggtgcccaccaccatccccagctaatttttgtatttttagtagagacggggtttcactatgttgcccagtctggtctggaactcctgacctcaggaaatctgcccgccttggcctcccaaagtgctgggattacaggcatgagccactgcgctgggcctaacggcacttttaaaatgtagaggtcccgcatttcatggcccatttagtccccacccaaacaactcttcgccatcacaacatctccttcgtcttgtcatacaattcataggcatatgccataaaatggaataggagtctgaaaaacagaagagacacttacggactacctgctgggaagacgggcctaagggagccccacagtggctttttgacaatgaaaggaaaagctacagaagagaaaaccatggcagctgctggttaagggaaatgggaggatcttcctttggtgaaaattgagtttgatgggtgagacccacaaattctagagaaagcaaagcaggcctctgggctgttgtggtgaccgctatttacctgggtggcctttggatctcgcaagtgcaggaagtgaaatatgggagtgggatgggttggggggcatgtaactcagagggctgagactggcagaaagactcttcaatattttacctccataaaagaactcagaaatttggcagcaaagtaaagtattatttggcagcttttaacaccaaccatgaataatatttgaacttcaattttttgatgtaacactccagtaacagcaccgatcctgtatattagatgctcctatgcatgcaaggcaaaatcgcaggaacaacaatctgagaatgcattgtctaagatgtatttcccaacgttacatataccctcgttactctgtagaacagggatatgacaactgccatcatcccatacacaaaaattccacagcctcagaagccacagtttctgctatttctagcctgctagtatgtagatgctgaaaatggtaatatatgctactgaaggacctgggtgtgggcggaaggtatagaagactgggtgtagcaaggaagtctcagccctctgggtataatggttagaaggaaggtctagatagaatctttgtcttttactgtgagttggtatttgcaaaggtataaggaaaattaaaactttcatgtggctgtgaaatagaatgtgtgtaagtcatttacacaaatgtcattcctcttgtagcataacaatcatattattagatgtatcagagcaactccgatgtaagtttcattttggttacaacaccaactcctatattaaattaaactcctgtagtataaagtttagcactagttatggggaagcagccttattcaaaaatcacatttctttggttcaaatttcagtgcttgtgctcaggcagcatggcatctgctcaggactttagaaataaatacagagaacattgtttctaaaagacctggaggctgaaatacagaacatggtcatcattaagtttacagatgacactaatgggacgaaggacgggttaggaattccaaataagagtacatgcagggtagaggcctggggagaacatcttaaccataaaagcaaatgatggagaaggactggttttgtgtggtcatgactagactaggaccagggctcactggggttgaggggatgaagctggtataaatttctggggcatagcactcagggtccaactgtgttactatgaattcaaatcccttgcaaagatatttaactagtccacacttgcaagctctgggaggggcaaaaacttttttttaaagggacctcaaacccactcgggtttgtgcagtattgatgtgatttaggataatactatcccgggtgtgcataaaaaggagcagaatgtaaacagttatcccttggttcccctcttaaccttaccccttcctagctgattcatccacatgtcctttaatttctacctcctgatatctttcatctgtccccttctgccttgtttattgccattaccttagttgagccaatagcttcctctctaggctctctgcctacacttttgactctttatgatctactctccacagagcagctaaagtcattcccctataacttaaatccaattatatcagttccttgtaaagtttctttattggctgcccactgcttttggactaaaaatcaagctccttatggtgatccgcacactctgcatgatctgcccctgctcagctctccaacctcgtttcctaccacgtgactactttgctacctctagctttcctctctgttctttgaaccctctggaccctctcccttctaaggcccctgcgcaagacggtgcttcctctagctcctcaagagcccacggcactctcatccctcaggtctctgcttaagtgctcctcctcagagacctatctttacctatttaaagtggccacttccccagaattctccaatcccttattatattttccacaatctgttggaatgatcttatttatccagttacttatttttatttgcctctgccctagatcgactctgagctccttgagagtaagaggctatgtctgtttcctttgtagctatattcccggagcctagcacagtgttggcacaaggctggcactcaataaatatttgaggagtaactaaacctgtctctcatcatgggccactgctgtgcccagcatgtttaaaaactggacctctgaatcccatggtcattcctaggggggatatctacagccacggagctaatgaatgtacctgaatagtaaactgaactatgtattttaagcccccaagttgctgatctgaggcccttcagcagtgggacaggtgggtatcattcgcggtcaggtgttctctgaaccttctattgtagcagtggcagctttgaaaaaacttttttttcttctgttacttcctacctgtattttctatgccttgaagaatgtctctaaatttggtatcacccgcattctcattaaggtggctttaacatctgtcttctagatcccgaatgatgatgagagagacaacaattaaagggatcctcatccctgacagcctcccagcaggcactccctgctcagccagagccactcatcactctcctgtgtttgccttctcccagccagcttttagttcatttgactggcttagattcaaatacacttaagttttgaaagctgagctttataattctagatacttacattctctgagtcatgtcattttctcaaaaaagcatatgatgtgagttttagagggcatttccggaggcagagctggaattacaaaaaaaaagcaggagagcaaagaggatggatgatgctttgatcaacactcatttcccaggccacatggtgattccatcagtgaagcacggtgtgtgcagatcaaaccaggagagccggaggagaacagacacccaattagttataataacctttgactggtaaatgaaaggaaggaactacggaaacctggacacccagaatgaatttcgggaccaaatccctctgagtttcctgtcctattatgtgtcagccggaagggcagcctttccgagggaagtgctgtgcattcattagaacatggggagccaagtgattgggaagcagcagccccaaatgggctttacggttactgtgaatgaaaaagaaaggccatgtatttttaagagaaaaagccatataaatctgacagctccaccccactcatagcaaacctcagtcatctccagccaaaccactctattttcctgacagagacttgcacagtgggaagacactgtgaaaaatcagtggtaacaaccgcaaaccacttatggtacgccctgggcttaatcatgatgtttttgggttcattcggggcagggtcaccctccattttcaaatgcgcgcacgcgcgcacacacacagacacacacaaactcttactcaaccaacacacactcagtgatagcctcacacacagaagatgaattatgcaagtaaattttctattttctctcttaaattgaattaagcctctttcgaaacttctaagttatcagtcttaataattctattatccagttaatgtttttatttttgttgtgttgagatagactaacagggatgaaaaacagattttaaatttctagttaaatctgcaaatattgattgatagtgatctctatcgacacttaaaatgcacataccctttaacccagtcattctatttctaggtatttttattaaagacatgtaaaaatatacaaagacatacctagccatccatcttctccatttttgtactcaagcagctgaatgtagctggagaaaagcacagtcaggcaaataggtttcactttaacatgatctcaaacctcacatgccctcaactctgcagtaatcctagatgtttctctagtttctttatcaagcttgcctttctaatctctgatatgactattttgcacttttcctttctcttcaaaatctcttctccaatcacttcccttcctcttagccttgtctcgcacttcaagcagtaagtacagaaagctatggtttggaagctctcctttcttattaccaccaaatctatgcatgattgccactgtacccttctcttttctcctgcacaaattggatgtgctaaatgctgttcttcctaagcaaggttaggttctgtgtctgtcatctctcaccttgtttctctccttcatcctcactcctctaactttcacctggatttagatatgcttacacatttatatcttcagccatggtattgaaaaaggtttatgccacacctaaatagctgtagagcactctgtgatagagcacctagatgactggagtcatccctgctgactctgggacagattgcttggatccttaccaactgccaggacctcatctgattggaaaaacctgcagagcaaattggtgcccactggctccttttggtttccttctggctgcttcatttgtatttctagacagatgtatggaggagtgtatatacatggggatgaggtggggtggggtttgcgctctctcctgctcaaaggtactaagccagccagatttacttcagttcaccttctgtgttccatccctcacttggaggactttaaatcttctagtggttctcaaactttagcatgcataaaggatcacccagagggcttgttaaaaccagatttctgagccccatccccagagattctgattccgtaagactgacgtggactccaaaatttgcatttctaacaggttcccagtgatgctgatggtctgggactctactttgagaactgttacttcaatgggttaactttgactctcctttatccatgtacaagggatcttgaggcaagtgtcatgaggtcatacaggagagcatccatcccttttgttagctctcagtccaaaggcttttgatttcactgcctgacaagctcctggcagtctctgcattagagaggtggcaagtagctgtgtggaatgtgtctgctctgctcggactggctccaggattgcagcccccaccctgtagtgtatacacagcatccacaggtaacctgtagcagggctttggagagtcagatgtaggaaaggatgcagccccgcattttcatcccttccccaacatgatgcctcccacccccgaggtggccctactggagaagactccaggaggagcgagtagagggaccctccactgaggcctgttactgaaggaagaggtctggaccctgtgaagaaggccctgaaagtcagtcagtcatttctgcccttgattttctctactcccctccctgcctgcctggccattttcttcttccctttcttccctcaatattaactgaatatatctccgtgccaggcactatactatggaagttagggacaacaaatgtggaaaacccagtcctcaccctccaacattttatgccccagtggcaaagacagatattaagtgaccaccatagaagatcaaaagcaataggtgctaaaatgcaaatacatggaaatacagggagcacagaggtaggaacaatggattctgacaaaagaaattaggaaagacttcaataagagggtggcattttaacttgttccaggaggagaatgggaagaacgaggagtttgtgctttggagaacagaaacggctaagctctccccttagtatggtacccctttccgatgggaaaacagcatatttcaaagcctttacttagtgctatcaagagcaccagctcttcctggctgcagccccacatccaagggtgtcttccagccatccacactggtagtcactgctgggatctactgtactctgggcctggtattcaagcaactgtagtgcacgtgcgggctaataatggggagaactcatgacgaatgatcatggcttataattccaaagagggtctttctagggaaagatgtccagtttctcaaattagggcaacaagctcaatcttacatttctcatctttcccacatgtcagccttatcaggcatgtgggctttttcttttttttgacctctatcctgtgacataagaaagacagtagctatttttctggatatctaaggtgaaagtttaacacaggaagccccctggtgactctgtatttcccctctactgtttgcttaccaactgtgtgacccttagcaagttactttatctctctgtgtgtcaattttcctcatccacaaatggggatcataatacctaaactcatagggttgttgtgagaattaaatgaattaatacttataagtactccataactgttagttgttttttcatattgacatttaaaccaagcaaatatattttaaggtaaattagccccagaaggtccttatttctatttttttcatgtgtttaattcagaactctttatctggatttcaagagggcccttcctaagccaggccatgtgcaatgtttgcctgtttaacatgacagacccctaatctatcgctagggctgagaagctctttgagagcttggagaagaaaactctcctgttcctatgttgggagtctctagtatttcttcaacacctctcccaaattgtttgttatgtacgaagcttcagaaatagagaaggtacatcagatcctacaacacaaagggccagcacagaaatcttgaaatgcctattgctataaagggagttgggaatgggaaactcatggacccttgaatccagcctgggttgaattctgcctctgcttcgtgatcttgggcccataccttaagcaccctttgcctcacttatctgaaaaaacaaagatgataaagatgcctacctcagggggttactgagaggactaaataatacattttgggtaaagcattattattatagtgcttgatacataatacacactcaataatattagctcttgtagcataatgtaaagaagaccagattggaagttgaagttacagagttttcgtccaagtgtgtcactattaatctccaataataattgttggagctgcactttcttttctgtaaaataaaggagtaggagaagatggtttcaaaagattcttccaggtataatcagctttttttagcctctatcatctttcctttcagagggcagaacaatagcttctctctctctctgggattcagggaatagactgcagaccctggaagagcttccttttatttgtctatttggcctttattgcttctggccttactgattttcagggatgagggctgacctgattctttctctttcatgggcctgagcctatttccattttaacagatgctctgggcttactttgatccctttctattttgatattcactgaagaactagaactagatatgtgtcttcttggagcctcaatcttctcagttgtagagactggatgatctctaagatcccttctaatgccaatgttctatgagtctgtgaatccaaactggtacccctttccagctgaagtttggccttgactgctacaaagctggatgcattcaagggcagtgtgggcaacaaagatttcagccaatggcgaggactacaaatgaagcagctgtaatgtcaggaagcatcaccataatttgaggctcaaacagcgtaaagtagaattttatagaaggtaggcttttggaggtgtttatggaagtcacaatgggacagtttgaagatagaataatgccttaatacaaaatttcctggctttcttttgagtcattggaacacagtgtttatgtttcgtaacgttaatcacatgcaattcttctaaatctgggatctaatggatgcaaaaattggtccaaatgtcaattttaaacatatgttttttatattgaatagacctgtatagttccaaacaccagttaactctttgatgaaattagggtctgatttttttcagaggtggttctgattgctattcaagaaagaagaaaaccttagatcactccagcaatggggtcagctgaggaagactatttcctgaaacaaagcatgaagcctgggatagctcagtaaatactgctcaccctaagtaatggatggagttgggaagctgtccggcagactttggtagactctggaaatttgaaaatcggacagaacaatgaaagccaacgtgagaaccctttcatggggactttaaatgcagatggagaacatgctgattttgttggtcattaatagtcatctgaatttcaaaatgaccattttcatttttttctactgatgtgaaacagtttcactcagtcctcagagagcaattaaccagactttttgttggtatccaacaactgtgcttgttgttttgtcttaagaaaaggaggctgggagatgacttagcctttcaggacaataagaaatttacagtttaaaaagtgacagaaatagggttagacataagtttttaaatgccaggacatcacaatgagaactggcaaaaaccatgatatggaggaatgggtggcatctgctctgaagatctgacaactactatctgttttatcctacaaggaaatggaggacaatttgattcttaaagttccttcccacttggtgcttcaaataacactgccatgactcataaccatttggatatttaaattggaattgtcttttgagccaataaaagttatggaagaaatctgcctcatagtcataacctgagatttttttcaccccaactgaaatttcccagtttaattattcactttattcattagaatttttaatttttttttttgaggcagagtttcactcttgtcgcccaggctggagtgcagtgatgtgatctctgctcactgcaacctccgcctcttgggatcaagcgattctccagcctcagcctcccaagtagctgagattataggcgtgtgccaccacacccgactaatttttgtatttttagtagagacagggtttcaccatgttggccaggctggtcttgaactcctgacctcaggtgatctgcccacctcagcctcccaaagtgctgggattacaggcatgaaccaccgtacccagcctattcattagttttggcatcaaataacttttgtctattttgaaaaatccagcttagcactaacaggtaagattagtgatggataaggtaccaaagaatgtgctataaacttggagagcaattcctaaagagatatttccagatattttcagcaaaggcaacatcaataaaagaactagagccttctgaagtgactttttttgaagaaagcttccttcatttgggtatataagctctaagatgtttgataaaaagttagcatgttacctcctaagcttacttcatgtgtaaggagaaccttcccttccacccgcctctcagattttaggagagcaagtgaaatgattcaactttgtgggttacctacagaaaacaacttcatactatatttttactactgtctttgaaacctgctttcctatccgtgaatgtccgtcttctcaaagcagatttcttagcttttagataataatgaacaattttattttcagattttaaaaagtccaggcaattttatataaaaactagtttttcatccaatttgatttacatcttggacaatttaggcttgacataaatcagaaaactgcagtgaggggagaggctacatatttttgtttgttttttttttaattctcttcctaccaattcctgaaggagcagagggaaagaagaaaggtataattgggacaaccatacttattgactgtggtggtgtaatatggctttggttcaccctctgagggtgatgccaaatcatggactcctctcttgccagacatttttgtgggttcttccaatgctttcctgctggaaacccccatgtcatactgttttcttaggcaggcagtatactctggtggaccacttgaaactcctctaagcgtatactattgatatatatatctcagtctctttctgttgggacatgattctttaaagataactgaaagcttggttacctgttgtggtaactactctagcccaggagagagaggcatctttgttctgcccttagtagagatataatttcataatacaaccaccctctcacctctttcaactgttagggacagttccagcctgcctcttcattagacctttccagatgagaaccaggcactgggctccgtgcctgccaaacttcagcacatatcaaggcttcccaagaactcttttgatactctagagtgtttctggagccaaggaaccctatcactgggcttggagtggagaagaagagccttcctcctgttcctactgccaagttgacacagctctcttcaaacacagacagaatcttctccctcattaacctcacagccccctcttatatgcagacaaaagatgggcaataggtcccatctcatttgggtccagagctggtctggggctaccccttaggaagtcctgcatggacaggttagctctaacttctttttaagatgtatgggcactttatacccatcaacctcagctttggggcttcaggtggaatggacaacagaaaagtcccacttgttacaaaagtaaaggctcaatgagaatcagaatcagagtcatggtggagctgaaaggatattctcagtttattattcgaaagatcatttcagacacaactatttctttattgctttattttaggttagtggggaacccaaacaaaactgctaatgaagcagggcaggtggaaaccattgaggtgatgctggaaagagagagcacttcaatgtgaacaaagaatcctgatggtccttccttctgaactgtgaaggcaaagtgaagtgcagacgaatctcattacaagagatagggaaaaaaggggaaggccagagttggtggggaaacatcaggaagtgtagtcatgtttgccatctaaggccaagggaaacagagtcaggtaaggcaggagaagattcatagctctgaatcaacagattcgtgctggagaattagctcattgccagggaagagaacgtctaaagctttaagtacatattcactgtctcacccatgcacacacatgccacaaatgcttcctggtgctgactctgtaccagggactgtggtaggcactgggattgcagccatgaatgtaagagagtttactcagaggaaaacaaataaaccacattcaagggactaaaataagttctgtttggctggagaacagagcgcaagaagaaggatggcacaagatggggttggagatgtgggtaaaggtcaaatcatgcaagtctctgtggcccattttaaggaatctgaattttattccagaggcagtgaattaaagggttttaagaaggtgttaacatacactgtgttttataaaatatttttggcctcagtgtagaaaatggattgaaagagaggccaaaataagttaaggagacttggggagtaagatgaaggagtaagttaagtttctaactcaggcaattgtgtgacagtgatgccatttgtttagataaggacgttagagaagattcaaacttatggcaagggaatggagaggtaggggaatggagatgttgagcttacatttagataaacatgcctgtgaaacatccagttgtttatgtccagcagaaagctgaaggccagaagagagaaatggtcaagacatatgtatttgtgagtgtgggcggaggattacctaggtgctgaggcaagagactgaaggcacaaactgtttcagtataataaagaaaatagttagaataagaatagtcataatacaaattagatatagagatgaccatgaacaattatcaatcattattataaacattattaatcattagcttttaatattactctttgttgcattactaatataacctaggaataaccggcgggtatagggtcaggtgctgaaggggcattgtgagaagtgacctagaaggcaacaggtgagccttctgtcacgcccgcataagggccgcttgagggctccttggtcaagcggtaacgccagtgtctgggaaggcacccgttacttagcagaccgcgaaagggagtctcctttccttggaggagtcagggaacactctgctccaccagcttcttgtggaaggctggatattatccaggcctgcctgcagtcatccggaggcctaaacccctccctgcggtgctgtgcttcagtggtcacgctccttgtccactttcatgttcctcccatactcctggttcctctttgaagttcatagtagatagcggtagaagaaatagtgaaagtcttaaagtctttgatctttcttataagtgcagagaagaaaacactgacgtatgctgccttctcctctgcttcggctacctaaaagggaagggccccccatcctgtaatcatgtgacctgcttcaccttgtcaatcacttagaagattcacccttcttaccctgcccccttgtcttgtatgcaataaatatcatcgagcccagctgtttggggccactaccggtctctgcgtcttgatggtagtggtcccccgggcccagctgttttctctttatctctttgtcttgtgtcttcatttattacaatctttcgtctccgcacatggggagaacacccgctaagccccttgggctggaccctacatgtgagtgacaaatagataatagtctccttttctgttgggctttcttcatctttttatgggtcctgacaatctcgaaccttcctgaaactaggtttacctaatattaccagtagatttaggaatgtatttattggtattttacactagtttcttgaagcagctaagagcaaacaaggcagttatttattccctatgtctatataatgtccccagaatatctcattaagaaggcctaggtcagttgttctcaaccttactgtacactggaatcatctggggagctttaaaaaatactgataaatgggacctactcctgactccctgccaactctgcttttgctgcctgggaattggatttttttaaagctccccagatgattctaaatgtgtagccaagcttgagaacaactgacctagatcctacttaattaatgtggcttttgattttgcatcagcatttccaaataaaggacatatattcatctctagagaactgcttgtttagcttaatggaagaattgcaaagtttgagcaggcccttcagggatacaagtgaacagaggcataagcatacgcatttgcggggacagtgaagacactgatggggccatagccaatggattcatgtgtattgtcaagtactttgacacatcttgtctaaattgtccataggtagccagcaacgtaggctggttctctcctagcagcgccaaacagaaatcagaatactgttctccagaattactgacccattacataggggaaggcaaaacatgactgcttgatattaggctcaggaaagtggtaaagaggttgcaatcagtttttggtcctctcttgtcaaaccattttatcaacaaatcagccccacaatatttaacagtctggtaactgcaaggcatgacacttacccttccttaaaaagcatgttaggctgggcactgtggctcaagcctgtaatcccagctctttgggaggctgaggcgggtggatcacctgaggttgggagttcgagaccagcctaaccaacatggagaaaccccgtatctactaaaaatacaacattagccgggcgtggtggtgcatgcctgtaatcccaactacttgagaggctgaggcaggagaatagcttgaacccgggaggcggaggttgcagtgagcccagatcacgccattgcactccaggctgggcgacagagcgagactctgtctcaaacaaacaaacaaacaaacaaacaaaaaagcatgttaacaaagctgtgtgatcctgtttttagcattttactcagattatcagaaaagtgtgggttgcattctacttcagggactttctcatctacctttttcttaccctctctgtatctccttcttttttttgttcctggttgtctctggcctatactatctttcttcactctccctctgattgcttttcttttcttatctttctcacacccctctgcctcttgcagtttcttggcactctgccctaagcactttgattcttctcttttaacttccatactcattcctgattttacccccaccttaggcacacctttcctccttctgtcttctgctattcgccctgcacccttcaacagtctttcttcatctttaagagaaggcactatagcagaaaaaacccttgagtgaagaagtagggaaccgggatttcaggccctgcctggtcagtgacagcagtattacctggggtaagccacttacacattctgggtctcaatttctgcacatagaaataaagttggtatgagtcaatggttctgaatagggctagaaatagtctcttttgttcattgtgcttcctggtaactaaaagaatgctaggaacataggaggaagtcaataatttttgttgaataaatgaataaatgtgttgcctgaagaaaccaccaatggcagagcatatacattaaaccattttttagcaatagggttcaatttgcatttattcatacatatgttttcccctactttctcttgggcatgaaaatctacatttgtgtgaattttgagcaaggtcatgagcaaggtctgtgatctgtaaatggtgtgacataaattggcccatgaagtaaagagcccatgaccgtgaccgtcgtaggaccctaaagatgtagtaggccaaatgcaattataggtcatttgaccattctctaaagccatttacaagtatgtcttaaacacattttttagaaaatcaagagcatattaacaaagcaaaagaataatttttgaaaaacagactacattgaaaagagaacagaatccagagcatcttggggtaataagtcaaagatatgaaacataaactccttcaaaagtacataaataactgaaatagataatgcttgctctctggaaatatagtatgcaagatggagagaaggttaaacagcaagaaaattaagtaaacaaaagcaactaatcaatagcacattaagacttataaaccagtcaggaaacagcaaatttgaagtgcagagccatttcaaatgcatctaccatgatataattggactctagatgtaaagaggaaatatgaggataattaaatttgaggttgtgggaacctaaagactataatataaactgtatcaaataaaaaaggaaaagcaagaacacggtgaggaagagaaatagcttttcttttgaaaagaatctttatttaggactccaaggactcattagatagagaatcattcattaattctcttcatataattaaaaaacagattttaatgtaataatttagagtggggtaaatgtttagaatccttgtagttgtaaaaagttttcctcttttcaattataattaaaaaggctttaaccttatgctatccttatactgcaactctagtgtttcattgttaaaattaaatttttaaaaggcgatctttgttcttttgaaatgtactgcataagacaaatttcaaatggaagaataatatttattaaaacatcgcaattgccttaacaaaccacttaaaaaaaaactcgggggaggagccaagatggctgaataggaatagctccggtctacagctcccagcctgagcaacccagaagatgggtgatttctgcatttccatctgaggtaccgggttcatctcactagggagtgccagacagtgggcacaggacagtgggtgcagcacaccgtgcgcgagccgaatcagggcgaggcattgcctcactcaggaagtgcaaggggtcagggagttccctttcctggtcaaggaaaggggtgacagacggcacctggaaaattgggtcactcccacccgaatactgcgcttttctgatgggcttaggaaacggcacaccaggagattacatcccacacatggctcagagggtcctacacccacggagtcttgctgattgctagcacagcagtctgagatcaaactgcaaggtggcagcgaggctgggggaggggcacccgccattgcccagccttgcttaggtaaacaaagcagccaggaagctggaactgggtggagcccaccacagctcaaggaggcctgcctgcctctgtaggctccatctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccctgacccccaagcagcctaactgggaggcaccccccagtaggggcagactgacacctcaaacggccaggtactcctctgagacaaaacttccagaggaatgatcagacagcagcattcgcggttcacgaaaatccgctcttctgcagccacctctgctgatacccgggcaaacagggtctggagtggacctctagcaaactccaacagacctgcagctgagggtcctgtctgctagaaggaaaactaacaaacagaaaggacatccacaccaaaaacccatctgtacctcaccatcatcaaagaccaaaagtagataaaaccacaaagatggggaaaaaacagagcagaaaaactggaaactctaaaaagcagagcgcctctcctcctccaaaggaacgcagttcctcaccagcaatggaacaaagctggatggagaatgactttgacgagctgagagaagaaggcttcagacaatcaaattactccgagctatgggaggacattcaaaccaaaggcaaagaagttgaaaactttgaaaaaaatttagaagaatatgtaactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaacgagcaaagcctccaagaaacatgggactatgtgaaaagaccaaatctatgtctgattggtgtacctgaaagtgacggggagaatggaaccaagttggaaaacactctgcaggatattatccaggagaacttccccaatctagcaaggcaggccaacattcagattcaggaaatacagagaatgccacaaagatactcctcgagaagagcaactccaagacacatcattgtcagattcaccaaagttgaaatgaaggaaaaaatgttaagggcagccagagagaaaggtcgggttaccctcaaagggaagcccatcagactaacagtggatctcttggcagaaactctacaagccagaagagagtgggggccaatattcaacattcttaaagaaaagaattttcaatctagaatttcatatccagccaaactaagcttcataagtgaaggagaaataaaatactttacagacaagcaaatgctgagagagtttgtcaccaccaggcctgccgtaaaagagctcccgaaggaagtgctaaacatggaaaggaacaaccggtaccagccgctgcaaaatcatgccaaaatgtaaagaccaacgagactaggaagcaattgcatcaactaacgagcaaaataaccagctaacatcataatgacaggatcaaattcacacataacaatattaactttaaatgtaaatggattaaatgctccaattaaaagacacagactggcaaactggaaaaagagtcaagacccatcagtgtgctgtattcaggaaacccatctcacgtgcagagacacacatgggctcaaaataaaaggatggaggaagatctaccaagcaaatggaaaacaaaaaaaggcaggggttgcaatcctagtctctgataaaacagacttaaaaccaacaaagatcaaaagagacaaagaaggccattacataatggtaaagggatcaattcaacaagaagagctaactatcctaaatatatatgcactcaatacaggagcacccagattcatgaagcaagtcctgagtgacctacaaagagacttagactcccacacaataataatgggagactttaacaccccactgtcaacattagacagatcaacaaagacagaaagttaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgcaaaagaatagaaattttaacaaactgtctctcagaccacagtgcaatcaaactagaactcaggattaagaaactcacccaaaactgctcaagtacatggaagctgaacaacctgctcctgaatgactaccgggtacataatgaaatgaaggcagaaataaagatattctttgaaaccaatgagaacaaagacacaacataccagaatctctgggacacattcaaagcagtgtaaagagggaaatttatagcactaaatgcccacaagagaaagcaggaaagatccaaaatcgacaccctaacatcccaattaaaagaactagagaaggccgggcgcggtggctcacgcctgtaatcccagcactttgggaggccgaggcaggcggatcacgaggtcaggagatcgagaccatcctggctaacacagtgaaaccccgtctctactaaaaaacacaaaaaaaattagccgggcgtggtggcgggcgcctgtagtcccagctacgcgggaggctgaggcaggagaatggcgtgaacccaggaggcggagcttgcagtgagccgagatcgcgccactgcactccagcctgggcgacagagcgagactccgtctcaaaaaaaaaaaaaaaaaaaaaaaaaaaaagaactagagaagcaagagcaaacacattcaaaagctagcagaacgcaagaaataactaagatcagagcagaactgaaggaaatagagacacaaaaaaccctcaaaaaatcaatgaatccaggagctggttttttgaaaagatcaacgaaattgatagactgctagcaagactaataaagaagaaaagggagaagaatcaaatagatgcaataaaaaatgacaaaggggatatcaccaccaaccccacagaaatacaaactaccatcagagaatactataaacacctctacgcaaataaactagaaaatctagaagaaatggataaattcctcgacacatacactctgccaagagtaaaccaggaagaagttgaatctctgaatagaccaataacaggatctgaaattgtggcaataatcaatagcttaccaaacaaaaagagtccaggaccagatggattcacagccaaattctaccagaggtacaaggaggaactggtaccattccttctgaaactattccaatcaatagaaaaagaaggaatcctccctaactcattttatgaggccagcatcatcctgataccaaagccgggcagagacacaaccaaaaaagagaattttagaccaatatccttgatgaatattgatgcaaaaatcctcaataaaatactggcaaatcgaatccagcagcacatcaaaaagcttatccaccatgatcaagtgggcttcatccctgggatggaaggctggttcaacacaagcaaatcaataaaggtaatccagcatataaacagaaccaaagacaaaaaccacatgattatctcaatagatgcagaaaaggcctttgacaaaattcaacaacccttcatgctaaaaacgctcaataaattaggtattgatgggacgtatctcaaaaaataagagctatctatgacaaacccacgccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaactgtccctgtttacagatgacatgattgtatatctggaaaaccccattgtctcagcccaaagtctccttaagctgataagcaacttcagcaaagtctcaggatacaaaatcaatgtgcaaaaatcacaagcattcttatataccaataacagacaaacagagagccaaatcatgagtgaactcccattaacaattgcttcaaagagaataaaatacctaggaatccaacttacaagggatgtgaaggacctcttcaaggagaactacaagccactgctcaatgaaataaaagaggatacaaacaaatggaagaacattccatgctcatgggtaggaagaatcaataacgtgaaaatggccatactacccaaggtcatttatagattcaatgccatccccatcaagctaccaatgactttcttcacagaattggaaaaaattactttaaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaaaaagcaatggggaaaggattccctatttaataaatggtgctgggaaaactggctagccatatgtagaaagctgaaactggatcccttccttacaccttacacaaaaattaattcaagatggattaaagacttacatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacagccaacctacagaatgggagaaaattttctcaacctactcatctgacaaagggctaatatccagaatctacaatgaactcaaacaaatttacaagaaaaaaacaaacaaccctatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggtgattcctcagggatctagaactagaaataccatttgacccagccatcccattactgggtatatacccaaaggactataaatcatgctgctataaagacacatgcacacgtatgtttatggcgccattattcacaatagcaaagacttggaaccaacccaaatgtccaacaatgatagattggactaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggagggatggcattaggtgatatacctaatgctaaatgacgagttaatgggtgcagcacaccagcatggcacatgtatacatatgtaactaacctgcacattgtgcacatgtaccctaaaacttaaagtataataataataaaaaaaagaatagaacacaaacacacacacacacacacacaaactcaagtgacgatattgaaactgacttttccatgtttaaacattcatttaaattcagaattacttgaactagacaaaatttcaagaagttgagcaagaggtctcttcttctacaataattcaatttaaatacatataatagatttatgagattccaggcactattctgggcattggaaatacagatatggacaacacatagtccttgtcttccaaagctgatggtctcatagggggacaaaaatgcccataaataactataacataatgatagtcgtatattccataaaagaacaaagcattatggccacagagaagaacatattactcacttctaatagctcttataaaactttggttgtaatcctgattctctgatgacttagtgaatggtgctagacagaaaaaagtatattgttgacagtgggtaggcaaattcccttccccctctatctcctactttcagtagttcagagatgagactgggtgcggtggctcacgcctgtaatcccagcactttgggaggccgagttgggcatatggcttgaggtcaggagttcaagaccagtgtggccaacatagtgaaacccagtctctactaaaaatataaaaattagctgggcgtagtggtgtgcacttgtaatcccagctacttgggaggctgaggcaggagaatcacttgaacctgggagagagaggttgtagtgagtggaaatagtgccaccgtactctagcctgggcaacagagtgagactccatctcaaaaaaaaaaaaaagaaatttagagatgaatgtgtactgttttcaaccttggggtaaggggaacaagtgctgacataggcattccacagtaggaattgcgcaggagcacacttggaagctgagatgttaggcccattgcccctggccttaattctacaaccaagtacttcagcatctggcatcttgaaatggtcaagaaaaacaagaacattaatcttactgtgagactcatatatctctcactgtggcaggtaagaggatcagtctttcaattcatcttttactagatccctgttgaatttctcacacaacagattcccatatcatccctgttcccacagagccccacaattgcaccttctttcgcccacttgcagcagataccttcaagtcctattttcctacaaagttgtatgtcatctgatatgaatatcctaaagtactcacgttaaggttccattccagcaacctcaaaatctttattatcttacagtgtactgcttaggagtagaaattctggaatcgaattacctggaattaaattttgcttataccacttactgtctctcatagagagacattgggctaaaaaaaattgagccttagatttttcatctgtaaaatgaggaaattaatagtatttaccttatatagttgttgataaaattaaatacttctagactactgagaatagagcctgatattccataaaactacaaaataactattattattattattatccctctattgctgagaatgaagataaatgtcgtattcattaaaggtcctctttcctctggcctccttcagaagttcactctaattctctacatcttatatcttgacttatttccattaggtctattctcttgctacttcaaaattccattttaaaaacctatttccttatcctgctacagtactgtgggtctcccttgcagcactgacaaacttctttaaaaagcccttgcccctttcaaaatcacctacccacttgtttctatctaatcaatttggtccaagtgttctttttcatcactagtagacttccatctaccaaatatgagggcttttctttgtcactcttcttctccacctctgcgtttaatagcaactgaatattgaccaacaatttcctccttcttgaaactctcttcctttcccttccatgactcgcttcctacatctcagaacgagccttctctgcatctctcttagacgtggtcttttctcaagttgtcctcagtctccttttaccagatctattcctgagcaatatcatctactcccacggttcagctctatatgtgactcccagatcatatccctggcctgatacctgagaaaatctacacactagtatttccaactcaatcggggtcatttgcacctgcatttcttgctgcacttaaaaactcagcttattcaagtttaaacattttccctccaaagggaattttatttgattgacttactcctgttggtatctcttctcaacccattctctctctgtgttccagtcatgctggccttctttccatttaaaatgccaccttacagcctgtgttacctctattagaaacttcctttcttttcccagcctagtaaacttctttagcttgaatgtccctttctcagggtagcccttccatccttattaatgcttagcatttttttttttttcgagatgggttctctctctgtcacccaggtttgagtgcagtggcacagtcatagttcactgcctcactgcaacctcaaactcctgagttcaaccagtcctcctgcttcagcctcccaagtagctgggactacaggtgcaggccaccacacctggctaattctttcttaaattttttttttttttgagatggagtcttgctctgttgcccaggctggagtgcagtggcacgatctcagctcactgcaagctccacctcccaggttcatgccattctcctgcctcagcccctgagtagctgggactacaggcgcccgccaccacgcctggctaattttttatattatagtattgtagtagagacgaggtttcactgtgttagtcaggatggtcttgatctcctgacctcgtgatatgcccgcctcggcctcccaaagtgctggaattacaggtgtgagccaccgcgcctggcctcttaaatttttttttgtagagatagggtcttgctttgttgcccaggctggtctccaactcctggcttcaagtgatcctctcaccttggcctcccaaagtgctgggattacaggcatgagccactgaacttggccgggactagtttgttttgatctcagttgtacctccagtacctggcttatggttgagccttccataactattcactgatgaacaaaagaataaatgaatacaaaggcatcaaacagtatagcacatttgaggaattataaatagttttatgactgaagcataaagggaattgggtgagggggtgggaaaggggaagcagcaaaagatgacactgaagtggtatgcaggggtcagttcaccgcaggctgtgagcgttgttgggaagcttgatctttattttgtatgtgggattgggtttgctaggggttgcaatcaggaaagtaagacaaccagttgcatgttttggaagatcatactgacagcgctgcagaaaaaggagattagagaggatgcatacttctctagatgaaggggaatgaagacgtggactatgtgtttgggttgtttgtactgaacatctgctgcttttgcctgcctgtcatcaactcccatttcttctgacaacagtgctcccattttccttttataaaaagtatctattccccactggatgctgttctgttgagactgtcaataaagatgccccgccctcccaccaaggggcaggagtatgatccgaactaagccaatcaaattttctctctctggaatcagagacgcaaactggctgacacaaagactgaaaaatgactggggctcattcatcccaattgtggcctctgaagagactgttcctgctccctggatccccagagttatccaatttcctaccctttcttggttgcctagctttttaaaatagtctgtgtgctatccatatctttctaataaattcttttttttcttttttgcttaagttagccagagttggttactgttgcttacaaccaaagtatcctaattgatacagcactgtatcccaaacttgcctgaatataaacatcatctaaggtgcttgttaaaaatacatatttctggatcctaccctagccaaaatcactgagtcagtaaccccaggggaacagcctaggaatctttatcattaatacattttttctggtaggttttaataaccaggcaaacttggcaaacacctaactagggcaaagacagcagggaaagaaaaacaaagaaactgacagacatagtgataagttggatgtggtggatgaggagagggacctgacttgagtgactaacaggatgatgatgctctaaaagctaaggagaagcatgtttataggggaacaatgaatttagttttgggatatgctgatatttagataatgcaggatatttaagggaaaataggtagctagtaaatggtgctgccacttactagatgtgtgaccttggataagttacttagcctctctgtgtaatggagatcatcatcatcatcatcatcatcatcatcttagtaattataatacctattcatagggttttatgacacttaatattaacgcacttagaactgtgcctggcacatataggtactacataagtggcagagaaatgaatgaaaaaagcgggatataagggtctgcattttaggagagaagactaaggcttctgagttatgatcctagagggagtgactgaagtcacagaagtgaatgatctaagaatgtatggacctacagtatataaaaaacagaaggacctctacttggtgggctttttgtcttatttcaacctatcaaaattcttcgacaacatttcatcaattctatgatgacttttttcacatttttcacatctctggaaaaggaatgcctcttgccatcaatgacatgtcattgtttaattatcagaattctttcttttttagtggtgcataaaataatggtgtgtctttcagttgacagcatcttagatttgatgatatgagaagtatgatctctcttctttgaacctcaaagacatcccatatcagcctcttctataacatttattttagcctgctgaatattagagtcgtccatcagctactacactgcaagaaccccaagggtcaagacatctctgactcttccttttgtttctcaaaggacacactaaatggttttgcctgcaaaagacccttaataaaaattgcttggattaaattgaattctaaagcaggatataaattatttttagaatttctgataattttgcaattagtctcattgcagttcccatctcttaatttgacatgtgtgagtacacacttgtttccagattactaacattacatctaattcaaagcatctacaatgtgaattccccaggtagttggttacatgaactatttcaagaaacatattcccagcattctgggaatattaaaaagataagaccagaaatcttactacaaagttatattgagaatagagaacactgttcatacacatattaataactgtgtaattactacagatgttgatactttatgtgttatcttagtttgcgctgttctttctcttaatgaagctttattccttttccttgtttacatgtgagactttgggtggccattacctgtgtgttcagtctcaccaaatccctaggggtcaactacatgctcagacatgcatcattattgaagtaaagagctcacctcctccccaagcctactttttgcacggaacacacctcaagccttggcaatggccaggtcaattctcttggtctgttccagctgaattttctaccatccttctctccaccatttctgactctgccatcccactgctcaagcgctaatatcacctctcaccttctggatcctagatcacattagcctctcttcttttccaaggccacaggttaataaagcctctccagtgtcacaataagaaagacgaatttaattgctgtcactgatgattgctattttgtttctctcttttctctctatggctcttcctgtgctgttttggggggctgttttgttctcagtggaatttctcatcttcaggtggacagccacatgtgtctgtgtccagtcagtcctttggcccctgtttctttttacagtacaatcttgcattgtgatcttgttcactgagtactctctcctccatagagctcactaaggatccaagggtactttgagtactcttagcattaagtaaatgggttacaggcatgtcatgtcattataataatatgtaatgtctcagtcccatcatctaccttttcccataatcctgagagaaatttgcagtgcatcccatgcccaccaaggctcagactcaacctgtcctccaagccttacctctcccagcatcctgcacactgtctcctctccataggcttccagccagatcagactatacaacaacatccaaactccccatggactcaggcacctctcaatctttgttcctattatttgcctaagcccggaattctctttcctcctttttggccactgaaatcctattcatttactcaaatctgactaaagtaggacgtccttcatgaagtctctcagtctctacctgaaaataactgtctgtttctctattctcccacaacagatttcttgcattgctgtgtctgtacttcattgtgtcttgaatgattatttgtacttagctaattccccataaaattttaagttctttgtggtcggagactccatcttgtctcagtattccttacatcagcaccaaaatgcctcatgacgtttactaaatagttgactacacaaaggtagagagattgtttacaatgatgcaagtattataaaagtaagtaatattccagaagagtaagatgaacacctagaaacccttgcaattttgaattctctaaaattaacaggaaagtcagttgcccttagaaagcacactagtctggaaattaagaggtttgcgtgttagtcttggttctgccttgggtaggtcatgtttcctctctggcttggtctcttcatagctaagacaaaggggttgctctagatcactatttcccaaaccttaatttttgcagtatctgtactttatttgcttaatagtttaaatcacccaaggcctaacattactaccaactttagccttatcctaaataagaatatctgtgaaattgtggtttcattgcagcagctatgatttgttaacataaattaaatataactgttaagtaaaaataaaaatctatgtgccattaaaataacttcctatgccactaatggcacatagtccatgctttaggaggtactggtttagacatgttcctttcagctctaaggactttaaaatcttctctggggaagttatgccccctcttgagccatttaacaaaatgcattaaatgaatcttgaatgggaatgattcagcattagcctcagggaatagaatgtaacttaataagccttccagcacctctaatgactgggattccaccctttttatgcctcccctctgagcgaggtgctgtttgcacattctgccttttctgcagcctccgctttcctgcagagccctgtatgtgtctgcctgcccggatctcccctctgagggctgtttatgtttgcacactcggcttgtcctgtggacttgtctaactaagctcccctttgagggctgtatactttggcacagtctggctctccacgggattcgtttgtccattaacacctcttgtcttgcagttacagtaaagtctttgctgcccttgcctcaagcaaataagcccacgtgattctatacttaactattcttctgtgtatttccatttattttctatactttatataatgaacatgtataaagtttataataagaaaagctataaattttggtttttaaaactgtgaagaggacatttggttgcagatgatggaataaaggcattgtaacttaattctcctctttcgaaaccaatttgacaacacgaaaataacgtaaagcagccttaagaagaaggccattatcaatgaagcaagtaaacagccataataccaagcaccataattacaaagcatacttactatgtactgagcttgcttgcttgaggtagaataaagagtcctgaaaactgtcacagccttgaaagcatactaagaactctaaaaggtggaagtggagagtgtctctataaagacttagctcctcaccacagaaaagactgagttgaagaacccatattaaactccgacttttattattattattattaattgacttttattatttgccacatgtgcttctagccaaaaaagactgacagtgataaagaaaggggtgagcttaccagatagcgacacagagtctagatctaagggaaattgctgtgagctacactgacctctggaatgtggagaacagaagagggatgtactcccagagcacaggacatgcaaacttggtggaaggaagtatgaacaacagatcctaatagagatagtacgctgcccccattcacatacttctgcaaatagatggctcgattcaaagatgagtaataattagaataggagaaagaaaactgtttatctgctgacactattattgtgtatgtagaaaattcaaaagaatctacaaactattagaattactaagtgaattttgcaacgtcactggatataaggtcaacatacaaatgtaaatttgatcactatctactaccaacaactatgaagaaaataaaactttaagaaagatacaacttcaaaaacatcaaacacctagaaatatatctaatgaaagtaggtaagacctctgccttgaaaactataaaaccttatggaaaggaatgaagaactcaaaataaatgaagggatttaccatattatggaatgaaagactcaatgttgtaaagatgttaattaatcctaaattaaactacagattcaatgcaacctctgtcagaatttcagcaggttcttgtgtagactaatgagctgagtctaaaatttatacggcaatgccaaaagccaaaaatatcaaaagtaatcttgaagaaaatcaaagttggaagagacttataccaccagatatgaagacttattataaagctatagtaattgtccaggcacggtggctcacacctgtaatcccagcactttgggcggctgagggggcgtggatctcgaggtcaggagattgagaccatcctggctaacatggtgaaaccctgtctctactaaaaatacaaaaaaaattagccgggcatggtggtgggcgcctgtagttccagctactcaggaggctgaggcaggagaatggcatgaacccgggaggtggagcttgcagtgagccgagatcgcaccactgcactccagtctgcgcaacagagcaagactctgtctccaaaggaaaaaaaaaattaagctatagtaattcagacatcgaggttttggtgcaagaatagacaaaccgaccagtgaaacataatacaaggtccagaaacagacctttacctatatatgatcatctgattgatgccaaaggcaccaatgcagtatactgaggaaaggatgatctttttcaataaatgctgttgagtcaattgaatattcatatggaaaaatgtttattgactcctaccttatcccatacaataaaacaattccagatggactacagatctaaatatgaaaggtaaaacaaggaagattttagaaacataggagaacatctttgtgatagtggagtacgcaaatatttactaaacaagacacaaagaatcttgatcataaagaaaaaaatggataaactggacaatgttaaagttaagaatgtgtgtttatcaaaagacaccattgaggccaggtgcggtggctcacgcctgcaatcccagcactttgggaggccgaggtgggcggatcatgaggtcaagagatcgagaccagcctggccaacatggtgaaaccttgtctctactaaaaatacaaaaattaggtgggcatggtggcatgttcctgtagtcctagctatttgggaggctgaggcaggaaaatcacttgaacccaggaggcggaggttgcagtgagccgagatcatgccactacatctgtcaaaggattcatatccagaatatataaagaaaaggacagacagtttgatagaaaaatgaataaaaccctgaacagacatctcataaaagtaactatccaaatggccaataaatataggaaaaggtgctgaatgtcattattaatcacagcaatataaaacaaaatcaacaccactacatgtatctgagaatggctaaaatgaaaaaaaaatcaagtgttgacaaggctgtggagaaaccaaaattttcatacactgctggtaggaatataagtttatacaccttggcagtatctattaaagccaaatgtaaacatgttctatgatcctgctactccatccctaggtatacatccaatagaaatgtacgtatatgtttactaaaagatgtccactagatgttcctagcagcactgtgtgtaatggttaaaacactgaaactctaaatgtccataaacaataaaatggatttataaattgtggtatattcaagtgagataccatcccacaatgagaatgagcaatccacaactatacccaaaaatatggatgcttcccacaaatataatgttgagcgaaaaaatccagacacaaaaaatactctatgattccatttatagagtataaaactggcaaaattattccacatcatttgcagtcaggatagtggttactattcagacagcaatgactagaagggagaacatggggaggggaattctgggttgctagtaatattccgacacttgatcagggaactgaatacgtgggcattttcagtctgtgaacattcattgaaaattcacttaggatatgtgtacatttctatacatgtgtcatgtttcaacaaaaagtttttgaaaaccctacttgtttccaatatctcacgaaagggagatttcaccaaaaaatacatatttctggcttctgaaaacatgtgaagatctgttcatagtggcttacttctaagaatcctctggagctgagcagaggccgtacccttgagatagggtatacaccattcgctacccactttgctcattcatgttccctgtctagcctttctaggcatctgagtttgtgtccctgggaatcgaagcctctctgtctgttggttcttgtttttctttcggagacagggtctcagtctgttggccaggctggagtgcagtggcgcaatcttgcactgcaacctccgcctctcaggttcaggctatctcctgcctcagcctcctgagcagctgggattacaggcagctgccaccacgcctggctaatttttgtatttttagtagagatggggtttcaccatgttagccaggctggtcttaaattcctgaccttaagtgatccacctatcttggcctcccaaagtgctgggattacaagcatgagccgctgcacccggtcttgtctattggttctttaactcagttctgagtccccaggatagagctcactttttgccctgtgtactctttccttctgtcctctattctccccctgccccaactctacactcccactgtggttgtacctcagcacactctccagtcatcttaccctgaaggcttctctcctgacctgcgctagcactcatctgattatgtctatcctcacatgccccaagtccttctcactctccccttatctgcttcctgatttcattaatccatccgctcactcaccgaccgacaaacatttattgactacttgttatgtgccagactgttcaagagcaggtgaagagcaggtgaatgacgggatagtctttgtcctgaggtccctaccctctgatgagaagtaaagacagcctgggagagtcactatacagataaagcattataagaatgtgggaagtctgagatttattctgtctgggaggagaatgtgggggttctggagaggccttgtggaagagatggtttgtgagctgtattttttaaaactggcagctatttagatttgcagagagtaaaggagactcttccagacaaagactgggttctgggttcatgtgggaaagagtatgtatttcactgtgcctgtatgtcctaaaagggagcagtgggaagttagggtggaaaataagctggagtcagaccatggagagtcatggaggcctcactacagactttactgtataggtagtgaagactattaaaaggtttttaaaaatagagtgcagagccaggagtataaagaatctttcatccatgttcatctctcctactctctctgagtcgcttagtttcccccttaagctcaacctatcattactgccaatctaatctccaaatacccttggaagtcttgtcctccaatcagcacagcagatcctagatactgtgaatgataggcaccacccactgctttctctctattcgtttcctgataagccaggggtctcctgaaagtgtgactggatgagctggcttctctcaaccagatttcatcgtgacaaacaggcaggtggaggaaggcgcaaagccacacagtacatgtctctgccctgagatgcacctcacaggtggtcccatggcctgccactcccttggggatctcctgatgaaccctaagcagcctgagaccaaagcccagtcctggccccatgtaggccccacctttctctttgccactcaggcctttttttcttcaccgagtgtattttcttggtccacctcagcaggacattgcctcctttagatcagtcccactacaactgcttcacagttgaacagccatttccaatgtgccaagtacagtcatgcactgcataaagatgtttcagtcaatgatagactacatatacaatggtggacccacaagactataatagagctgaaaaattgctattgcctaatgacatcatagccattgtaatgtagtgtgacacattactcacgtgtttgtggtaatcatggtaaaaaacaaaactactgcacagccagttgtacagttgtataaaagtatagcacatataattattatgtatagtgcataatatttgatatgataataaatgactttgtgactggtttatgtatttatgatactatagttttcatcattattttagaatttactccttttacttattaaaatttaacagcctcaggcagatcctccaggaggtattccagaagaaagcattggtataggaagtgagagctccaggccatggaactagactttccagggggacaagatgtggaggtgcaagaaagtgatactggtttttttttttgttcttttttttgtttttttgacacagagtcttgctctgtcacccacactggagtgcagtggcatgatctcggctcactgcaacatctgcctccagggttcaagcaatcctcctgcctcagtctcccgagtaggaaactgatgatcttgtccccttgtaggcccaggccaacgtgtgtgtttctgtcttagtttttaacaataaacttcaaaaggtaaaaaaattaaaaagtaaaaaacagaacaatcttaaagactaaggatataaagaaaattttgtacaactgttaggctaaatattattatacaagcatcaacaagttttaaaaaattaaaaagtttataaagtaaaacagttacagtaagctaaggctaatttattattaaagaaagaaaaactttggccaggtgcagtggctcatgcctataatctcagcactttgggaggccaaggcaggcagatcacctgaggtcaggagttcgagaccagcctggccaacatggtgaaaccccgtctctactaaaaataaaaaaattagctgggtgtggtggcgggcgcctgcaattccagctacttacgaggttgaggcacgagaatcacttgaacccaggaggcggagtttgcagcgagctgagatcgtgccactgcactgtagcctgggcgatagagctaaactcagtctcaaaaacaaacaaacaaacaaacaaaaaacccaacaacaaagaaaaacttttaaataactttagtgtagtgtaagtatacagtgtttataaattcagtagtgtatagtaatgtcttagtccatctcattcactcaacactcatttattgactcatccagagcagttgccagtcctgcaagctccattcatggtaactgctctatacaggtgtaccattttttaatcttttataccatattttcccgtaccttttctatgttttgatatctggatacacaaatacttaccattacatgacagttgcctacagtatttaatatggtcccatgctgtacaggtttgtagcctaggagcaataggttatattacatagcctagacatgtggtaggctatcccttataggtttgcataaatacacactatgatgttcacacaaacaatgcaattgctaacaatgcatttcttagaatatattcttaatgttgagtgatacatgactctactcaatcctgttggatcctcacagacagcctctgagagcatggaaaggcagagatcaggtcttctgacttaaaatctgctggttggccgggcacggtggctcatgcctgtaatcccagcactttgggaggctgaggcgggcggatcacaaggtcaggagatcgagaccatcctggctaacaaggtgaaaccccatctgtactaaaaatacaaaaattagccgggcgtggtggtgggcgcctgtagtcccagctactcgggaggctgaggcaggagaagggcgtgaacccgggagacagaacttgcagtgagccgagattgcaccactgcactccagcctggcgaacagagtgagactctgtctcaaaaaaaaaaaaaaaaaaaaaatctgctggtctactctttttatacaatagatattcaaaaatatttgtaggataaacaaatgattctatgtacaaatttctcttgaggattagttacttttttattctttttttatttggatgggttgatttttttatttggatgattttacaagaggtttgatatagcaaatctgatgttaggataatcttccttgagccaggtgtcacacaaatggttcctggggctctggcttaaaaaacaaacaaacaaacaaacccaaaaaatcttttcaaagatatatgtgttcctcaaaaggttacacacagagttaccatatgacctagccgtttcactcttagatatatacccaagatgaatgaaaacatgtatacacacaaaaacttgtacacaaatgttcataatagctaaaaagtggacataattcaaatgtccattaactgatgggtggataaataaaacatggtatatccatgtagtggaacattattctataataaaaaaatgaagtataagcacacattgcaacatggatgaaccttgaagacattatgctaagtcaaagaacctagttacaaaagaccatatcttgtatgatttaatacataagaaatgtccagaataggtaattctatagagacagaaattgtattagtgattacttagggctgggagggttgggggcgtaccggtagtgagtgctcataattatgaggtttcttcttgggtaatgaaaatgtacaaaaagtgattattgtacaattctgtaactatgctaaacaccattgcattgtatcctttaaatgggtaaattgtagctcatgtaagttatatgtcaaataaagccattataaaaaagatgcatgttccttaagcaacacttagaaaataaaaaaatatacaaagaagaaacaacttacccattattttactactcagagataaccacacttgacatttttgctatactttcttcttatttttttttctgtatatccacatgcacatgtgtgtgtggctgcacaaacatacacaactagggtcattttcaatattcaagatcgtagtctgcttgtttggcttagtgtgaatcatagcactttccacaaatgttataagcaggggtcctggggtcagacaggattcctgggtaggaaccttgcttctgcccctggcatactacgagggctggagaaactctttaatctttctaacctccagtttctgtaactgtaaaatggaaatgatgtcacctactttccatgcctgtcaagaagatgaaacgcaaagttcaataagtgctattttcctttgtccctcccagccctcctccctttagtgagagctggtttgtttccctcagttgcaaggcagactgctcttaccagtagccagccacaatgtactaaaacctagctagtgctgttgtccccactctctgcctttgcttaaatgaaagtgttacctctttcccaggagtatgaagcacagaggttgagagcgtaggctctagatccaaaccttctgggccaaattctgtctttgccattaacttgagcaagttcctttactctctgtgactcattttcctcatctttaaatatgtgtaatagtagtactaaatttataggcatttttttgaggatgaagtgtggtagtatttgcagagaacatggcacattgttaactattgttgcaatttctttatgtagtattctatgttcttctttcaaatttttagttgtccagtaatttgttaagttccaaacttacagtatttcttgtatacaatctgaagcagaattttgtggctgcaaactcataatggttactcatccatatccactagttcacagcacaaagcaatttttgtttggcaaatcgagtagttaaaaatattgtttccattaattttactacctacgtacctcctggaggcagggcaaggcagtttagttaaactaaaccaaacaaacattttagggggtttataaatgagtacttatttgtagctgttctaaatcatctcagccagatggccatgttttaaatatttccaaggaagaagattttgcaagctttctcaataacctgtcttaatgtttccaaccatcattgaaagttcttctgaaaatctaattctggggtgactctacaatttatcatccaaaccaggatgggacaaaatccaaactgggacaattctggacaaactaggacacacagacatcatcctgtatagtcatttgtcctgttctgagtgttgtccacattatattacttggtacttagcagaaaagaacaactggttcccatggtctacataacaaccttatattcttaagcttttacttttttgtcagtttgtggaatgagggaaaaagaaacagaaacccaagcagacagacaaaacttgaagaattttttttttttaattttactttaagttccaggatacatgcgcagaacatgcaggtttgctacataggtatacatgtgccatggtggtttgctgtacctatcaacccgtcatctaggttttaagccccacatgcattagctatttgtcctaatgctctcactccccttgtcccccaccccctgacagggcccggagtgtgtttgttcccctccctgtgtccatgtgttctcattgtccgactcccacttatgaatgagaacatgcggtgtttggttttctgctcctgggttagtttgctgaggatgatggcttccagcttcatccatgtccttgcaaaggacatgatctcattcttttttatggttgcacaatattccatggtgcatatgtaccacattttctttatccagtctatctttggtgggcatttgggttgatgccatgtctttgttattgtaactaacgctgcagtaaacatatgtgtgcatgcgtctttatagtagaatgatttatattcctttgggtatacacccagtaatgggattgctgggtcaaatggtttctggttctagaaaaacttggaagaatttattccttgtccttgatgatgatacttacagaacacttaataggtatactaggtgagtgtcttaaagtattgttttattaaatcttcataaaaacctgtatcatcatcatcatcatcattattgttgttttgccgatgaataaatgggtcaccaagaggtagagagagagagagagcatatcagccaaggctctacagccaggatcttcccaaagaagaagtccagaggctgtgttcttagccaacatgctcccctccaggcctcctgcaagatcctggcaagacaagaccttttgctgcagtgcccagcccagactggctatccctacaatactgtgttacaataaaaatacttcagaacacttcaaatgtgtgaaatacacattctcttcttgaatcctcacaaccctgtgaggcggttagtgaaggttatcattcttcttatttaatacataaagaaaattgaggctcaggaaggaaacgtaagctatatagagaaaaagtggcatagctaggatgatgacctaggacttggctctgactgctcttttcacaaactgctaatgacttaacatgtgatcttcttcgtgggtatttccattttaactgagttgttttggaaaggcaaagcctaccacaagggatgatctttgaacagggggattttggccaccattgcacatgcacgggaggcatttggggatggagaacctttctagtggccttcaagctacaccttttatgtaagttccttacctgttctctagaaggccacgctaaagacctagggacacagaagcaaccatggctttttaaaagtcaaatttattttcatagcacgtagattttctgcccattttctccaagactttgtgcgaaggcagcacaacatcaggccatcagtaacctgcccatgtgcccagggaaggtgtgagacagcatgagctggagagctggggaaaacttgcccctgaacacaatgtgcttatgtttgagaactgggttcatttctccacttcctaaggtgggacacagaagggtttgagttagaggctctcctatggaaggggaggtgacttagttcctgtcactccagatggaagagtaataatgaaaagaaaaatgggtgagaattatagaaggtcaaattcttctcaataaaagatatttttcccctcattaccataatcttttactagacttagctgcccaaggaagtagtgagttctacatggctaactgtactcatacactcgtagatgacttgcttctcaggaaggggataaggtagtctgcagtgcacagatatctcttggggagcttgtgaaatgcagattcctaagtcatatcccagaaattatgattcccaggaagctgcattttttataagcttccccaccgactctgacacaggtagcccaagcaacacagtggtaaagggattcctactgtagtgtgagacaggatgaggtgtaaggcagggatgaaggaagagagagaagggctcacatacatcccttctgagctgaaccagatggttgggtgaactttactcttttagtctctctaatattaatcttctttttggatgtttattccttggtttcctgacagagaatgcttgagtgacatatgaggtgagagatttggggtgtaataataccatgtcatggaaacactcataaagccatgaccccatggcatatgaattctatgtggggtttgcacaggtattaaatgttttgtggttggcttttggaagcctgctctatcctgtcaccgggatttctaagctggcctggagggaagcaggcctgcagcttcctggtgtttggagcagatgggaaaagagtctgaaatattccttgtcatcacctccagctgacagaccacaggcaaaggaggcaacagggaaaagtcagaccagctgatacgggagaaaagaggaatcaatggtgatgccttgtgaatatttccttcgtgtttctctacaaatggatggtgtgtgtgtgtgtgtgtgtgtgtatacatgtaagtgtaccaaattgtgtagcacttgcctctgactggagacagtaataaatcaggggttacaaaaccaccactagctacctcctgcaggccctgtcaaagaaacaggcctttgcgaacacagctgagccagcaggatccccagtactgtggccccacctcatgggataaaaatcacacatctgggatcaagcatgccagatgtgcaaagggctaacatggaaaagacactgctgggaagaccacatagctctcaaaaacattagtgcagggttcaatgggttttgtaaccttagtcaccataatgcttttatcagacttaggtagcagactttctactgtgccctgattctttgcctcagcatgtcaagaaggatgcagaagaactaaactctttagaagaaatcctgttgaccctgctgagacagtgacagtaaagctccagaagcaaaatgagtcctgggtgaagtccttagtttaaaatcaatttaagtgtatgatcccgagcaagttactttaacttctatataacttgcaattgttaatctataaaaatgggaaatggccatatctacttcataggtctgttgtggggattcagtgagatggcaccaagaaagtccctaggtcagggactggcacatttcaggagccatggctgaaggtgggaatgaatactgctctaggagggatgggtagacaaagggagataacttcctgttggccaagccccagaagtctgtgggcatagagcagtctctagattgtcctttaaggttctcaggttactggggcttctggaagaagtgtggccttgttatcttctttgaaaccctggttgacttctctttctctctaggtccaacaactcctttctctgccttgaggttctcttatacatctttcctttccgggcttcaggttctttcccctcaaccccaccctggcagcctagccacaccaggatgtttttccttagagcagcagtgacatgggacttgaagattaatgagtcactcaaggtttccacccagctaaggaagacagagaattcctaattcctggcaatctactcattgcttttgtgagttttaaattaaaaataggtaagactactgctaacgggtttggggtttttttggtgtgatgaaatgtcctaaaattagatagtggagatagttgtataactctgtgaatatactaaaaaccattgaatcatacactttaaaagtgtaaattttatggtttgtgttatatctcaataaagttgttattttaaaaagtctgattttttttttttttgaaatggagttttttacttgtcgcccaggctggagtgcaatggctcgatctcaggtcactgcaatctccacctcctgggttcaagcgattctccagcctcagcctcctgagtagctgggattacaggcacccgccaccacgcccagctaatttttttgtattttgagatggggtttcaccatgttggtcaggctggtcttggactcctgacctcaggtgatccacccaccttggccccccaaagtgctgggattacagacgtgagccactgcgcctggccagaagtctgattatttagttagctttacattcttctatccttctctacttttaattaaaatgtaaaataaacttaatgatacatttaaattacaaatttaaaatataaatttaacaaaaatatagagttataccatatagcattttgaatcaagatgatataccacctctatccctccaaatccatattcattctcattctcattctctctcctcctcaagtactactgtacctgtcaaaattcaatttatccttctagatttatcccatgaagcctttcttggtctctaccaagaagtatctttctaatcacttttcaaatctgtgctaagttattcctatctgttttgcacgggactaggcccagggatgcacagatgagcagggctaaaggaagatattaacaataccactcctaggatctcctctacccagaagtctcttttttacctcttccaggatagctccccagtctccatttcagaccaggactgatgcccaggcaaccttcctgcctcctgggtcctccaactcccaaacaactgccacaaattaaacttcttcatatccattttcatttactttagtctcctaattaagaactccaatgactccaattacacacacaatccaactaagtgttaagaggtcttctctgagacagctgttttgtatctcactggcatctctggccacctcacaacatttccactctattctggccagctggtttatgggtctctgcaaaggttcctcctggcaggtggaatcctagccccaagctgctccttccttgcccctcacctctttccaaggccagctctgaacattccttctccttgaaggcagtcttcccctaaggagccttgtttcatttacctgctgtctctgtgctcagcttgctgtctgttgtttgcccttcctcctgctatctgcatggcacggctcctgttgctttatgccttcatggtacagcacaatgctctgtacccagtaggtactcaaatgaaagctgtcttctcttctttaagacaaaccctctgcctgcttcagaactttccctctggactaagaggaagtgtttttgtggattttttttttggtcttgtttttaaaataagaggctgataattaattaattagctctgaattgcctatatgctaggcactgaggggactgtattttttccctttttttgacctgggcattagaataaaaaaacagcagttagtaatgacttggtagttggatacattgctttgtctgctcagaccccatctaccaattcctttagctttttcacataaaatagacccaccagatgagaccacagaagcagccattttctacaaatgagaccctggcaccacagataaagggtctaggggtggacaaccaacctggataggtcaactgcagtcccattataacacgcacctcatgtcttctggctctaagtttggggttgaaatgatttatcctgtccaattaaaaaaatacgattctttctcagattgttttcaaccacgtagtgttagttattgcatgtttaaagttcgtagtgctgcacagtgtagaaactcaagtgtataaatctaatgacatatgcttgttgtggtctcgctgagggcagtgggactgtacaactttctttttaaaatataattcaagcaaataaaggcattaagttgtactagtgcaatcgaagatttattatctaaactttgaacagtcaggaaattccagagttggattccaggagaaatatttctagaaaagaaagtagaaagacctaatgtatgtcagtgcttggcccatttgctgcctggtacaataatcctgtggattaagcatggggacctgccaggcatgtagctcatgcctgtaatctcagcactttgggaggccaaggcaggagtatcgcttgaggtcaggagtttaagaccagcctgggcaacacagtgagattctatctttactactactactactactaaaacaaaatttaaaaaatcatgggggatcatactgcacagactaaccctgaaccttgcaaaaggagaccaatgtgtaatgaatgatcgttgaatgggcttcaaaggggtaaaataattttacattttaaaaaagcatttatcttgatgtaattggccaacaaaattacattttctctgttacaaaaggagaaactgaggaacaaagaggaagtaactaacttgagtctcctaacatatccatagtagacctagaactgtattcaatatttacttactccagatactggactccaatttcaaaattacaacattcatggactactgatgtatttcatgagattaagaaattgtgagcagaaatgaaggcattcaaaggtgccttcgagacaaagttccataaaaatatcacacaaaataactgctaggcgagggagggtctttcagcccagcctgattcatttcaggcactggcagttaagccaagcttattttcatagctgtgagtctcactcagatttctatctatctattctggatcatgagtccttggagttctaattcagagcaagagaattccttttcttttttttttttttttgagacggagtctcgttctgttgcccaggcgggagtgcagtggcgtgatcttggctcactgcaacctccccgcctcctgggttcaagtgattctcctgcctcagcctcccaagtagctgggattacaggtgcccaccaccacgcccagctactttttgtatttttagtagagatgaggtttcactatgttggccaggctggtctcgaactcctgacctcaggtgatctgcccacctcagctcccaaagtgctgggattacaggcgtgagccactgtgcctggccttttcttttcttacctggttttatttctaatttcaaaacaaaacttctttctaaatatagtatatattttccattaaggagagatactataattgatgatttatttattccctggggatagcatctgcatgttccagaggtcagttttatttgtttctgtgaacatataaccatatctcaatgtggatctttctgctttggctgcttgctctaattttctctccttcctgacctgatccacacacgctcatgtgcattacggatgcctggggttggatttcttccttctcaaggtatttcgtgaactcttatacctgtcatttgcatcctgcaaactgcatcctcccatctctccacttttctgctttctcgagagtgaactcaccttccatgactaatgcaatccataagcagccttcatgctgattctacagattttaatttcctaacatttccctttagacttttcctaacatcctctttttaaaaagaaaatcccttcttggagttagtcacaggctccacatgcctcctgtgtgaaatccccccaacaagactcagatgcctcaggtggtacgtggccacgaacaggcaaggcctgcccagactaagtgaagtggagggttctaagagagtatttctactgacgtgtactaggaactgactgtgtgcccagcaccctgctaggagtggtggatgagacagggattaatcgactatggttcctgacctcaaagagctctaaggtccttggcacaatattcaagactaaaatacacagattacagcatggtgtagcagaaagggcactagatttggggcaacagatctgagtgatcttgggccagttacttaactttattttcctcaattgtaaaaggagatgatacctatctcatagtggctcttgtgaggattcactagtgcaagtagtatatactaggcattcaataaatgacatttaataatttactgttattattctttttaaatataacagcagcatttactattagaactctagaaccagccaaacaaaatctggaactcacttctattgtagaaaagctttcagagatgcctttaatatgtattagaaagaatttgttccaggcttattggtaagcctgactcttgaggcttgcatatagaacatgtttctacttccccaaaaagggcctgattttaccatgaggcaactgaagagggactctgtggagagcccactctggggagtgttgcttgttgctcaggcccacaagaatgaagagaacatttgttttgttgtcccccattctaaaagcacaggtgaaatggggtgagagcgtttcccgcttgactcctgctcttaggatggaaaatggaaaccagcaggaactcagcactgctcagctcctatctttttcacctcgcactttttcaaaaaggccatgggtcacacaggtcatggctcaaacctaaaaaagtctttatctgcaaaggaaaccaggctcatcacagaatatgctagctgtatagatgaggagcagaggttaaaaaccacgagcactatcaggcagtccttgagatggcctctaatttagttagtcctaatgaagcatacctaatgagaatactactgtatttctttttcttatacagctgtattgagatataattcacattccatgtaattcacctattaaagtgtataattcaatggcttttagtatattcacagagttgtgcatccataaccacaatcaattttagaatattttttaccccaaaaagaaaccctgcatccctcagctctcatcccccaaccccttaccccacccctcacgcctaggaaactactaatctactttccacctctacagattggcatattctggacattttgtataagtggaatcataacatatggtcctttgtgactggcttctttcacttaatactactatatttcttaaagacagcagtatcttcagtgtatgacaaaaggagagttgctaaataaagtgcagtcatactgtggattactgcagcattaaaaaacgtagatctacatagcacataaatataaaatctggaagaatatacatcaaaatgataaaagaagagaaccccagggagggggagagaggaataagactaggaatagaatgcaaagaggactcttcctattaatttttttcaaggataacttttcatgcattacttctgtaattaaaaattaattcaaaagagaacagtagaagtaagagaaagagaagcaggagctttccttggaaagtccaaatggaattgggcaggaagtccaagcttccctgatgctgctgaagaatctggaaccactctgatcccacagacccatccagtctacccaatatgcagaaaaactccctggataagatgcagccctgaagcaaagcccagggagcagtgattccctttgtgcattggcatcgagaagaaggtctacttcaaccacaggacaacctcagttgtcctcatttcctactaatttaaagggaagtaggtaggaagactgaggactctgaactgtgagagacactgttaagctctagggaaatataaggagggcaggaactacactatccaggaccctgtgtatctgtacatacatactgagatggaaatccagctcctaggacattgggaactgtcttgacctcagtggtctccacagatttagtggagtggatcttgaaacaaaagggggaaagggggacattttgtcctttttcttttcttttttatttttaccatttcctgggaaagcagggaagaggaaagctggataggctgatcccacaaccaaccactgtagggaaagagccctcagcaaacagtctgagccacctttaaaaggaaaaggcgtcatataggctcctcagtttaagcaaccaattatggatcatgagaagaatttaccttcattttcaatagactctgagatgctaaagacctaggcataactgaatttgcttgtgatgactttagaaagaatatctgctatctacacatctaggattggaatacaggtacccattctcagggtacccattttccacacagcaccacatggccgtgatgataaatgatggctcttaggtggaagacagccaagttggaatgtcacaaaaaacagagataagatagaactcatcaattctaacagacatttaaacaggtaaagtcacttgcctgaagtcaaacggtgaatttgtagtagcaacagtcatagtaatagtgataacatagttaatatttattaagtgcttactatgtgccaagcactatgctaagcatttcatatttattatttcaattaatcctcacaacagccttataatgtagatgctatcatgaccttcattttatgaataaaaaaataaaggctcagagagatgaggtaatttgcttgtggtcacacagctagctgggggctagaacaaaacatcatgtcttctgattccactgcaatgttattatcatgccatggtgcagattcttgactttctttccctagtctccaacaaccaccaccatttttaattccccagagtttctaatttgaaatcagactactaaactttttcttgtcatttttaactgtatgtttgagttaaattcacctgataaagacaagaggttatattagtaaataattaccttgtagaatttcactcatcttgtgtgcacctccacttagtattttcataagctgatacttataatttaggtgtttattgtcactatttagctaaaaattgaaattgattcttttgtttctgagtagaatgaagcccctgtttcactctttactgaagaaatatatgtaaaggtaaaaaatgaattccgaaataattggaataataatatattaagctacaaagtgaacaacttatgatatcacgggtaaaacctagagtaggttaaaataatgaaaggtgtcatggaagagcacaaatcaccagggaaacaataaaaattctggcatatgagaaggcggattacattttccaaagggaatcctgtaggctggggaggggaggggtgaatctttgaggccactcacccacagaatgaagacaactgaagaccacagagaaataaaaagcgactcaatacagtttaatatctttttttggaagaaacagaaaatgttgaactcatctgctttttcaattatgaacaggaaacataaaactatactcaataatataccaaaaactgtaataaaaactacctcgggcccatgttacagccagcaaaagaggacaaggagaagcagagagggaggtgggggacagaggagagaagaggaagctctgcggggtcccaggcacctccacatctctcactgtcagaccccctgtgtttcacagagggccctcctcaggtctacctcattttttgtttccttgcctcctaaacttctccagcacaccctttgcttctgctttctcccctcctccatcctgtcctgcccctccgcccccaacacagtctgagaaaacagatctccaggacccctgctctaatctcagcccttgttctctatagtctattggattttcaattgctaattagccctcctttttttattgtttttctttaaattaccacagtaatatattcacatggttaaaaaaaatgccaaaaagcttatcatggtgagtgcagcttctcccatcaaatataccactatttctgaatttctggtacgaacgatgaggatttagctcttgaaaaacccctacgttctattctctccttccttctcctgatgaagttatattctcacactttcttctgttcacttctgcaactccaaacaacatatttaaacctataattcttttggtagcaacaatacatagttatccatgatacccaccgagaatggaaaccatccacaggcaagcagcttgctgattactttaacttgtctttatttattctattgtctttatcaatatgattttactgtctcaggaagctcttgcccaggaagatacaacttgaaaatatgtttattgtttgtttcagcaatttcctgaaatcccacttaaataaacatcagattgcacaaattttcaatagatagtatcaaatgactgtttactctctaagactcatcctgtgtaaactaagctacaaagtgaataaccctcacccaatgttattgctctgtggtattcactagtcctatattattatattatgatattacctagccctaatcaagccccacaatgaaagattcacttcaaaccagatctcacaaaagtcctcataaatatcccattttgtccttgctcttctgaggtgctattaaaactttggagaggtatttttctctctcttaccacagtaagcaataaactcagttttgccttctcatcaggttagtttggtggtactttggagccctcattccacaattttggcagtgccactgaaattcatttgggacctgctcactatcactacctaagactcaactctaaaacagtgctcccctgagccctgttgcctcctgctgggatctcactgacattgacaataaagtttataagtcctgcattggacttggctctgatttctttttcatttcatttatttgagctctccaaatgctgagtttattttgcatcctagggttaagaaaccttttcaggaattctttcattatttgataagattgggaaaacttttatccttgatggaaatctgccttattattaaccctgctatttgtttctatctgtccttgacatttcttcttgtacatctttaaagaaaagtttgaagggaaaggataaagactcagagtctgcttctcaagctggccccaaggactaagaaattcagaaggtttcttcttgtccagcatcctttggaaaaactatgctttgggtcagttttcaaaacctcctaagaatttttttcactgttgctgttttgtctctgagactctgattcttgatgagatctcctctctaaaccttctgtcccatgggaactgaaaattcatcaaattttccattggagatggcccagtcttttggatggggacccaagtcatgaggtgcacagcgacactttcaaccaactatttccacactctcatgggtttgtctcagtctaaatcgaatgcttcaatcttctgggccacactcctgctttttacatgttcttaaataaaatccaaatttgtgaacttcctttctaaatggcacaatttcatcaagtataatttagaatgacagaatttttaataggaacaaaaatgttcacttgagaaacacttcagaataaaaaacaaagtaaatatcaaatagtctgcatttttgattagtataaacaagcatacaaaagaaattaaaattataaaattacttctttaacagattccttggccaaagcaaaggaaaaattgtgaaacacttaaaatttttttcctttagataccccctacaactcacaacttgagacacaaaccgccttcatcttcctattcctcttccctcatcctatgctcctccatttccctctgcttctctttcttcttcagatgcattcccctcctctcctggctagccagaaactctcaaagctcagttaccccttaaaattaaacccctttcagaacaggaaaacccctggcttttaattccttgtctcaatctgagctgagagccattgaaaaaagactttccaaagcctagataagatattgtgaaatttacacaggaatttaaaatagttttaattgtatataatgtggggctcccagatctataccaattagcttatatgtcagtgggaatctcagctgcaaaaaattggatggagaacgaagaatggcaagacccggagaatgacttaaaagacccagaattgcatcagcagctctgatgcagtcccataagtaaagaaggatatgtctatttgagacttgaaggatcagctcttcaacactactggacagcattcaggggcagatcctgaagcagagctgatcccagtttctcttcactttttgtgaatagcctagaaatagaggatttaatatgcaagcaaaatctagaatgggaaacagtcctatggccagacctccaccacctcactgaagatttaaagagtcttagaacaaaaacagagtaagacttgccaaggtagtgctctccattactgtggtaagcaagtcactcagctttgcctgatcgccaggttattttgctgatgttttcagggagccggcaggcactcaactccactttgtaagaggaggtcattagttcttccatctttccctccaccacttctccccccttccacttcctaattctgtcagctgtgctttccttttatagctttccaaggctgataatatttgtaatctattctttaaccaaggctatcggaagatgtagtctaagtgttgaaaaccacctatcagcttttagtttactcatatttgaatcatgactttctcatttagttctcacccttcccctccactttacagtttctaaaaggcttttctctgcttcttgaactcccatgcctttatcatgttctcagtttttccccaaatctctaatatactacctgtttcatcaaattgccattttctgcccagaaagccttcctcctggagtcctccattcttttgctccaatctggactatctgcactgttaagtctgctacccagctggtgatttgtggactttcatgtctgaaaatgtcactgccctcacacttgattaaaagtcaggtgagttatacatttctgtgttgacaactaattttcaaagtattgctctattgtattgcagtctcccgcgttgatgagaaagttgatgccaatcttagccttactcctttttctctctggaaggtttcagtaccttctatttattcttggtttttaaaatttttttcagtgatgtgtttacatgtggattggttttctttcattctgcttgaaatttactaggcccttcaaatatcaagacttttatatcccttcaacccaggggcatattcagttatgggatattttcttgcattatttccttgatcattttctctcctctgttctctccttctccacatctactagtgaaataggggaaccttctcatctccattttataacttttctttcaatattttgtatctttttgtttttctttatgttctgtatttggggacttttctctatttcattttccagtccttttattattatttttgcttgggaattatatttttaatttccaagaggtccttacattttcattgttcctgcttttaatatataatgtagcttgctgtgctggtttctgaatataatacactgtgggctctcttagctgacttccatcaaccaacttattggatcaacagacactttccagtatgtatacatgctgaatgctcatggctattaggctattcactggtttgcccacattcctacttctataaactgagctgaatacctatcaagaagagttatgtttcttccccaaatctgtttagtcaagttgtgcttggttttatatatatatatgtgtgtgtgtgtgtgtgtgtgtgtgtgataaacatgatatatataaaatatatatatatggcttttatgtggcattattaaaattatttgataattattattcatctttctttttttttttgagactgagtcttgttctgtagcccaggctggagtgtggtcccgtgatctcagctcactgcaacctctgcctcctgggttcaagtgattttcttgcctcagcctcctgagtagctgggattataggtgcgtgccaacacgcctggctaatttttgtgtttttaatagagatagggtttcaccaatccacccacctcgacttcccaaagtgttgggaatacaggtgtgagccactgtgcccagtctattcatctttttatgtgctattttttatattaaaatattttcaacatttaaaaacaaaatttgtgttgggtgtcccaagagctcaacatctggctataagtagtttataaaagttagtcttttcttcttaatgatcaaaaccaatttttaccttgacaaatccattttaacttaacaacaacttagtgtgggctttagagcctctataagtcagagatttgataaaaatttacctttgaattccagggctagggtcatataacagactaatagtaatttagatttaaataatatatatatttttactattagttaacatatttgaatcacagtaagtacagctgtcagaatgtataaggaatcatttaccacagatatgattaaatccatgcaggcttatgcaactgtggcatcccacgtgtagggtagtgggaatagtccacccttggtacaggcattgagagggatacattgtgtgtagagatttttaaagcaattataaaacgaaataaaagtcagtctgctttttattattgccatgtgccaacaattctaaacgttgccagtcataaaatactcctccctgaaacaatcttttgttggttctaacttctaaacaacccctgtggtttctgttgagttttaataatatgtgtgtaagcttcaaattagcacattttaataatttatcctttagtaaatattgtactctagatgaaagtcaattccaagaactcccagttgtttagtgggtcccctacacacacatgttccttgtgagaatgaatttgtgactgtgtgagctgtttgacattgtgcaagctcttctccagccaggacttcacatctccaactcctaatggtactacatcctcctgcacttaaacagagggttcgaaataaaccatgatagcatcgtgatcttaaagatgaaaaaacagaactagagttatttcaactctgtcaatttatgtggccacttagagattttgtgttgaaaatgtaaacggaaagagtacaagctatgctctatttctgttggacaaatgcaagttttggtttacactaaaatgttttactgaaatggaacaatacctttaaatagaaagatctttaaaatagaaatgtatttgctcttttaaattgtcaactgttttaatactataaaaggaatcaagaaaataatactattacagattatcactatgactaactgtcatattgaggaaggggatgttgaaaaatgatccccttctgggtgccaaatacactaagcatgcccatgcatgacttggcaggttgctagggcaagaccaggcagtactgtgaagcagatgagtgtggcaccagttcatcagctccatctgtgtctcgtctttcaagccctgtcccttcccaggcctcaccctagctttgccaattcaagattccacttctgaagttttgctctctgcagtcagttaacgtattcttttatggcataactgtctctatggagtatttacattttacaggagcctttactttaaagtaaatacctttattaagatataattcacatatcatataattcacccatttagtgtttataacccaattagtatgtctacagtagtgtaaccatcaccataatcaattttggaacattttcatcacccacaaaagaaattccataactattcatagtcattccctatttctgtaccccctgccacccccaaccgttttctcctctgcaatccctggccccaggtaatcacttatctactctgcaaactgattatacaaaatggactcatttttgtcatacccaaccaacgaagactaggggggcatagggaagcaggtcacaaatgcctactccgggaactgtcttccaagtccaatccaaaactgcatcagcctgctattgaggcaggagaatagggtctggaggcagggaacctaagaacttcctagaactaaatcaaagggaaaaaccctgatcttctacacccaagtaaataactttgtaacttcacttcatcctcttcatttacataggcgtacaccaattaaccagtgggaaacctcttagagggtatttaaaccccagaaaattctgtaaccagtgttcttgagccgcttgctcgagctaactccccctctgtagagtgtactttcgtttcaataaatctgtgcttttctttcattgctttggttgtgtgttttgtccaattctttgttcaaaatgccaagaacccagacaccatccactggtaacactatgcctttaaaatacaagttttacctagaaactgctgccattcaccaatcagaacttgcctgctcctgcaaaacaatgcccacaccagttaactttatttcaaaataacgtatgtaaccttcctcttttcccccaataaaaccccaggctttccctttgttctaggacatacctaacagctccctggtttgtgtgccccaaattataattcttgtatattatttctaaataaaccctttgcttgaagattcatcactcatatttatttcatgttcacactactttctgtctctatgtattcacctattctggacatttcatatagcataattttttaaggttcatccacgctgtagcatggaactttgttccttttattgctaaataatattctattgcatggacataccacatttcatttacctctttatcaccagttgatgaacatttgggctgtttccactttttagcaactgtgagtagtgctgctataaaaaatcacctacaggcttttgtgtggacatgtgtttttaattctcttgggtatatacctagcaatggaaatgctggggcatatggtaactctgtttaactttttgaaacactgcaaaactgttttttcaaagtggctgcacctctttacaatcttaccagcgatgtaggagggttccagttgctccacatcttaatagaagtctttgaaagtagggggtaaaaagagtgtgaagggagtaaacatgcactgagcactgagcataaaacatacattaactccaaaatctatgtacttttggttgtactatgctgaggaccaaaaagccttcactggactgaatcttcccctgtgtaagggcagaaataagaaattggatggttgggttgcaggaatcaaaactatagccacacctcttactgtccttagtaacctgactttaccattccaatgtcttcatcaatgtagctttcctattccagaaaactcctggtcaggaagataaaagctgcaaataatttaattgtggattccaggaacttcctgaaaaatccatcaacccctcaacagaaagtagcaaacaatagtttgcacctcaagtctcctttgaactcctcacctcaaaatccccacctggccattcactaatactaaaccattatatcataatccttagctaatcttaactaagacccaggataaaccagacttcaaaactcccataaatattctaactttgccttccccattctaagatgctaccaagagtctgtttagatagtgttttctccaccagcaaaaacaaactcagttttgccttaacaacaggttgctttggagatattctgggaaagctaagatttgacagtggatatttgtgaaaggaagcctgcaaccccacatacatgtatagacaggtgtcttgcctccctacctggatggtcagacctgcctaggagtgagtagtaaaaggctcctgtagtactaagaagaatcttgcttaaagtcacaaaatattagagtagtagaatgagaaaaacaaagaaaacataatttaaattttctattagactataagttctctgagagctttccaataatctacctactcaatccccccaaaatcctctgcagtttggtctactggtgctacatgggggttgtatggctaagccatgaccaggatgacttaaatcacatagtttgctctgagtcttgggttagatgctacatgaaaagttataatcagtaagaaaggtaccaagttctaccaaaagcgcttctttattttaaaagttgttttaaagtagtgtctttttttttttttgagatggaatctcactctatcacctaggctggagtacagtggcgtgatcttggctcactgcgacctccacctcccaggttcaagtgattcttctgcctcagcctcccaagtagctgggattacaggtgtgcgccaccacacccagctaattttttgtatttttagtagagatggggtttcaccatttggccaggatggtctcaatctcttgaccttgtgatctgctcgcctcagcctcccaaagtgctgggattacaggcatgagccaccaagcccggcctacagtagtgtattttcaaaggaacagtcacctaatgtttatttgatgccaaatgttttatgctaaagaagtatgtttttggtaagtaaaaacttattaaggccgggcgcagtggctcacgcctgtaatcccagcactttgggaggccgaggtgggtggatcacctgaagtcaggaatttgagaccagcctggccaacgtggtgaaaccctgtctctactaaaaatacaaaaattagctgggcatgatggtgggcacctgtgatcccagctactcgggaggctgaagcaggagaattgcttgaacccgggaggcagaggttttggtgagctgagattgccccattacactccagccagggtgacagagcaagactgtgtctcaaaaaaaaaaaaaaaaaaaagtccttaatctcttacctacttatataaatgaagctttacaattattattccaattattctaattccaattattatggcataacattgatacaaagggaaagagagttcacagtagacaacaaaaaagacatggacactatttaatgtaacttacatctctattaggaaattgtaaaaagtaaaggattcatatacaatagaattgccaggttcatgcctcagtatctaccatgcatatcttagttccccaaactgttcactgtttgcagatgcatcgtattttgacatatttctgagtttatgagtcattttctatccttggagtgctcttttccctcttaccaccaacagctatgttccaccatccctgtttatctagtgaaattcttttcagccaggcattctgtgctttaatgtcctaaacgacattcacataggccactattacaccttctacatccatttccactggtgtttttctaatacttgtttaaatgttttttcttaatttaagcatataaatgggaaacttaatatcaaattatgtaaaaatttaaatagcattactttccataattagaaagtaaccataaaaacaaatactctggaaaaaatacgttgttatattctagctagaaagctaacaaatgctctgattctgagactctttgtaaaataggagattgcaagattaaagagttgaggacatactccaacaaactgaaacttcctcttagacttgatcagaataatgaaaaggaaataattctcccacggtgggattcaatgttatataataccatgccatgtttctcctactcacagtcggatacctagattcctctccggtatcatcagtcgtgggtgctccacactttgggaaacattggcgcagaggaataatggtgggctttggggccagattgttctgtgctcaaacctgagggttgccatttataaatttggctttggacaggtaacttgacctttgtaaacttcctgtcttcttaagtaaatatgatcaacctcagcaggagatttgaaggatttgagataaggtatttataagatggctagcatatgaaatgtcttaataaaccatagcttatattattattatctttatcattatcatcattatcatccttcaaggcatggatcaaatattataccctctgtaaaaatgccagtttcttccctgaaatttcacaacactctgaacatactttcatttgaatgacttgtttatatctgtctcactcattgtttagtgagtttttcaaaggcaaagcctcttctcagcagagcagagcaaagcacacgctgattgaaagcctactctgtccaaagctctgtgagtcatatcatgattcggaaaaaaatctgcaaatttaaacctgcaagagattgagcactcaggcaggttatggccatatcatcagaacagttgctcaggaaacagcctcatacatgctgaaaagagcaactgatacatgtttctactttgtaaattaagaggcaagacacttagggccagaaaattttccacatgtccctagcatgcccttgtcctcccacagctgttcctttctactcctcttaataaaaaattcaagttaccaaacaatggctgctaactcttgagtacaattcctcctcttctgagaactgtcttgatccaaatatttctgaaactagatgaacttcagttcacccctccttctgaatccctataaacacttctgccctccttccccaagttaaaatgctccttcagaaccttctttgacctggcatttttgagtaaaggcttatgctaacattctctggttgattttctttactccagaaaacagtaaagtgtcatgagaatgatatttagagatcttaaaccaatgttttaaactttttaaaattgtaaaatatttcactgaaacaaaagaatacatgaaatagctaattcagttttcattctctgtaaccagttttagctttcattctctatatatcatgctgcccttcagctctttatctattgaattgaggacatccaagcttcttcagaaggtcagatactacttagaacaaaaaggtcaatatccagctttgagtttcaaattagcctaaaaacatttattcaggcaaagtcttggaaaacagattttattaagtaagttttttctctctaaattgtcaaagcttttcttaacacagcaaagcttggaggtctgacataatatttcactagaagccttagagaggattgaggatatgatgtagggaaagtttggaggggatgagaccagggccaggacattgcctgcatcacagaaaagaggcccagtgtttatcctactaattttcaggccagggagaaggagaaactgaaagacaggcatgcaagtgtttgacttttcatatggagctgcggggagactttaccaacctagggcagctacagtggcacagaaacagtgtcttggtgtgattctgcaagacaagaccgaagtcagtgcttctagtctgccacggcctttgctttcctgcaggagatccacaagttcctatgtgctctgtgaagccacagaggactgctgaggtgactggctttctgaaataatcttggtgacagtacaaggaagtctcaaaatacggacagcttaacatggagcaatggtaacgctcatgctcaacagcaggcaccgagacaaagccaaaaagatctaacagcacccagcacagctcagtaaacaccagtgtagtgcaccaagtaatcagggatggggatgactgagtgaaggccagtaagtaaccagatgatagcacatgagccacaaggcccctgcccagtgccagcacatggtgttagcagctcttagtacctagatggcatctagaaggaaaaaaaggagaaagagttcaaaactcgacaaaacatgaaaaattaccagaaagaaaaaactgagctacctttaactggaaagttgatttttgttgttgtagttattgtgattttgttatttccaagcagagttaggggctcaagagtgatcaatccatgaaataaagtgtgtttttaaaaaaatatctgattggtagaatatgaattcaaggcttcctgttaaaataacatagtgtaaggacgatgggtgcactgcagtcaagtataggccaaggtacacatctggcacagcatgacacagcaggattggaactcaggcgcacaatcccatgcattgtataatcacagctgtgtagtcataacatccgagggctcatcacctggctgtgagccactgttgtctgtgaggtgcataaatgcagcactgacagttgagtgagctgctgaataaagccatgtcccacctatctgtggtctcttgagtgttctttcagctacctgccaccccactgactcccctcagacctcagcttgggctggaatctaacaaatagtggtcaagatgatgagccctgggatgagacttcatgcttccaatcctggctcatcactttttagcatgagttgaaatcttcctccttttagtttccacccaggagtgcagttctgtgccctacaagaaatctatgcccaataaaagaaatcagccctctcatacatgacagcctttcagatgtcagaagacaacctttgtctcccctgtgagcttgtccttcgttggtctaccttctctagaacttttaatccacagtcacatcatatgatccatcaccctgtcaccatccagactgctctccctaaaagtatttgcaagttacctatattcccttcatagtaacttcacactgttaacacataactgcttgataagactccacttttgtcctcagccatgactggaatggttcttttcattcccttgaatcctcatctttgactcaaacccctcttggaattatacagaatttagtcatcctgtcaggagaaggccgctggcagctgtgattcaactatccagatattcgcaattttccctaccttatctcccttatgctgataggtttaaacaaagagatgaggttaattagaaagtcagctgttgggtccaagttccctgatcactacttctctacaaagcaagaacagaaaagtaagagagtaaagaaggggtttactgcatgttctaacaccaacccccaaagccttagtcataaaagataactttcgcccaggcgtggtggctcatgcctgcaatcccagcactttgggaggccgaggcaggtggatcacgaggtcaggagattgagaccatcctggctaacatggtgaaaccccgtctttactaaaaatacaaaaaaattagccaagggtgaggcaggcacctgtagtcccagctactcaggaggctgaggcaggagaatggtgtgaacccaggaggcggagcttgcaccggagccaagattgcaccactgcactccagcctgggtgggaatctctggttatgcttctaggggtcatatcattcaaacattgtcttgtttaaatatcaccctttattctttcattttcggattctctttttcattcaggactcaacagtcactagtggctgagaaaagagttttgtctaggttggagccatgatgcgcttatctgttgatagacatgtcacataagcatttctccagtacagaaacatgcagtaaattgaaatctgtacaccaggattagatacacccaggattgtatgccaacttccaatagctttcccacaccaggaaaatgaaatttatgataaagtagcttctaagttcaatacagtctagtggttacagagtggtttctggagccagactgcctggatttgaattccagcccctccacttactagccagtgggagagtcacttaattcctttgtgtctgagtttctctacctttaaaaaataaataaatgagatggaaagatttttttaaatgaaggcaataataaggtctacctcatagtgttgttgtgagcattaaatgcattaatatatgtaaaatgcttagaccatccaattaatccagtcaacaagggatgtaaattacgtcaagagactctgaacaagctatagtaatcttccctgtacagttatacctatgagctatatacatttatttagatacaggaagaacggtgaaatagggatcaaaaaaaaagaagagcccctgacactgccactagctagcaaattatttatcatttctgtgctccaatttattcatctgcaaaaatgagatagtaatattacctggtagttactgagaagactatgggacaatttacatggagcaccacgtaaatggcagagcactgtacaaatgtaaaaggtcattaatatcattgatcatcattcttctcacaattaattggcatccagagacatgtataagatcaggatattggccaggcatggtggctcatgtctgtaatcccagcactttgggaggctgacaggggcagatcacctgaggctaggagttcgagaccagcctgggcaacatggcaaagccctgtctctattaaaaatacaaaaattagccaggcgtggtagtgtgcgcccataatcccagctacttgggagttgaggcacgagaactgcttgaacctgggaggcagaggttgtagtcagctgagatcacaccactgcactccagcctgggcgacacagtgagactctatctcaaaataaaataaaataaaataaataaataaatcaggatatcctgccttgtaaaaagaaattgattattttctttaacccttttttctagacttgaagaaagcccctttgcatttccttggcattagagcatttcgtcttcatttcaatgtatcagcgcacgtataacactgcattacacggcccagttttcaaggtcagagcttgcctgtgatcactatacttcagtttggcttattggcctatttggatgaatatttgatctctttaaaagtgtttccaaatgacaaggaaaggataaaacacttttaggcaagactcctgtggatggctcatgatgcatttacagcttcaaacagattgtgtccttccctaaagaaggtatcctgttggaacttaagcttcagtttctcttggtttggatctcagactccattttgcttctgtaatccatgctcaaagactgctacagtcttgactttggtcattcatttccttgagttacctggagaaattaatctgattttagttaaaccttttctacaccaggtaaatcttgatataaccaaagtgaagaccttgttcacactctgtgggcaatgggtatgatttcatattccatagttcagggcctttcctcttgcatcctcaggaatcagaataaccagccttctgtcacatggaccatgccaactagaaatcaccctaaatgtcttatagtttacgtaactttattgggttctccctcaaacaaaaatcctctatttctgattatttgtcccaaatgtatctggaaaatattttcaagctaaatctcattttcttatttcctgtccatatttttaacttccccagaccccctggataatttatctattgcattattatgtgcagttaaagaagtaaagacctgctccttctcagtctttgagctcaggaaatatctccaatcatttttcaattttttgtggtccagagagagcctaaacatgtgttttctgggggaaatttaatccacatgcttatgattaatttatatagaagtcattgaattggtgtttctaagacattacatttggcaagctacctctcttgcccttcaaattccttcttgcgttttatttgagttggtatggaactctacccaggtgcttttcagtgctggcaagatacttcaaaaagtcatcctgaatatctgagatgccattctgtccattttatagttgatatataactgcctgaatggagggtatcttacagtatagagagtgattaaataatttatcatcaggattcttttatgcagcagctataactgctcctcagagtgggctatggcttctaatggctgattcattcaaaattaaaactcatttcaatttaatcccagccaatttaataatacttcactatgtacctcttatgtgctaggtacaataagtcataatatttcctgccttcaatttgctcattgtttaaaaggaaaaattgatccatctatttaaactatgatagaaggaactaaatgtaacatataatcaaagtgctatgaaagaaccagaaattcctattggagacatcagggaatatggaaatatggctgcacttaggaattactgagtatgttgtgggtaattaagagtaggtggctacagtggaagacatgcaatctgggactggctcattggaataagattccaaaggcagcgaaaatccagattatggaaagcgttggatggcatgcttaggagtctggggcattatgtaggcaaaggggatccaacgaaggtttttttttttaaatacaaagaatgatataatcatatgtttaactatgataatgtggaagacagattggaagtgaaagaaactataggcaggggaagattcagaagactgctgtgatgatccagacaagaaatatagaggctctgactgatgacagagactaaagtaatgacagtggatggcttggatttgagacacattgctgagatgggcttcatagagtttagaggtgagtaagatatgaagacagggtaggctgtgagtgatctctgggtaaattacctacattgttggggtcttccttttcttaacaatagattgaagacaatatctccagttatattaaggatttaaaaaacatagtatgagatgttttagttccttcttggcatacagcaggctctcatttcagggtaacacaaaaaataaaaatgaaaatgaggtttgtgaactaagatttccagaacaaatcaatacccatgcttttcaggtctctgaacttttggtatatactatttaaatatctttcacatgtatctctataaatatctagttattggctcatttttaaattgacaaataaaaattatacatatatttttggtgtgcaacatgttttgaaatatgtataatatgtatatattgtgaaacagctaaatcaagctaattaacatatgtattagctcacatacttttcattttttgtggtgagaacacaaatatattcttagtgattttcaagaatacatttttattaactagagctgccacattgtacatagataacttaaaactattcctcttatggaattgacattttgtatcctttgactaacatttccctaccccgcctccccttccccaccacaagcccatgatatacaccattatactctctgctcctatgaattcaactttttaagattcaatttattagattatatccaaatatcaattcagatatatatctatatatctgaataaatttattagttctaatggtttttttagtggagtctttaggatttccttatataagatcatgtcatctgcaaaaaggaacaatttaacttattattttccatataagtgccatcatgtggtatttgtctttgtgtgcctagcttatttcacttaccataatgtcctcctccaagtttatccatgttgtctcaaatgacaggattcccttctttttaaggctgagtagtattctattgtgtatatataccacattttatttatccattcatctgttgatggacacttagattgtttccatatcttggctattgtaagtaatgctgcaatgatcatggaagggcagatatctcttcaatgtattgatttcatttcctttggatatatatctaccagcaagatttctgggtcatatggtagcttatttttattattttgaggaacctccatactgttttccaataatgactgtactaatttacattcccaccaacagtgtgcaaaggatgttcttttttgataggatgaattttgatagagattgcattaaatctgcacatcactttgggtagtatgaacatgtaattcttccaatccatgaacacaagagatctttccatttatttgtgtcttcttcaatttttttcatcaatgttttatagttttcaggatataggtcttttacctccttggttaaatttattcctaagtatttctgtagctattataaatgagatttttttttttttttttttttttgagacggagtctcgctctgtcacccaggctggagtgcagtggtgcaatctcggctcactgcaagctccgcctcccgggttcacgccattctcctgcctcagcctcctgagtagctgggactacagatgcccaccaccacacctggcaaatttttttgtatttttagtagagatggggtttcactgtgttagccaggatggtctcgctctcctgacctcgtgatccacccgcctcagcctcccaaagtggtgggattacaggcgtgagccaccacacccggccaaatgagattattttcttgattctttttcagatagtttcttgttagtatattaatatgctactatttttatatattggttttatatcctgcaattttactgaatcaatttattagttctaatggtttttttagtggagtctttaggatttccttatataagatcatgtcatctgcaaaaaggaacaatttaacttattattttccaatgtggatgcttttgctttctttctcttgcctaactgtcctggctaggacttccaatactatgttgagtagaaatggtgagagtggacattcttgcctttttcctgatcttagaggaaaagctttcaacttttcaccatggagtataatgttagctgtgggtttgtcatatatggactctattgttttgcgatacattctttgtatacctaattgttgagagttttcatcatgaaacaatgttgagttttgtcatatgctttttctacatctattgaaatgattatatgttttttgtccttcattctgttaatgtagtgtattacctttatagatttatgcatgttgaaccattcttgcatccctgggataaatcccagttgatcatgataaataatccttttaacgtgctgttgaatttggtttgccagtattttttaggtgacttttgcatctatatgcatcaggaatattggcctatattttcctttcccttttagtgaccttatctggctttggtattagaacaaataaactttgatcacaaaaaacctacacttttactctctgctcccacattttataattttgatacaacaatttaaatatttttatattgtgtatcccctaacaaattattgttgctattgttatttttagtagttttttaatcttcattttaaagatataaatggtttacacaacaccattacagtattaaagtattctgaacttgactctatatttacttttaccagtgatttttaccctatgttttcacgttactaattagcatcctttttttttttcagcttgaagcatccctttagcatttttgctaaggtaggtctagtggtaataatgaactcccttagcttttgtttgtctgggaaagtctatctttcatttatttctgaagtgcaactttcctgggtaaagtattcttggttggcaggtttttttgttgtttttatttcttcagcactttgaatgtatcatcacactgtctcctggcctgtaatgtttctgctgagaagtctgctgctatccttattggaactcccttatatgcgatttgcttcttttttcttgctgctttcaataactactttttgtctttgatttttgacaatttaattataatatatcttagtgtagtcttgtgtggagtgaatctgactggagactgtattaattcgttctcatactgttaataaagacatacctgagactgggtaatttataaaggaaagaggtttaattgactcacagttcagcatgagtggggaggcctcagaaaacttacaatatggtggaaggggaaacaaacacgtccttctttacatggtggcagcaaggagaagtgccaagcaaaaggggggaaagtcccttataaaaccatcagctctcatgagaacttactcactatcatgagaacagcatgggggaaactgcccccatgattcaattacctcccaccaggtccctcctacaacacatggggattacgggaactacaattcaagatgagatttgggtggggacacagccaaacaatatcagagacctttggccttcctgtacttggatatttatatcttttcccagatttggataaggaatgttttctgctattatttctttaagtaaaatttctattcctttgtccctttgctcccccttgaacttctacaattaaaaaatttgtggccatgtgccacggctcacacctgtaatcccagcactttggaaggccaaggcgggtggattgcctgagctcaggagttcgagaccagccttgtcaacatggtgaaaccctgtttctactaaaaaaaaaaaaaagaaaaatagccggatgtggtggcatgtgcctgtagtcccagctacttgggaggctgaggcagaagaatcgtttgaacccaggaggcagaggttgcagtgagccgagattgtgccactgcactccagcctgggcaacagagcgagactctgtctcaagaaaaaaaaaaaaaattgctcatccgcatgtgttgacttacacctgtaatcccagcatcatgggaggctgaggcaggcatttgaggtcaggagtttgagaccagcttggccaatatggtgagaccccgtctctactaaaaatacaaaaattagctgggcatggtggtgcgtggctgtaatccaagctactcaggaggctgaggtgggagaattgcttcaacccaggaggtggaggttgcagtgagccgagatcatgccactgcactccagcctgggtgacagagtgagactccatctcaaaaaaaaaaaaaaaaaaaaaaaaaaaattgctcttttgatgctgtcccatggatcccataggctttcttcattccctttcattcttttttttttcttttttccacctctgacagtatattttcaaacaacttgtcttattgtgttcttttggtggtatgtcaccttgtttttatatgttacctgttgccttaggttgatatctgcacattttgaagaagtaaggacttattctatttgctgcagagtggctttaccagtcagcccatctggagattctgggcaggttgtctggagtggtccatagatgggcttgctgctggagtctttgggcaggctgacctggtgcctgggtcaggttagcaggcctggtgtaagtcctcagggctgggcctggatcctggatccactgtggtagacttattaattgggtcaattagggcaggcctggagcctgtatctgtggggatgaacctggagcctgtatccatgacagccagtctaagactgggtccatagaggttgacctggtgctggtgtgggccttgagcctgaatcttctgggaccagccaggtgctgggatgggtctgatacctgggtccacagcgttgtgactgaagcctgagctcatggaagatgggtctgtgtcctggtccacagcaactgacctggtgctgggacaggcctgaagcctgagtctgtggaggcagacctgggtcctaggcccacaggggctggcctggcactgggatctacttgggtgggtcttgaccttgggtcaactggagtctggtgtcatcaggactggcctggatcctggggctagccagtgatgaagcaggcatggagcctgggtctataagggctggtatagagcctgcgatcatgggtactggctggcacctagggctacggggactggcctgaagcctgggtccactggggttggcttggagattgggtgtataggtgctggcttggaaactaggtctgtgaggggtgacctggatccttaggccatgggggccatcatggaacctgggtccacagaggtggtcctgaagcctgggtccacggggactggtccaaccagcactgggatctactgagaatggcctaaaccttgggtctgctggagcttggggccacagagattgacctgaaggataggacaaagggactggcttggcactgggcatgcccagattctgtgtccatgggtgtcagcctggtgcctaaggctacatgtgtcaacctggttctggggtagtcctgaagcctgaggccacaggagctggctggtgctagacgggtctagagtctgtatccacggtggccagcctgaaggctgaattgaacggtgctatcctgatggctaagactgcaggggtggtttggatactgtgtctgctggggctggcctgacctggcccttcagggtgggcctgaagcccaggaccactagggccagtccaatagtgggacaggcctggagcctggggctgtgacgtcttgactggtgcagggcgggtttggagactcagtctgtaggtactggcctggagtctggtcccatgggggcctgaccagtgctcagttttattgggtacagtcctggtgttgagggtctgaagcaaagtctggtgttcacttccctctccttcccccaagtgcagggtatctctttcaatgctatgctgcctagggttggaggagtggtataaaactgttcttccttccatattgaagaggttcaatgtgtcttatttctgtgctctacctaggtgctataatatttcacctggcttccttagctcttgtgaaggtattttcacacataattgttgtggttcaaatggatgtttccacagggagacaagctctggaaagtcctattctgccatcttgctgctatactcccagccttcttttttggctaattttaaagacaaatagtcattacattgatgtgtagtggttaaagtgatcattagcaaaaaagtcatgtttcctaaagggaatctgagccgctaactaataatcaaaacacctttaagaccagctgtgggtaattagcacatttgcaccagtgattttctactctggtttgagacagtccaattcagcaaataattttttagtgtacgttaggtatggatgtttactgcttgcaagaacataggaaaagtatatcaagtccctaccctcaaggagcttatattctaggaagggaaataatgacaagtttacaaatgactataaatacctgtaggtaacaccatatatactacatgcataaaaggatacagataacatgttaatgatttttagaagcagaaaagaaaacattcacttaggataattcaagaaaagcgtcaagaaagagttggtggtctttgagataaactttgaaagacagcttgagttttgtttaatggagatgttggggaaggtaattataagtgttgaagaaatccaatcatacacttacatactcagttcctctttcactcatcaaacttttattgagtacctactgtgtctgaggagtatagagattaccaaaaacaaagtctctgcacatcagatttcagtcactttcaactcaaatgtttctcctcctcatggagaaggaggaaaaaaagacaaacagatgaactgcaatgtaatatgctcagtatttcatataagtgcttaattaaatgctgtatgtattagtcatagttctccagagaaacagaacctatactaataggatatatatgtatatacatacacacaaaaaaaatatacacacatatatacatacataaacatgtatgtatatatacacgtgtgtgcgtgtgtgtgtagatatacacaaagatatatatacacacacatattatatatatacgtatatatgtatatatacatatatacgtatatatatgtgtgtgtgtatatatatatatatatatatatatatatagaaagagagaaagagagtgagagagagagagagaaagaaacagacagattgattttaagtaactggctcaggtaattatggatgctgggaagtccaaaatctgtagggtaggctgctggcagggtggagacccagggaagagctgaggttgcagttcaagcctgaaggcagtctgctggcagaatttttgttgttgttgttcagggaaggccagtcttttctctatcaaggtcttcaactgattggatgaagcccatccacattatggagggtaatctgctttactcaaagtctattaatttaaatatcaatctcatctaaagaatatcttcatagaaatatctagaataatgtttgaccaactatctgggtaacatggcctagccaagttgacacatacaattaaccatcatactatataagaaaaatggaacaaatttggtctcagcctccatccatcagattaatcagagtagctgatggagtggcatactcagtgtaaatctgagttcagccaagaacatgtagggctgagggatggattgttgggagaagtagttgactaccaaccgtgattatctctgcatgttcttgatgagtgtgccagactgcaagacttatgtcttctgataaaaagtagtttctgcagctacttacacaggcaactaagttgtcaaaatgaccacagcatgactaccatataattgcccacccctgcggggaggaatactggcttgtttgctgcttccacaatgtttgctgatagcctaaaaagtgctaggcttttggcctgaactcctcagctgcagcttagacccactgcatgtgtagcataaatttgggcccactgcgttgttcctgtgggactcggtggccagggaaactgatgcaaatatgctaatgatgcttgctgagtagataaagtcttctgtttctgacctagaagacttgggcttgaagcagcaaaggcaaacttgttagcttgcaaatagggtaactctcaggcccttcacagttcttgacagctacagtgacgaggacgggatgccaacagtgacatgactttctgaaagaggaaggacagaggctttgcaggtcgggttggggatataagtattcccaggagctgatagtaagtgctctcaccaaagtagtgagtgatgctgaggagtaagggttccccagtgtcctatttttaatgaacaaaagtagaactaattatttggaagcaaacagtgataggattgaaacaagccaccaaaatggtaccttggcttttggtcactttcccaaggagggtgagggaaaggatgtttattttgacaatgggatagcaagccctgtgatcctaacccaaatgcaatgtggttgtgcttactgaaagctgaaatagatgatgtcagtaattatgaacttaccacctgacatggggctttggaagggctgaaaacattggaaattcatttgattgagctgtgagcagctgtcacaccactcaaaactgaaagtagtaactaaaccagtcttgaaaaagaacatattcatttttgcagttactcacactttccaatttcaaagtttaatacaaaactacagtaatcaagagattatggtattggccataatctcttgattactgtacatatacatatatgtataaaggtagacataaagatctatggaataaaattgaaagtccagaaataaacccttacatatgtggtcacttaattttcaataaaagtgccaagatgattaaatgggaaaagaatagtcttttcaacaaatggtattgggacaactgtatctacatgcaaaagaatgatgttgaatctctacctcatatcatgtacaaaaattaactcaaatggaccaaagacctaaagataggagagctacaactatacaaattcttagaagaaaaaataggagtagatctttgtggccttgaattgaacaccaaaagtacaaatgaccaaaaaatagataaattagagttcatcaaaattaaaaccttttgtgcttaaaaggacaccatcaagaaaataaaaagacaacacacagattattggacttctggtttccacttccatatatgaggagtttagaagtcaccattccttctgaacaataaataaaaagctgaacagtctgaaaaatcaacaatttttcttggatccattagagaggtgaggacacagggcaaaccactgcccccaaaattggagagacagacagacaaatacagggagtcatggcatactgcagcagacaacctgaactgtgactgtgctggaggctcagtgtggacaagtttgagagtttgcaactcccggaggactcagtcattgggaaaacccccatatttttgtgagttttacctccaggagctcaaccaggatctcacagcaaatactgggcaaaaattcttcatgctttcagtaggggtaaggggaaaggaactattttgaaatacgccagagcactctgtttttttgtttttttttttgacagagtcttgctctgtcgccaggctggagtacagtggcttgatcttggcttagtgcaacctccgcctcccaggttcaagcaattctcctgccacagcctcccgagtagctgggactacaggcacacaccaccatgccaggctaattttttgtattttagtagtaacggggtttcaccatgttgggcaggatggtctctatctcctgacctcgtgatctgcccaccttggcctcccaaagtgctgggattacaggtgtgagccaccgtgcctggcctctgttcttagcaagttctgccctcaggagaaactagttaaccatagcctaataataccctgttggggtattatcagagcctaactgacctaagtgaaaggaaatacccaactccagtcagctctagccttccatgcaggagaagggaaataccaactccagcccactctagccatcctgttccaccaaaagagggaagaaaaatactgaaaaacacttgtgaagttcacagtccaaaggcacaggctcacaaaaagtctgagacctaatcataggactataggatgcttcctctccccccataccttaccaccgtattactaaaggcttatttacaattgttctttttacctgatacatcacagctatccagataaattacaaggcacacttaaagggaaaaaacacagtttgaagaaacagagcaaacattagacatggcagggatgctgaaattatctgaacaggaattaaaaacagctattattaatatgctaaaggctctaatggacaaagcaaatagtatgcaaaagcagatgagcaatgcaagcagagagatggatatcctaagaaagaactaaaaaaaaaaaatgctagagatcagaaatactataacacaaatgaagaatgcccttgataagattattagtagactggacatggctgaggaaataatctctgaatttgaggatatatcaatagaaatctcccaaattgaacagcaaagtgaataaagactgattaaaacagggcagcatatcagaggactgtgggacaactacaaaaggtgtaacaaactagaaggagaagaaagagaaaggaatcgaagaaataattgaaacaataatgactgagaatttagtagtagatggaccccaacaattctaataacaaaagacagtcgtaagtactataacagggctacaggagccttgaagaaaaaagctttatttcctgaatggtttcaaagggaagcagtgcagttttattttaaaagattttattaatttaggttcagctgggaggtccatctgaagatagtggtatggaaataacatattgaaatgaatcagaaaacttcagagctgaagggaaactcagattgtccaattcaacctctacattagagacagacccagagcgcccagtgccctacaatgagtgagttggtgtcagaatgtggaatcagatccagaactcctggtcttccagtaggtgagccttctatcccaaggccttcctgccttcctgctgtcacttcattatggtgccctggggtaaggagccttctcaggaacatgtattatttgggtaactaatattacaaatatctgccaatgacgtcttgttgcacagtctttccaagtcttccctttagctcctcccttccagccagtagtaatatctcctacctcagacatctaaaaaatctattgtctactgatcatttggatcctttcctccctgtcttattttcacaaatatttatcaagtacttcctatgcaaggcaccttatgttaggctctggggataatgagtgaacaagacagaatttaacatacacatccatcatctattaactctctccaaggctttatgccacccaacacagattgtaaacatggagagaaggaatctaacattattttttatgttctacagaaactaaaacagtgctttgttttagtgtatgtcataaggttctcgaacaaagatattaaaaagaattatcagtgaaatttgtaaagatactaaaaaacggaatagtataataaaccaccaaatgttctgccattctcgtttcaaagtctgatgacaggtgacagagagtgtaaatggggatggttgggccagtgacagggaaactctaggcaccaagttcagtcggggatcccagataaagggccaggcagtgagatacaccactattatttgtatgaagggcaataaacaggaagcaatgaagtttgccaagtgctggtggcaagggcaggatagagcatcaggtgcagggagcttgagctaaactttgctgagcagtgctgcctgcctctgtgcctggcagtgggtggaccatacctcaggttggtcttagggacactgtgtgacctctgatgtgtgactgagcgtctttcccccactgcagcctttgcagatgctgttcctgttgagcgatgctctgctcttccaccagcctctctaatggctgcctcttcagtgaagacctccttagccacactttctaaagaagcctcccctcctcattattcaacttagcaactgcttcctacacagcattcagaattttgtaattaattgttagtttacttgtttatttttagtctccccttctagactgtaacctccagtgaggacagggatcttgtctttccccttcacctccatttcatcagaatctacaagtgtctggcacatactaggtactcaataaatagttgtcaaatgaatgaatgatagacagtactaaatattttgttaatatctcaaaaattgaagcaagagttgagtacagaggagtagagaaaaataaaaaggtagttaatttaattagggcaatgtaaacctctaatacagttctcaattctggcttcacgttgaatcacttggactttaaaaaaatatcaacacctgggatcctctacggatcaacttgaacaggaatctctggggttggtgcctaagcacaggtatttttaagaagctcccgaggtgactataatgttcagccaggcttgagaaccactgctctaacaaagaaaggctataaggattgtgacaacaagacgagggtgaattttagaatagaaggcaggtcttctgccgtcaaatttagggtaaataaaaatggtgtgttctattgaatcctttcaatgcttaaaaccaaatcaaggatgaaataagcagagattgataataattgaaagttagtaagtgaggtatctaatgactgacagatttttttaaaaaaatgttatagtgtagtacatttaaataagaattaaaaagcagaatttatttttatttgttctattttttaataaagacttttgcttttatttaaacaagcacaaaaccataattgagttagaaaaaaacataacgtattatcttggttctatcagcggcttattttttggttcctacaggtcacaaccagacatcgttgtgcccttaatgtttgccaatatagtctttaagatgaaatattcttaaatttgtcatatcgtggcattcacaaaagtgccttccaacctagcaaaggacatttctttttttcctcttcctgctttcctttctttttctttctccctccctccctccctccctctctccctccctccctccctctctccctccctctctttcttctcaggtcatttttagataattgtttagtgttttcagtgagctgatgaggttaggtgagtgcagttcttctcattccagagctgaccttgctcctcgctgtctgcacgttgcttcaaggatggcaaatcatgttcctaaactcaagtgcagcaagactataattgcttcttctccctaatttatttaggaggccacacaatttgctgtagctgtaatccctcagtattgcaatctgggaacaatataaatggctgatggcagagtgggattttcaattgttgcttctcagtgattcacataatgtgctgtcattagcactttgatgtcacatatcatggtttccagggcttattgggccatttataaataccaaatgaaggtgctggggctagtattgcagcctggttactgccttaattgccttcactgggaaagcttgccagcatcttctccggagggaaataaaatgtaatttttagtttgtctttaacctttgcagtcaattcctctcaagtgaaggaatcatagttttccttttttgttcttctcgttttctagttaagttgctagaaaattataaaaagttaaattacttttaccaaaaaatctacttttcatcctttagtcatcattgcttgaattgatttccagatatctaaatatcaaatgtatgtcaactacatatcaaatgtatattaggtatcaaatgcatcaaatatatatcaaatacatatcaaatatatatttgataacaaatgtttattatcttaccacagttatattcaggttattaatgataattattgtgacttatagaattttaacaaagtgactttataaataataatagtgattaacatttattgagtatttactatgtggtaaaagatacatattcattggctcgtttaatctttccaacaaccctctgaggtagacactattattgtctccattttatgagaggaaattgatatttattgatgcttataaatccaaggacatatagctagtaagtggtagagctggttttgaaactcaggtcagtcagattccaaagccaatacttttaagcagtacattcaaatacttccctgtctctaacaccagcacagttagccccatttcacagaggaagaaatgaagactcatgtaactagaaaattgtggtgtgcattttgagcttgcaccttctgattttaggtctagagcgctttctgtttcccaagggggcttgcatcggcgtgagctgttgcaactgctagtgttgttgccgacatcctgtgcacaccgctcaggctgataaataagcaagggagaactcctagtagaaaatcagaggaacgtctacgtgaaagcattaggggcaaaagaactgccttcctgtcagatagtgcagagcacaggctctgatttgagcagccagggtttaaagacacagaggagaaaagaagcaagtcatgttccctgggcatgcagcccaggcacttcggccactgacgtggagccagcctgagtctcagtgattgatcctgcagccaaggatgcccttctctcagcagccgcaggttcccacaaaggaaggctgcacatggtgaaatctttgtcagggcccctaatgggagcattgggtttcacatcacagctacccctaaacaggtacactctgcttctttcatcttcctgatggctcccacgggaaagaaaagaaagagaaaggcggcttcaccaagaaacaggtcacaggctggtttggctgggttttgtgcctcccccgccctaccacctccaggtctgtagctttgaaattctttaattttcatacaccctgtgtggccactggacagcaatgggaaaagttttcttaatttttcctaatccatctaacatgattcactggaaaattaatgcctctgtactttaaatatactactgcttctgtttggaagctcctccccagaccccaaactcttcttcctatggctaactggccctttttaaagattcagctcaggcattgtttcctccagaaagccttccttgatgccccatgcctgtcctccacccagtatgacttctgtactcctcttctaatacactatagggcttctgttacagtccctgctaacttgtctatctccctatctctactgtaagctccttgagggcaggacagtatctctagtgtctagcatagtatctagcacatagcatgaatgcaataagtgtttacgaataagtgaaacatgaataataagtgaacatttgcatagttatttaaacacaatccttttgaaatactcttttttctttgaaaaataggccttctttaagatcttaaaagcaataatgctgattgcagcaattttccatacaaaaaattcacgtaagaaaataaaaactgcctgtaatcttaccacccaaagaaaaccacttttaacatttagatgtagtccccttctgtaattttctacatgtatgtatatataccaaatcagaatcctatttttatacctaatttgctcaaagattgtaacagtaacttctggaggtagaggtggcatttttattccaatttaagtgatgggaaaactggaataccaagatacacatctaattaatggcagagctaggactagaactcatgaatcttaccatagttccaggctcctgctgtttcctatgatgccttctaattaggtggtgttcttcttcttcttcttttttttttttttttttttgagacagagtctcactctgtcgcccaggctggagtgcagtggcacgatctcagctcactgcaacctccacctccaagattcaagtgattctcctgcctcagcctctcgagcagctaggactacaggtgcccgccaccatgcctggctagttttttgtatttttactagagacggggtttcactatgttagccaggatggtctcaatcccctgacctcgtgatccgcccgccttggcctcctaaagtgctgggattacaggcgtgagccattgtgcctggcctcaggtggtgttcttgtatcaatccagcatcaatggaacatgggtttgtaactgggtgtccttgctctacacagggagagatttaagccctgtgtccacaccatagcttggcagtgcatactcggcattgtctctaacactttggagggaaacaaggatggagcatctaggatcttgtcctaggatcttgtgataggctcatcaactgtgctaggcaggcaccagtaagagttagagtttccttctgatggtcaaatgacatctgaacagcgatggcttggctcagagcatgttgctatgggaactgcaaccacaggttcaatctcaccatagactagtgaattgtactccaatccatgaccaatgactatactccagaacaatgtgcacagcaggcactcaataagtgtgcactgggctgaaatgaatgtatatgattcatcagggaaagtaggcaaaaaagcatgctggcagtaaatttccataccactgtgcccactgtggaaaaggcaatccaatgtgatctagctttttattttattccaaatagaggactaaattgtagtcccacaaacacatatcagattattagttccatagatgaatttatgtgcatgtccctagaatgtcaagcatgaagccagacacaaccgaggtgtccatgctttttgaattgaattgtgtgaagacagcctggtgtgggagttaagaagatgtcgactagtaattcaccattcctttccctgaaagctctgtaaatcaagctcttaaaaaaagcagcaagctaaattccaaaaccctctctgaggagaaatgcccatgactggtggggtctggactatgtccaccaaatgtgcagatctcttctgcacaaacatcgcctactcccaagggagcccgtgactgactgaccagctgtggagactcacacgtccccattttcccagtgttggggggggccaggggaagggagtgggagtcgagtgatgaagcatggctgaactaaatattctcctcccaggagaaggaaaatgtcatagcaggaggtgggtggcacttttctggaggaataaccatgaagaacatggggtatatttgaaaatgatcttttctaaggacaagtttctcttctaaagagctatcctcatattctctcttaccttagattggggctgttgaaatggtcctgccagagctaggctagaatgccacaaactgggattaaagttgactgggcagggggaggggtaaaatgggatatgggttgaagagccataaggccaggatgttcacttttctcaatttattcaaaagcactagttttgggaggcaaaatgcaactcactaatcccctaagcgcttaacaaactctcttgaagatttaatcacaatgtaaaatccacaagtttttattggcagtgtttagttatcaattgcacaactctctgaagtggcaaccagtacgattcccaggtctgtctccattacacattccaggggcctgctggcaatgtgtgtcagattggtgttctggtctagccttgtaaattccttccaggggagacttaggacacactctcccagctgccaagttctctacttataaggtgcagaatttattagtgcaaagaaagataaaaagaaagcctgctacctttttaagtgcttttacatacagtttctttattacagcttggtgtttccagaaatacagctgcccagatcatttgagtctttgtgctgaatcagtggaacttgttttctcttcctatgaacttctatgagctctgctccaccatgtatcaactgaggtcttttgtgccatgcttttaaagaaagtcactgacagcaactcttatttgaggaggacaaagccatgaggactgacatccttaacttacacatggccatgcaaaggtccaaagagggttgatatggaatccaagtttgtccaactctggaaatgaagcctgtctagtcacccaaagaccatctttttccagcctgttttcttctctccaatttctcaacatgcctgttttcatttccagagtcaattctaaggcaatgttggcctcagacacagaaaagacatcaaagaggctaccataagaaacagtgtagtccagtgaaaagaaaacacaatttagaactggaaaactctgagttccagttttcttactactcgtctgaccttggataagtcactcaataatgtcacagaaccttagtttctctttagcaaaattagtataaatagtcatattcatctcaccaggttctttttagagcaattatgacaaattgcaattctctgatttatgtttatttattttccatttctcagtacagttcactacattgtaaactccaagagttcagcaaccttgtctttttggttccccacagtggcctattgccaggaatagcaatcagcacatagtacatgatcaagaagagtgaatgaaatttgaatgagtgatgaaaggaataaaggaaaaaaggaaagaaaggaaaaagaaggacagagggaagtgttcagagcattgtagatgccatttatgaaagtgaactgtacattgttaagtattatctgcatcttttataactaacatttaatgcgtgaattatgccaaggtgatctgtttaaaatgtaagttagatcaggttacttccctaattaggccttccagtggcttttcatactatctacaggtcaactcctttcagcttacaaagccctaggtgatatgactcctgcctacctcatttccaacctctcccccttcctcatcatgccccggtcaccctagtgttcttgtgtttccgcaaacgtgccaagtttgttcctgcctcggagcttttgtgttagtttcttcccaggcctggaaagttcttttgtgaaatctgcatagctggctctttactgtcattggctcttggcttacatgtcaccttctcagagaagcctttcctgcacatgtaccctgaagggcccaagcagtgctctcttatttgttgattcacttatctattactagtcctctccagtgcctgatgttcaaaaaatatttatttctgtgtgccattatatttgtttagtgcttacatttcatagatacttttctaattattttatttctgcaaaaacaaaacaaaacaatcctctatggttccatgctgaaaactctcttttacccctctccaccccagtctcccacacatgtatcttgggagaggtacactagtccggcaaatgtaagcaattatgctagttagttttactctttgtgatttaattgtacttttggagtcatgtacaccaagtgatacaacaattacttggttgtaattgagacgtggaactggtgctgtgggtgctgagctgttctctgctctgggcttggaagcttcctggcttagggcttggggaatggagggagtggtagaaataggcagagagaggcaagtggtaggaatgctcactggttccagtttgggtttgtttattgtgggccccagggcaacaaatagttctgtagaaagagcactgaaccaaggcacaggaacaggttctagggctagccctacatgtcccacctccttgcccctcccctagctagcagtccctcagttaaatgaggtggaattggatcatctcaaggagggatcccagctctgaaattctatgacttgatgagagcagtctgatcttttgtcatgaccatgacttctgtgataaaggataacccgtgtaatatttctgataagcgtagcttttctggtccatggaatttctctgattggccaataaggtgactagacaaacccatatttctgcttttgccattctagtttatttttctctttccttttctttcctagataagttgacgctcttggtaaatcccctcattgtcacacggggctcatcatctaactgtaattgcacttcagccactcctcaagagatgggttcctagtgtgtctgatcttggataacactcccccatctgctttcaacatgttgcatttgatgttaactaatgtctcctattagcattaaaataaaacaatctggaaaaattcactctcaagcagagttcaaacaggccacaagtagatggggaatctcaactgcacaaggattgttttgttttttttttttttgagacggagtctcgctcagtcgcccaggctggagtgcagtggcaccatctcggctcactgcaagctctgcctctcgggttcatgccattctcctgcttcagcctcccaagtagctgggaccacaggtgcccgccatcacacacagctaattttttgtatttttagtggagacggggtttcaccatgttagccaggatgggctcgatctcctgacctcgtgatccacccgccttggcctcccaaagtgctgagattacaggcgtgagccaccgtgcccggcctggattgttaaaacaatagtaataaatatacaaatatatataaatgaatatatgtatattgcatactgcacatacatatgtatgtgtatatataaaagtgagtgaacagatgtgtgtgtgtgtgtgtgtgtgtgttgaagccaaaagtctgtaaaacggatcaagggaacaaagacaggaatgtttctgttcaatgaatgaaattaactggtaacagcaagaggaaaaatattctcctagtatggaacaaggcatgatcaaaagaactgaatgacatggaaaagggattgggaatctttatcccacacttactggtaatgggttaaaattctggtccacgaggtgattgtatccatggtcaaaaaatgagtgccgtatcacgacatcaatgccctgattggccagcattcctaaagtgttcaaccatctaaaaggcagagaaaaagagctacatcaatatattttttaaatggcatataacaagctctatagagactggctactatatacacatatacaccaatctccagtcaccaaatttacctagtactttaaaaagggttattttaagcattaagttcacagctgtaatatattttagagattatcaaatccaacctcttcatttgatagaaaaagaaacagaggtctagaggagtaaaatgaactgcccttgatcattaaatagtttgttgtgaatgacttaactttttattcctgaaatactaacaaatgaacaccctagccatttgtaagcctaatatccctcctggccagaggacatacaattacagaagagcgcacattgtgcattccatccctcaaactcccctgcttataccctgtccctgaatatgtacctttaacagaactctaactcatatactcctatgacctatgcaaatatagtctagtcattagcaaccctcatatatcactgtcagtagtcaatgcaataataattttccttggcactataagtaactattcagggattcaagtatgccaccatcacacatattttgcagtggaggacctgcactgttcacatacttatcatctatcctactatgccaaacacctattttccagggcatgccatccttcaaaaatactgccctcttagttcttccaacactgctaactctgccttcattatttacacattcatgcattcatttgggcttctctttctcttcctaattctgaaacttagggaaacttctacttgtaataatacatagaataaatgtgacttagagattcagtcttctctatatgaaagataaggcatttcacaacttgtcctaaacatgtgtgtgtccagctttatctgtcacctcttccccatcttctctcaccctagaccccatttcccacaggctccaagacacatgaaactactcttggctacccaaatacacattgctttctcacacttacccaagtccttatacatgttttaacttctgcttagaattcccttctactcttctttgaacctaccccttttcatctggcagatttcttctcatatattaatctccaaatcacgtgtcattttattctaaactctgctgccccagccaacagtggtaccttcctctgtacttccccagatctcttattcataccctcagaaagtccacagaaagaatcacttaacttatttctccacctttcctctgtcagttctgagttcatcaagcatagacacaatgtctgaacttgtaccgcaaacacccatcaccattcctggcacaccgtaggtactcaatactctgttgacttgaaatctgtctggataaaattagattctcggaactttgagaatcaccattcagcacactggggaaaattacgcatagttatgatttcctaaatctgaagccatatggagctccaaacccgtgacttgaagaattaagttttttccttgctggaataaagagcactgctaatttttatattgtgaataaatattattcctatatttaaatgttttttacatttacaattatattttattctcaaaaaaactaacaaatatttactgacaattagagttataaaaataaaacaaaacaaaaagcaaagcaaaacacaaaagttttaaatcaaaagggaaatctgactgtaatatagtagaatcatttttgttgttgttcttcaaattggaacattgtgacccagggaattgaaattacttttggaacatgacatggctaagcaagctacttgccttcataatttttattaatttggtaatcctataaaatcaagataacaggtttagcttttcctttagccactgagacatactatgaaataccttgtcaaaggctgtcctgtggtagaactataacatgaattgtgggctaacgcctcctaagtagtgttctttctgtattgaaatggcacaaatacaatagggtctatatctaacaagtattttaaaagcaaattgtcttattcaactttccatccctatgcttgtcaaacgaaggaagaaacaaaacaatgaagaaacacataatcacatatgtgagtccctccatctagcagcatcttcatgtcaatacagggctctatcttggtgtttttatatgtgaaaagatcctacttgtttactcattcattatttattcaataacattagtcaatgctaaatgctaggcattgttttcagaattgagaagatattaaaaaacgcttgtgtgaccatgtaaatgcctgtgtatacatatttaaaagaatcatatcaaatgtctacttttgacctctacagagcttagcttagtgacctgcatagagtatatactcaacaaataaatatcaattcataaacctgatgtttttactagtgtataggaagatatttaagaaattaagaatatgcattctccctgcaaacctacatccctatatgcatatgcaagatctggagcattcaaaaatggctagaaccagaactactgctttcccatggctttaggaatagaatggttaacatgaaagttatcttcatcttcctcctataataacaagacccctcagagagggaaagcaatggtcttcccattctatgcttagctacagacagttgataaaatgactggtatatctaaccaaagatgctaccctgccattattttccactccactaaaggtgaatatctactatgtaccagacactattaggtgcttgagacacagcagcataccaagagtatttgtggtccaccaaagaatctcaaagccctagctgggaaactctacttttgaacactcggtagcagagaatcccaatttatgcatacgtgcatgtatatgtcctggtgaactcagagttacgtgatatataaacatttcaaaaaggctggaaaaatgccgtcttttcaatttcttaatagcctcctacagcttcctagaatgctttactgctcccctactcccccccgccacgacaggaagcaatttatgccccttggagaactgaactcaaagggcacattgctgggtgctgtcagtggagttgagaccaaatgggtgacaaagaggtaagagagatggggagcagaataaactagttttcatcagatctgtgtcaactaagcattggatatctgaattacagccagaatataaacaactatgttgatctgtgttctgcaaagtgactgtaggaatctatggctatttggctgatgctcatgaaaaggcagttctcttttccaacttcctccatgaaggtctgcagtatttctcatttcatatcattccctaaagggaagaatgctcacaaaaccactcagtacaactgggctgcttgctgggccctgcagcagcgtcctatagtgagtgctgagcaaatgccattcctctgctgattccaagggggtccctgcagcattgacaccctggcttctcactctttcaacaggtctcatatcaagccagtggagagtgggagtgtacttttgtggggttttatctggggggcatgggggagggacggagtcttgctctgttgcccaggctggaatgcggtctcagctcactgcaacctctgctacccagattcaagcaattctcccgcctcagcctcccaagtagctgggactacaggcgcatgccaccatgcccggctaagttttgtatgtttagtaaagatggggtttcaccatgttggccaggctggtctcaaactcctgacctcaagtgatctgtccactttggcctcccaaagtgctgggattacaggcgtgagccacggtgcctggctgggagtgtacttttgaaagaagattcttaaccacactatatcaaaggtgactcactccacttcatgcatttgaaccacgcttgctgacattgtctgtgctacacaacgttagatgctgaggacacagaaatggaagacccaaggtatcactgtgaattacactgaatcattttcttcatctgcgtttgccagaactccatctgtaaaggcaatccacttgactggcctgatttgtccttcattaatgtattaaagaagctgcctctatgcaggggaatggaagctgcataattaagaacagctgttagtagcaaaacacatagctgagggcaaagctatggttcttaggaggacattgctcagtcaaaaatccaaggccataggactgtactggagcaggaacaagtcatttacttagtgatcctgaggggtttgtccctgccacatgacactggcaggctaatgagaggcccttatgcttctggcttaagtcattctccagacgactgtagtagccttcaaattcattttcccattccttcccaactcttgtgactaccattgataaagtcaaagttttaaaacacaagtcagattctccagattttttttctctctctctgtctctctccttcacaatcttcagtggcttgctgtgaatatagaacaaggcctcacttcctctaccgggtttttaagaccttctgtaatttggtggtaaaccctttcctgagtctcagtcctcattgcatcctcacagataacaaggctttagtcacattagtcattctctgctcctctgtgcctttgctcataatgtcccttgggcctagaaggctctcctctgtcatcaccatgactcccacctatagaaattagagtaatcctactatgcttcactcaaatgccacttcctccatgaagtcctccctgatactcccagtcacagaaatacttcattcctttgcatgtctgtcatttttcttttgtagacagaccatgtgaggaagaaaggcaggtggtctactgcagtggtaaagaagctgtactctggagcaaactgcctgggtttgagtccaagctgtgccactaactaaatgagtgatcttgaataagttacttcacctctttcagttttctcatccgtaaatgggataataacagcatctatttcactaaattgttataaaagcagtagcatcgatttcattggttgttaaattatgaaatataaataaagcacttcagacagcggtaagcaccgtatcattaaaagtatgattactacagcacttacctcctacagctttacaatgtagttatctcctatcccagttccatcaatcatatttttttctggagggaaaaaaccatgccttattgttacctatctcccaagactatagtgaaaattggcttagaaaatgtatgttgtttacactgtgttttgaactttagacattcaataaagctgttattactataattattactgttactactattactataatctttgctctgatgcctgtgcctgacattttaatatctagagaaggtgttgatcattgttgaatggtttaagacacacatgaatgaatgaaatgaactttcaacgggaaacatgcctcacccctaggatgggcagaataatcagcaacaccagagattcactgtccttccctcctgaaagcccctgggggtgaacttgcaggtgttactcacaagaatcctgcagcataggaatcggatagattgtttgtgcctccagctgaggtggtcaccacaccttcaagccaaatcttctttcctggagtgtatgtattaaccacctgtttacacaacaaaagcagaaggggataacgaggttttaaaagctattcccacatgagaagaaacacacattcccttaaggaagttgatctgatttcctgttttcagggggtcatgatttgtgctttcttatgatgatgcacccagttcagtgagttggcattcacaaaccaaaatgcattaacattgacacatatccacttaaagaaattatcatttttccctaagtaaacccaagtgataatgtgacagaacaagtgcatactctaggatgtaaactgactgcagtactttccactaaaaaatataaatcatattgtgtttccatatcaacaagcattgagaaacaatgcttttcagtctctcttatagcacatctatgacacacgtactccctaaaagccatgaatgcaacacaagcatcaaaagccacaaatcacaagaaggtagagagaatgctcgtgggagatttattttataattactagtccaggtatattgtaatcacactttgaaaataactgcagtaagggtaaaaagaaaagtcactggcccacaaatgacgcatcccacacagggaataattgcatgccttccaagcagaagcaaaacttcctgtcgaaaggtggcacactgaagatttgaaatggcctagtctctgacccacaagatgaagactgaccaaactattcagatcagtgtgcagatgcttggggctgcaatcggcacttaggagtaagattgtatactgggtagcccctaaaagcagaacctgagtcaaaggcttgtttataggtagttcactcaagaaataataccaaggagcaggaatgagggactgggggactgaaatagggaagaagggaaaactaagacaaggatgcattttcaaattgacaaccattgctggcaaaaactcagtctcacagggatcttggtaagagccttacagactgtgtctcagaactgacccccaaggggatacaagggaaagcatgagtagccttgtgaccattaaccccttgcccctctatccctatttcatgtgcaggcctgagtgctgagcagattctctgagtgttcctcatctctgcctcagagaaggaaataagaagtgaggtactacgtagtacactgacacctagctggctgcagcctgcatgctggcccagccctgatctctacaatgatggctagagtaggaggtgggactgggaggatgccagctatgcactaatgaggctggataaagaaaatagtgtatttaggtcctatggccccccagctactctcctagacatacacaccaaagaaattcttcttcaggtctctaaagaggtaagaatgagaattctttctatgtcactgtagcagatgtccactgctagaagaatggaaaaataaaatgtggatatacactatacaatattatgcagcagttaaaacaataaagtcaatgtaaatccaacatcatgaatagtctttaaaggtttagtgttaaattaaaaaaaaacacactgagtgagatttatggcacaatattacttataaaattgctcattcacacctaataacactaaataccctataatgacacatgcctcttaagaacatatatcaaacacataaggaaagattatataagagagaggtgaaaattaaaacaaaaacaagacctttcatgaactgatgataatagtttgctgttagtttaggagtattacgttaatttaattctctgcacctgagggccttcaaaaagaaaaaatatatgtgccaaacccatgggtacatagacatcaacaatcaatcatattcctcttttcatttctagtgaggtacagctccctgtcctctctccccacatttgctagagaatttgcattatttggaacatattttgggttggcaaagttactgacccttttcagaaacaaagttgtaagaaaattacacaaatttgagattaaagtgagtattatgatcataaatggaagaaaaatcctgagaattaacggtggtggtcaatagcatgttggtaaagattaagtaaaaattcacttttatacacaaaaaaagaagagtcgtttgaggataccactaggtagtcctctcacccctttcaatactgttcatgcccaactcaagggaagcagggaattgtaggaacaagaaagtaagaaaaatgccttaaataatcaaaagacacatccatatggccagattaaaggactacatctatgatttcccttaaaatatagtgctaaaaaaatctgtgtacatgataaactatgcacttcctttataagtaaccagagcagagtaatatatttgtgtttttctttttttttgtctttggcttacaggatatttaatgtttaattttgtgctctaagatagatttaaaggcagttagagaaaggagctttggttaaacaaaacaaaaaggtaaatactttaacataaatgaaccttgaaaacattaagctaagtgaaagaagccagacacagaaggccgcatatgatatggttctatttatatgaaatgttcggaataggcaaattcatagagacaataagtagactaatggtttcctagggttgaagaagaagaggaagtttaagatgggagggggaaaggagagtgattgctaatcagtatgaggtttcttttggaggagatgaacatgttctaaaattagattgtggagatgatttcaaaattctgtgactatattaaaaaccactgaatttcatactttcaaagggtgaattttatgctatgtgaattatatctcagtaaataaatacgtgtaaaagaacacattaacaaaaggagaggtatagtctaagtaggcaaataaccataatgtggaaacaagaatgtaccctggaaattctgggttatgctacatgctagttgtgacacttgtagcagttattatcttggacttcaatatcttcatccacatttaaagtcatgaatttgtagtagatgaactctaagttctttttaaatataaatgttaaaatgtgttagtattttataatgctaatgtagatttccttggttatcacccaaaggtctagagtatctttgattctgaaatttaaaacaacaagtatgggaaatgaaaaaaaaagtcaaacacagctcagagttggtcatctcagaaacaaagatctgggctggaggaaaacgctgagaaaggtagaaaaatccacaggagtaaatgaaattgcctagggagaatatataaacatgaggctagaaagggctaaggatttcccatctaaaaacattaatgcattatcaagggcattaactaattcattcaacaaatatttattgagcacctactatatgccaagcagagttctagtggtgggtctatagcaatgaagcataacaagtttttgttcttgttgtcttacattttagtcaagggaaggagaataataataaacaagtaaacaaataaaagaaatttagataataataagtgatggaagaaaacaaaacagagtaacacggtagagagcaatttgacaagagggtaaggtcagtactttagatagcggtcagagggggctcatgtggaaggtggtatctgaactgagaactgagtgaagaagccagcctcttaatggatctagaagaaccgcacagaaaaaggacctcaggtggaaataggtctgctgtttttagaaccaaaagaagactatctggagtgtagaaagtaagggagtgaaatatttaaaaatgaggtcagagaagaaaggagtatttttattctgagtgtgatggaaagctattggagggatttaaccaagaaagtgatctgatctgacttatgtaaagatccctgcagctgctatgagatcatatatacataatgaaactgtatcatgatacagttatttgtatatcattttaattgtaaaatgataaaaactgtaaaatgatatacaaattaaagttttattattttataaccacttcgagcttcaatttcctcacatgtaagctggaataatacctgataggattgtgttaaggatctttccttgtcaaaggccaaagacacatacactaggccaatcacaggaagatcctgagagttagtgaaaaggagcacagaactagcagataaacatttatgtgggtccttctacggtgatgcatgaattcagaggaactagtgccaattattcttacggtttggtggtaggattctgaactaccattttcgatccaagtaagaaattcaggaaatttcctagaaaccttgaaccattagctctttgaaggcagggaatacttttattcacttttgtatttacttcctatcagaatgcctggcacagagtaagtgcttcacaggagactgtgtgtaacacaaagaagttaatgcaattccatacctgcccttgcacaagcttacagtaaactgctactccttaaggaagtcatgtgacctgataaagggcgactaaaacctgatcaaagaattggaagcaatatgctgactgcaaaaacgaccttagagatcaggaaaaacataaaatgaaaacctattacaacatgaaagatctagagaagagcaacatgcttatttgccaaatctcaggatatcaggcctggggttttctccttgatctgagaaggaaaaggaaaattgtgctttgcttagcaggtaatttatgtatggaatccaataacctcagaagtgttaaaggtcaattaccatacaaggtgatttggataccagaaggattttatgtgttatcaagctcgttataatattctgatattaagaaaagaaacaatcatgtatttccacatttatcacttgaggatgtttgctgtaagtacaataagtcttcacttaaagtcatcaataggtccttggaaacggcaactttaagcaaaagaacgtataatataaccaatgttgctataggctaaatgatactaataagaattaagttcctatgacatatttctggtcacaaaaacatcaccgaatttctaaataaagaccccaaaacttttcatactaatcactgaaataagtgtgatctatatacacatttaaaacacatgaataggccgggcgtggtggctcacacctgtaatcccagcactttgggaggccgaggtgggcggatctcaaggtcaagagatagagaccagcctggctaacacggtgaaaccccgtttctactaaaaatgcaaaaacaaaattagctgggtgtggtggcgggtgcctgtagttccagctacttgggagcctgaggcggaagaactgcgtgaacctgggaggaggagcttgcagtgagccgagatcgcaccactacactccagcctgggcgacagagcgagactccgtctcaaaaaaaaaaaagaaaaagaaaaaagaaaaaagatgaataaaaacaagtaagaaaattacttacccaatttttggtgaatcagtgagtggcggtagtcatggaggtggggggttaaatcaaggaatttgtttgcaaagcaaaaaggagcacctcctaccaccaggaagttcaaaaacaatcacaaatatgacagacttgttgtgtgctttagtgccacatcgtttattgtacatttgtataattattgtagactttacaaatttttattttacaataatttttattcattcattcatttattttccaacccgcttataccagttcagggttgagagtagccagagcctatctcagaggctcagagtgcaaggtgagaaccagccatggacaggttaccattccattgcagggccactcatacccacgcccatactcacttggacagggaccatttagacacccaagaaacctaatgcagtctacatatttgcaggagtatccggagaaaacccaaacagacagtggccccagctgggaattgattttttttccatcaatattataataaaatgatgttaaatgaaatgaaattattcaagaacctactgtacttagttggatggtggcatgcccaactcagaggggtgatttgtatgagatattatttttctttttttttttctcaagacggagtctcgctctgttgcccaggctggagtgcactggtgcaatctcggctcacttgcaagctccccctcctgggttcacgccattctcctgcttcagcctcctgagtagctgagactacaggtgcccaccaccacgcccagctaattttttgtatttttagtagagatggggtttcaccgtgttagccaggacggtctcaatctcctgacgtcgtgatccgcccacctcagcctctcaaagtgctgggattacaggcatgagccaccgcacccggccgagatgattatttttcaaaaggagttcaaactctagctcctttaagtgaggacttgattccagaaaacggttggatttataaaatactgtgtctacaagacccttcaaggacatagactctgtgtaaataaaagttacgcctgtagccctactacttgggaggctgaggtaggaggatcacttgaggccaggagtttgagaccagcctgggcaacacagctaaattccttgtctcaaaaaagaaaaacaaaaaattagccaatcatggtggcttgtgcctgtagtcccagctactcaggaggctgaggcaggaggcagtgagttttgttcacactactgcactccagcctgcatgagagtctcttaaaaaataaaaaataaaaaagttaatcagaattctcttctgacttgcagggagatttgaaaggaaacaatctaaaattgaggaacagttaggggcatggactctggagatggattgcctgcatttgaattctggttctattatttacttactgcatgactttgaatgagttgtattacctgtctgtgtttcaattttctcagctgtaaaatcagaatcatatctgccttagaggattttatgatatttaaattatataatatttataaagcagttgaagtagtgtctggcatatagtaagcacttagaggtgtaaaccaaaatattacctagaccactctccttgtccaaggcacataagcttgtgtttgaatgaataacatcagagttggttgtttttccttcagacgtaggacttgtggtgataggtaatagcccagatgcatgctaagcagcaggaaaggccagtttagaatttaaaatgcacatggataactcacacaaacataattatcattcagagtagttcatttatccattctcagcacaggggtaattcctgtcaagccacatgaacaaatatacacagtgaggaacaactttgatacaaaaactaaaccagttatatgaaatgttttttggggaaatatttctagaaattattaatgttaaaggttctaggagtagtcagtacaaaccaacaaatattttctgagtatttactgtttggggcaccgtgggaggcttatgaactctgtatcttccatgagcagagaagagcatgatggtgacatgtagtggaggtacagacactgaagctgggtgctggttgggtccaggaaggaaatcagcatgggcagaagaggagagaaaaaaattaggagaaacagatggaaccagctgcaaaattcccttagaaagtaaaactctaagaaactgagggctatagttcaacactgtggttttttgtagtaaacatgattctccctgtgctagaagagagaaacttggagtactttggaaagaaaaagggtacagttcctggtgagaaatgatgtgccaatgaaggttattttaagggatacactgtctggggagtaagacgtacaaatgctgaaattacttaagtgaaggtaaagggagctgagtggttggctgcctttcagctgttcttctgttcccaaatagacttcaatccttgggtgcatgtggtcaagggggctttcaggtaccctgaaaattgctcagtaaagggccagtggctgctctgaatccttgggcctgctagaggcagagttgtataaagggaaacccttctagctccattccttcatatttcagggctggggactatgagtactgtttcatgtggacatattgagggaggaatagggagacagaaagagaggggagactagagaaaacagcctggattttttagtttattttccctaccactttgaattaaaaaaagaaaaaagaaaaaaaaaacagtaaaaataagaaaatagcaatttatgtagcacattttcaaatttgggcttccttttcctgtgtttccttgatatcctgcctctaaaactgtgatctaagtcctttaaaaagactcttgagagcctggcttcagccactggctgtgtaagaaatggtagccttgtagcagcagacatgttgtttatggttatccaaacccaacaccttccttaatgagaaaggaagcaataaaacaggaatagcggacaggccagctgggctaatcagccctggcaggaggcccaccctccaaatgaagctggagcccattaattctagcatctcatctagttggaaatcaaccttccccagaatttcacgaagaacagtagctctttaagtaacccaaactggtcctctacagagttggttacaaagagctgaatagctacaggaagcttcttaaaccttacctacacacagagctcttcttagggacatccttgcctcttgtcagtctttgttccttattgtatttataagtggtcaaggcgagagctctgtgcccttcccatgtttctttccatccttcttttgtgttttttgactctccacttacttgctacattagagcagaggatattgactctgtcctcttcttcctcactgcccctccctgagttctggatcttgtcatttgttccttggtcttactgcctctaatcttttcctcttctagtccatccttcacactgctgctatttgttaacttgacaaatccctcttcagcttaagaaccttcagtggttccctactgccagcagtggtactcaattatttgtgctcagagaggtctgtttgatcagctgggagatgtgctacaagcaacttgtttcagatactattgaaaacagtgatttgggaataatttagttcaaaacaaaaagagtggattcaaagttgtcataacaatatttcgccaaaattctgaaatgtttccttaactggggaaaaaaagctaaggagctagtaattgcatataacccatagtctattttatctatttgtccatgggagtattttagacacgataaaataaagttgagaaccaccgaaccacaggataagatgctaactgctttatttaacttgttatcttagactttcacaaccatcccttagctacctcttcccccattgctcccctgtgggaggaagacctatggttcactacaaagaaaggactcctacttttcaactacacgaagcaatcgtttttttttttgttttttttttttttgtttttgagacagagtctcgctctgtcacccaggctggagtgcagtggcgccatcttggctcactgcaagctccgcctcccaggttcacgccattcttctgcctcagcctccccagtagctgggactacaggcgcccgccaccacgcccaactaattttttgtatttttagtagagacggtgtttcaccatgttagccaagatggtctcgatctcctgacctcatgatccgcccgccttggcctcccaaagtgctgggattacaggcgtgagccaccacgcccggccgtaatagtttttttaccgattacctttcccctgctcacttctcatccacattgttttgattttttttttcaagcctatttcaaatgttatttcctctgtgaaactttcctcaaaacttcagaaagttaattcttttatcctctgggttccaaagttctttggacctacctctgaccttgaccttattatactgaattgtaattttctattttttttcctttttgcatgccctatagaatgcttgacaattactttgcttataaaatacttataaataaatgagagagataatattttactgatgagaaagctaagtttcagagaagataactaataatctcagtatcacaagggcaaaaaccaaatcctcacagttccagtttagggctctgttcactttctaattcaatttcctgtttgaggagacccacaacttctggttggctaaactgcctccatatttaacatgtccttcttaggttagacaagctgggctattctgagctcagtcattccagtatctcatcacattcctcttgatgcatttcttctgtctaatgtacttcctgtcagtttcattaatctttttctgtataatttctttttatcattgtgttctggagtgccatctttgcccattttcttttggtatcagatcaatttttaatttgcggcttctgtttctgtgacatttttaggatttaaaattccattctctgcacttgttatctcaaaccacagaaaagcagttgaatgtaattgcaacaaaacataaaattaaaataaggacatacacaaaaaagataaagtcactggggaggcaaggacattatgatcatatgcaagaaaatgggaaagaaaagtttcacagagcccaaagcaatgactacgttcaaggataagtgctagtgagagagagattggaaagtagccacttgcacataaattactcttcgtctctttcccagtccttttctgtgactaaccaacccctacctacttacaagtcataggttccagcagcctcactgttaattttactcttgcttaggacaaaccctataatcctcccacttacatgctgaaacactggatggtcatcctaagttgccccttcctcctgaagaagctttttgccccaaacagcaatttgcttccagggccattcctccaaatgtccatgggtagcacataccttcttcacattgtcattgccttgcatatagcaggaccttactaaacactgaccaagagcctgtgcatatgaaacatatgaatggaatccagtagatcaatgcaaataaccctctaaaaagtcttgtcgtcttccactatcacttgcctaatatcatgatactcaacttcattcattcattcaacccttacttcattcatccattcagttcattcaaccctcacttccaggacacccaccctagattattaactgactgtggggtcaaattgatgttctttcaccaagaacattcattcagtattctcctttgaaagccttcctaatcctgggtggttaggaatataaatattacatgggttataaaataaatagttgataagtgtgggcaatactgaatagtgtaatggataagagtgctggttctagagtcagatgagcctcagtttgaactccaattttactacttaaaaagctctgttggcttgagcaaatcactggtttatttaatagattaataatatatattgcactcaataaatggcatttataacccaaaaggtaatataattattatatttctgtaagttaatgatgcatttttcacaattcaatgcttttgaaatcaggacattattcaaaatcaatatcaaatgaaacttgcctactgtttaccctctcccttcccagttgttattaaattaatggtgaattctctaatatttgttctaagattcaaggaaatatttgtatctaagaatcaaggaaattaaggttcatggaatgacaatgactaaaactttggtgttctttggtggtaaacatatctttcaggttagactccccaactataatatttttcatgtcttgtatatgaaggccaagagtcaaagtttcccttaggtcatattctcccatttgcagatgcacagccaagtggggtcacagaggctaatttaccgagaagttcatggagcttaaatttccagctccctgctttcacaggcatctaacaatatcctaagaagggctctgctaatgtgttcatatggtcaaatatttacataatttgcagatttccttgttttattttccttataaaggtccccattgtataaatgtcaggccccataaaactcagaacactcattgatgttatcccgaggtattaatgtggtacagtttgtatctggggtcctgtgccttctgagtacgggtgacccttaaacgacatgggtttgaactgtgcaagttcacttatacattaatttacgtcagtggaagttacactgggtgcacgtgcctctcctttctgcccttctacctcccccacctcttctgcctctgccattcctgagacagcaagaccaacgcctcctctttctcctcctcatcctactcaatgtgaagacaaagaggacaaagacctttatgatgatgatctgcttccacttaataaatagtaaatatattttctctttcttatgattttattttctttctttttattccctttttatttttggaaacagggtcttgttttgttgcccaggctggagtgcagtggcaggatcccagctcactgcagcctcaacctccctgggctcaagcaatcctcccacctcagcctcccaagtagctagtatcacaggcatgtgataccatgcccagctaatgtttgttttctttttttgtgtgtgtgtgtagatatggggttttgaaatgttacccaggttggcctcgaactcctggctcaaatgattcacctgctttggactcccaaagtgctgagattacaggtgtgagctgccacgcccagcccatgattttcttaataacattttctttcttctagcttactttattataaaaatatagcagatgatacaggtaacagacaaaatatgtttatcagttaggcttatgttatgttatcagtgagtcttctgttatgttatcagtaaggcttctggtcaacagcaggctattagcagttaagttttgggggagtcaaaagctgtaaatgaattttcgactatgcaagggagtcagcgcctctaaccctcatgttattcaagggccaactgtatttccttggcgcgtgtttctcttcccctccatcaaaacctgctcttgggaaaggatcttctatttacctttaaagccttagtgtgaatttaagccagtgtagtctacctcttcccagattgcttacattcttcatcatcatcctaatgtagaatgaaagattgttcactcaaatgaaatgtctgaaacaaacagactgaaatattattcggggccacaaaaagacttttccatcactcctaaatagatacactgaagatactttcctactatgtctatacataggcatagctcatagggctgtctaaactgatttccatctattcaacactaccacaaagttagcagcagataagtttcttctgcagtgtgaacagcaaagacagcacatataaatgtgaatgagataagacattacttcttttatacttcaggtgctttattctgctcattcacctgcccctcgctttgtgcatccttccctccaacatgtattgagcacctgctatgtgataggcactgggacattgaaataagcagtcaatattgccaaatgaatgagggaattaatgaattaatcaaacaaatactgatttttgtggtgatactactgttcttaccctagtaatgtgttttcattttccagttttctccattagagaagactaatattatcattgtcctcatgtttcctttaattgtgcctcgagttattctatggtgctcaagaagaagtgggtttttgtttgtttgttttgctcttttcttcttatttactaagaggatcaaataagcaggtaaactggaaagctggttaaaagcaagaatttcttttaaaatctattaattacttcaaagaaattacatgtccttcttccttacttccatggtcctgcaactacaatatattggaagaagtggcataatgtcactacatttattgagacttcaaaagagttgatctttattaaatataaacagtcataagcaatgataacaaatgaataatcatgctcatatgacgaaccatacaaaccattcctttatccatacatgtctaccacgagtggttctctgatcataccctaagaagaactgtataaattagagagtctaacttttaggtgttagcctcaatgtcactttctctgagaggacttccctgatttcctttccctcacaaactaaggtgggtacttcccaccatggactcctagagcaccctgtaataggaatcataacatcttattactgttgcttgcttaattatcagttttccccactggaccataaagtctatgaagacaagcatcacgtcagtcttgctcaccattttattctcagggacctggaaaattctaagaatgttacaaatagtcaataaatgaaggaaggaagggaagaaagaaggaaatgaaggcaaatagaatgactactataaagaagatagtaagaaatgctgtgaggtatggagaaaagagaactgttacatactgttggtgggaatgtaaatttggacatccattatggaaaacagtatggaagttcctcaaaaagctagaaatataactactgtatgatccagtaatcccagtacagggtatgtatccacaagaaaataagtatgccaaagagatacctgcactctcatgctcactgcagtactattcacaatagtcaagttatgaaatcaacctgtctccatcaacagatgaacggagccaggtgtggtggcttaggtatgtaatccctgcactttgggtggctggggcaggagagtcacttgagaccagaagtttgaggccaccctggtcaacacagcaagaccttgtctctacaaaaaaattaaaaaattagccaggtgtggtagcgtgggcttgtagtttcagctacttgggaggctgaagcaggaggagcgcttgagcccaggaatttaaggctgcagtgagctataattgcattactgcactccagcctaggcaaaagaacaagaccccatctcatgaaaaaaaaaaaaaaaagaatggataaactggcatatatatttgcggaatactattgagccataaaaaaagaatgggatcttgtcatttgaggcaacatgaatgagcctggaggacatttgtttaggtgaaataagtgaggcatagaaagataaataccacatatgttcttgttcatatgtggaagctaagaaatttgatcgcataaaagtagagagtaaaacagtggttactaaaagctaggaagggtggggagtggagatagaagaggctggtgaacaaatccaaaattacagccagataaaaggaatacattctagtgtatgatagcactgtagggtgattataattaacataatttattgtacaatttctaatggctagaagatttcgaatgttcccaacacaaagaaatgataaatgtttgaagtgataaatgtgtgaattatcctgtttttttttttgttttttttttgaaacagagtctcgctctgttgcccagactggagtgcaatggcgtggtcttggctcactgcaacctccgcctcctgggttcaagtgattctcctgcctcagccacctgagtagctgggattacatgtgcctgccaccatgcccggctgatttttgtatttttagtagagacggggtttcaccatgttggccaggctggtctcaaactcctgacctcaggtgatctgcctgcctcagcctcccaaagtgctgggattacaggcatgagccactgtgcccagccaagttatcctagtttgatcattacacattgtatacacgtattgcaatatcattctgtaccccataagtatgtacaattattatatgtcaattaaaaataattttaggaaaaaggaaggaagaaaggaagaaatttttcaaatattggggaagccaattgttgagtttagttagtattcaaaatgcaataatatggacagtacttttggaaacacttcctttatgactgggatttcaccaactcctttctgtgcttattgaattactgaaaataatatcaaaaagtgttatttcctcttctgattcctctaggagatgaagacacaaatcacagagtccaaatgacttcagccaaagtggttcttctgggttcttaagtcattgttttggagtcagcccagctatccagactataccatctgcactgtgtcctgaactttctcaatttcccatctgactcttccctgtatttttagattatcaactctttcctttgactcatctcccaatgtacacatgatcatcatcattctaatgaaagggaaagagtgtgtggatcatccaaaggggtgagttgtccacacactgctcaaacatgtctctatttggctttcaaatgcatcatgtagattttcatataaccagataattcacccactgctcagaaaactgagaattcttctctaagtggcaatccaaatttgcaaaccacagctgtttttagcaattgagtcattgtctttcaggtgccaaaaatatcacctatcatattccccagagttcaaaaaaaagaggaaagaggagaaaaagcaaagaacaagttgaggataaaggtaatgtaaagcttctctagtcacagaaattattaaaaatagctataataactataacaacaataataatagcaataagaactagcattcaataacaatgaacaaaacagggctttctcacatgactttcctaatctacctaagagggagggagaatagtatccttagcatcttcattttacaaacaaagagacaacatcagagaaatcaagtaagtgactggcccaaagccacacagctatacttaagccaggccatcagacttcaaatcctgggcccaataccctattcaaacagccttaccagtgatttatcaagccactcccacatggcgtcattttggtgaaaaatctgccccttttctaccactgtgggcctaatggggtccttaggacttcacttctacaaagagagaagaaacaaagtacatttctagctttggggtgaaggttctaggtatatagacagtaaaaccttacttggaaggccaggcacggtggctcacacttataatcccagcactttgggaggccaaggcgggtggattgcctgagctcaagagttcaagacaagcctggacaacatggtgaaacccttgtctctgccaaaaatacaaaaatcagccagttgtggtggcatgagcctgtagtcccagctacccgggaagctgaggtggaaggattgcttgagcctgggaggctgaggttcagtgagctgagatcctgccactgcactccaacctgggtgacaaagtgagacccatctcaaaaaaaaaaaaaaaaaaaaaaaaaaggctgggtgcagtggctcacgcctgtaatcccagcactttgggaggctgaggcgggcagatgacgaggtcaggagattaagaccatcctggctaacacggtgaaaccccatctctactaaaaatacaaaaaatcagccgggagtggtggcgggcgcctgtagtcccagctactcgggaggctgcggcaggagaaaggtgtgaacccgggaggcggagcttgcagtgagctgagattgcgccactgcactccaacctgggtgacagagcgagactctgtcacaaaaaattaaaaattaaaaaaacataaaacctaacttggcccatctctgaaatggtttgaggaacttgcaagaaagccatttggctagtgggccctagtttgcactttggaccctaattcccaagaaccctcctccccacccaccagggacttcaggaacagtcaaagcaacatttcaacaatcaaagtttggggatccttgtctagtctcctagctctcatgtccccagggaagtccagtgcttagcacaccttgggttgtggtgagagagactctcctcttggaggccctaacgactgggtccagactgctttagccaatgagaagtctatccagtggttcaaatctcagggaatctgttatccagcaacacctctagcgtatactcacttaaggtaatatctggcaagagctttgtaaaagagaatcaggggaaaaaaacagggaaatgacttaaagcctactaaatgaaacagggaggatgaaactgtggaagatcatattttccaaaaatgactgcaaaaacatttctggtcttacatgcttttccagaatcttgccactcccgcattgaaaggaggagtttatttcttttcgccctgaagcttggtgggtcttggcgactacttcaatgaacaggatatggctaatgtgatgccatgtgacttctgagggtaggttaggaaaagtgatacagcatcacgtgtcagagacgggagtgaacaagccttctgatggtcccagatactaacctttcagtaatccctgcctttaggtcttttagctcaagcttcagatatcatggagcagagacaaaccattccctctgtaccctttgagaattcctgacccatacaatgcattggcttaataaatggctgttttatgctactaagttttggggtaatttgttgcacagcaagagataatcagaataggagccctggcttgaggggaccctgggcatgttctgtttgcaattgccaaaaggtaagttcagaccctgctgctaagcctagccctccctgccagttgctttctgcatataggtcatctctcaggggctctactgttcctcccagtgacagcacttccccttccccttctaagtccattaggtttgtttttaaagatctgaataccaattgcacgcagagttttagctcttttccttaagtttcttgggccctggataaatcaggaagtaagttatttcagttttcaaactggtttatatggttaaggcatatgcagtgcgggacggtaatgggaagtggggataaaggaaagaacctaacttccaacacctttgtcttagttctaacctacagccacttgctatacttaaataataacatgagcacagttagaaccttcactctcagtgccttgatagaactgaatcattttacttccaacaacagccctttgatcaaactcaagactggaaaagccaaaactataggaacttgactatcttgtacactattgtaatataaacacttagaacagtttctaaatatactaagcactcaataaatatttattgaatgaagcaataaacaaatgaattaatgacagaaaattcttccctccttctagagggcaatatgtaatatcagattagcataatgtgcttagaaagctagagtattcaataggttaacattctattacattaggtaatatgttttcaatctgctgaaagtaagtgttaaaacttactttaccttgagggcagagaccatgtcttataccactttgtatccccagcatctgacactttgccttaggtacttgctaaatgctcagtgaatatttttcaccaaatgaatatcaaacagggactggtagaaatatttcaaatcatttagttctcctaggctttgcctagtggaaggcagtgacagataagggtgctggccaatgcacctgatccctggagggatcagattgggatgtagtagttcagaagctctgaggcttctcagcctatcaaactcttgagaacaagagaattccagaggctgtttataatctgagtatgacattgggatgaatacaaaaaaggtcaagacctccactttagctctcaaaattgatgttctatgatttattcaaataggatttcctttcagagctataaatgagctattcatttgtctatttattaattcatctcatatttattgagggcctacctgttataatttttctgcaaagatttgtttaatccgctcgagaaatagccaactattcaaagggtccccattccctggaaaagaaccttaactgggcaacaaaagataataatatattttagaggcccatggcaattgtagatgtaagatcctcacaatttagaattaactaatccagtagttcaaaatgtgatccataattggcattatggaaaatcacttgacagatgattaaaaatagagacctctgggagccactccagccatattaaatcagaacaacaggagtgaaattagaaactttagtgagcaccactggtgattttgatagtactcaagtctgagaatcactgaccaaaggtgtgctgatagcacttacatgcaattgcttaatataatatagctttcctctcaattttacaaaattaagatcttacttggctaattctaagacacctaggaacagtgtaaatatggctcagaattgccagtgcccagactggaatttcactgaatgaatataatcattttctccttaaagtaacctaaaataaacccctccaaaaaagaaaatatcaagtaaatctattcttcccttatgaaactcacaagaagcaaactataaacaaatacttcatattaaaatagacatgctttaggtcaggcacagcggctcacaccggtaatcccagcattttgagaggctgaggtgggtggatcactcgaggtcaggaattcaagaccagcttggccagcatggtgaaacgccatctctgctaaaaatataaaaattggctgggcatggcagcttgtacctgtaatctcagctactcgggaagctgaggcaggtaaatcgcttgaacccaggaggcagaggttgcagtgagctgagatcatgccactgcactccagcctgggcaacaaagcaagcctccatctcaaaaaaaaattaattaaaaaaaaaatagagacgctttaaaccttgatatggcacacacagacccttttcaatttgaaaaacaataaatgacaggcaacaactgtgatggggagcttgtgaccatgcccatctagactgcactattttcctatttttctactctggttcccacagtgctgatgcccagctgggactttgtgtctttttccttgtcttacccccagaatcgctccttttcttcccaggatacttttactcactttctgaattttcctaatctggtcagagagtgtgtctaacaggcgagttttcaggaagtccatcaccttgaccacccggccatcaatgtagcaactggaataaaaataaaataagaatcagataaaatctcaagcaagggattataaatacacttctctagcccaaggtctctgttgcccgaggaaacaaaccagggttccactcgggctctcatattctaaaaggttttgaacctgggtacttttcaaacaaataataacctttttatcttctccatttccaccactatttgtgggctaatactgttatttttttcagcttttgtcacgtgaaaccccattgcttacttgctggaattgatggaaattccataatacaaattggataatgaggaatacttttttttccccttgagaaagtaatttaacacccatcccatgcccatcactaatcccaccttaaagtaataaaggtatgtgagaggtttgaaagaatactcaatcattttaataaatttttccatatctttaaataagaaaataaacacgaaagcaaaaatctgacttagtgtagtgagtgagtctccagctcattcctgtgggcgaacactctgtagtcaacctactaccaaaatatgctgtggttgcctactacctccagaatgaatgaacaaactaatgatgaatgtacaaaggtggaagggccctctcctaaaatagtaacaacttgatactcattggtttttgttttgatttggtttttcttagcttaaatgaaatattaagttgttgacactatgttgtaaatatttgaccaaaacaggcccatccagctttgtggagatatcctttgtgagactctttgctgaagattaagctaaggctgacacagggttaggtgatcttcgttacctcagaccttcccttacccccatcttggcaaagttctgaattcaatcaatttctaaatgcttgtgattcctgggtgccttttccaatccactaagttatccttggttgttggctaatgataaattatttcatttttaagaagcagccacccatcactacatattatagaactatgtgaaaattattttcaatgtcaacttgccataccaacatgtgatgtattggaatggttaatttttaaatttttgttttattgtaaggcaggtactttagttgaggtaagggtggtagatgatctacctactcagctttccttttggcctcacttatgactttacaacatttccacagaatccagtgcttaaaccattggaatgttggagcaaatttggcttttagccagaaatatctgacttcaaattccagatctggtattaataactatatgatcttgggcaagttacgtagtctctatgggcctcagtttttttattcttaaatgggggataatatatcttctcctcaggcttgagaattaatgagctaacagatgtaaagttcctggcatacagtagggactgaacaacttttagttcttcctaattgtcacctcacaaagatgggattataaacaataggagactgattaattaagttatgtgtaaatatagaacactataacagtggaatttctgtgctgggggtacatgtatttgaaaatttttgatggttacttatatcaggaaataaaataataacatgtcctttgcctcatcccttgtatagatgccagactcagatccaataaacatttattatgtgcaacacatagtgctgggcatatccatgtccattatcctatctcataacctgttcatagtagtacttcttcattagcacctctgatttttggaaaaagatcagatacttaattagcacctctgatttttgaaaaaaagatcagatacatggcatactacatgaaagccaggcatgttgagacagagtagtgttaaaattaaaaataatttatgcaatgctaatctaacacacatttgaggacatgaatacttgctactatattatatggtgaccaggaatttgacaagtaatgcattgtaattattcttttattatttaatcaaatatattacactttcctcttttctcaattagttcccagtaactacattacacatcagtatttataatttttgttagcaacacacatagtttaatacctattgagataaaaattccagatgtaatttttcagtaggtaggatttcctgtgaagaacctccctagcctaccccaatctgtggcccatggttgagggtcccttcattcttttcctccttccttttctcaagtacccagaatctggagttagaaaaccttggttcaatcccttctttaaagtgggttttaaaaaacccaaatctacaatattttcacagggttggtgtactgatcacataagcaaaaatgctgggcacgggacctgtcatataaaagctattcaataaccagatctactctgttcagattacttaagggcccaaggcagcagaaacttacactgaaaggccatgggatgggatgggcaggggagcatccctctggaggagagcatgctatccgctgtagaacttggagtgaggaaagtgtagagcagcaagaacagatgctggattcccagcaggtgtgaggcagaggcagggatggagatggctgtgattatgttgtaaaaatttggagtttgaaaagaccttactggtcagctggcctaaagcatgtaagcttgctacaatatcccttagaagtgattttctggctttgcttgaacatatccagggacaagaattcactgtcatacactactaggactgcttcactgcatcacagctctaattgacgaaaagctcttctgacatggtgctgaaatctgatccctgttacttcctctcaatggctagcattatatcttcttgaacccagaaatggtccaattgctccttcatgtgatacatgggagatgaaatccagcaaccttggcttaagcagtttagcctattcttgtccccagttttacccttacaagctgtatccaatcattctcaggtaatcttgggctatttccgtgggctgtgaattggattggagcgggaggagatacaggcatggaaaccaataaataaagttattttatctcaatagtgctggcaagaaatgatctgggtctaaataagggagggaacaagaaaagtgaaagcaagcagagatgaaggaagaacaaataaagcttctgtagagggtaaaagagaggaagggagtcactgatgaccatcaacatataagagagattgccttggagaacactgttgccaaagagatgtaggttagtcatacaggaatacaatttgtttagagagatgaaagatactgtctgacatatcaaaaatatacagaatatcaagaaagaactatataccacgtagctggggatataagaaagaggtacagagaaaagttgagacaagaaatgttgacgtgggggtctttttcaggttgtaagtaatggccaaagccatggctgcagatgaactcttcaagagaataagggaaattaacagagatgtcagagacccttcaaaatgcttctaaaatatggccctgggcattgcctctacctttgacccagctaaggaccccttcctcctctagcctgatgatcacagcatctttttaataacttcagtctgagtccaattcacatttgaatgtcaaaggaatcctcacattatactgagaagtttcagcaactttcatttgcaaacttaaacccacatttatattgtactatggaaatatgaactttggtcatccagaattcagtatcacttttaagagaggggatcatttaaccatagggtatggccaggcgtggtggctcaagcctgtaatcccagcactttgggaggctgaggcgggcggatcatgaggtcaggagatcaagaccatcctggctaacatggtgaaaccccgtctctactaaaaatacaattagccggggcgtggtggggggcgcctgtagtcccagctactccggaggctgagtcaggagaatggcgtgaacccgggaggcggagcttgcagtgagccgagattgtgccactgtaccccagcctgggcaacagagcaagactaggtctcaaaacaaaacaaaaacaaacaaacaaagaaaaacccatagggtatgaatttatcaatgcctaaacctttttcttagatatgcttggacaactaacttactgtacttacccattgtaaatgtgaagcttctaagaaaacattcagcatcaacaatccgtggctatttgaaagcttcttcccagttacagagctttggttcactgatggtagttgcatgtggtgataggtccaatataaatatatcatttatatttgggcatgaaggagatggagtagtctgtggtgaccattttataagaataaattgctaaaaatgatgataatggtgatttctttttttcttttttctttttttttttttaaaaaaaccctggctgaatggtctagaattacctagactgacacttttaggtatatcatggtcatcctccaagctctcttgaaattcagcatcacttaagatcataccacaagtcgtcgagctgttccactaaaaaccaaagccaagaaaggctgtgtagaaataacctttctgggaactatcacaaaggtaatgaagttgaaacttttgtattaatacatcatcaaaaggtctgtctcacccaatgccagcaattcattcctacctctagattggcaggtcatatcaagcatatctctggggaagtggcaaagatagcagactatacaaagtaaaaggaaccacttatcaatgtattcaccaactctcctgtcccccttaattttacattttagttccagtacaataatcttcatcttattttatttggtgttgccctttatttttattacaaaagaactaaatgctcattgtagacgaattagagaatgaacatgaacaaaatagaaataggaaaatggaaaatcacctacagtataataagcacaacacctagagaagctcattgcaacattttgctgcatactcttccagtttttcatagtaaataaacataaaatttcccctaattagttttttaataaacctgtactccagatcctattcaactagcatttaaacttaaaattgctccaaatgagacatccaagcccatctcacagggatactgttagcaagattacagactcccagtcaaagcatcttactcttattttaatttcattctggccatttagaggtcctctgccaggagcagagctcacctccttcctgtctctgtcagccaagttttaaccccattcccgtcccactgacccccttcatcaggcccctagattcagtcttcaggattgtactacaattagccacttatgcccattaggcttttaaaacatttaatgaggagagtttgttggctccaggggcagctggttttgtttacctggccctttactttaaaaagaaaaacctttgccctttattatctgaccccttcttttatttcaggtaattgcattagtgcgggcttcccagtgctcaggaatttccggacttattttgctccctgctagtttcaaggaggaggggcagcctgctcagaattctaacacccagcctgctgactgggcaggtaattccagaaaattggagccttccctactgaagggggagaagcttggataatcattagaaaaaccctgttcacctataaaacctattctgccgcctcgaagcaaacactggagaaaggctgatttgagtatttaggctttataaattgcacttgcccctcctccaaaggccctcagcctgggctcctgctgagcacttgccattaagcttttcttctgaggctacattagttttcatcttctttgcaatgggtcaaccttcttatcttgtgtttcagaactgctttgggcaggaacgcttagatgaaatgaacactgttacaaaaaaaggttctacagaatacagatgtttctttggctttcttaaaccagttcaaataattccattcaggaatcatctaacctactaaagggacatagttcagtaagaaagagtttgtactgtggaaaaatgttatagaaaaatagtacaggtaaaggtcagagttgtgagcaatactaaaggcaaataatgtctttaatgaaagaatgagtgcctgtatgacttaacccataatgagccaaccgaggctcaagtgccatgccaagggctccattttctgcatcttcttgctctcctaactctttgcacactttgggtcctgcgcctcaagcccagacccttttccccatatatccagagttgtatgtggagaggcactgagtgtgggcagaggctcaaatcatcttgatcctagcggtgttaaggagaggtgtacaggaagctgggaaaggaaagaggtagggaaatcatatgcagcttcagccattggagcaggctctagggagggacctctaaaaattttcagaatagtagcaggtgatggcaccagaattgtgggcagaagtggatccatgtgcttttggtctgaaacttaacacaagttgtggggccctctttaagaggaggaaatcaaaagtacaaaacaaggctgggcacagtggctcatgcctgtggtctcagcactttgggagaccaaagtggaaggatctcctgaggccaagagtttgagaccagcttgggcaacatagcgagaccctcgtctctacaaaaaataaaaaaattagctgggtgtagtggtacaggaggatcacttgagccacagaattcgaggttacagtgagctattatggcaccagtactcagcctgggtgacagaacgagactctctaaaaaaaaaattagaaagcattttttaaactacaaaacacataatagatacaaaagtaagtatttatatcaaatgacaaaataaatcacaacaaactcccagaaacttagagaatcaagttcctttcttctgagagctcttcaagcaatttactagaaatgtttacataatgcttcctcatagcaacctgcccccattcccttaccccttaccacctagaacatcctacaactctcagcactcataggaatcaatgcaagagaggggtctgaagcttaattcattagcttcatggtaaatctaaattgtgaggcattaataacaggaatgatagggtctatctaagttgccagaacccaaccatctatgtgcagtattttaaaaaactcagtgtttgtaaattgggggttgcttatactgttgccacatccttcccctggcctcttttcatgtaattgtcattgttcgtggcagaatagcacaactgaactataattaagttagtatattactaactaggagaaaatagaaaggagaaagaggaagggaggagtcttacatatattaagttccttcttatttgctagctattttacatatagtgtcatttaatcttcatgaacactctctattttgcagattagaaactacagctcacacggtattagtaagtaggaaaccagagatcatataggtactaagtaacagacaccaaaaccttttccctttgtactttgatctgccaagtgtcccaacaatacagcaccatgcttatttcattggtcctgtaatcaagtaaaattgtttttcaactgcctttagtcttgcttacttcaaccaaatctaaacaatattgaactaagtgcaaatttctcaagaaaacaaaacaattaccacaaaaccaacccaaaacagtaacaaaagcaaaaaccggggtagataagtaaaagcatggaggtggtaaaactctattcttttctttgcaaaaaagtttttcaaagtgttttagtaattgttatataaagaaaaaggggctccatggtcaaataagtttaggaaatgctgggttaaaaccaaattcagtagtacttcctgtttcagccatgatagaactgaacagcaaccaattcaggctgcgattcttgagagatggtagggcacctgaggtgaacttcagatcccattcacctgagcttgctcctggggacagggtaaagatagtttactgactaccaaaatttgagcttcccttccatagtgctgagctgttgccaagaagcagctgcccaggcagaacctacatttctttgcccctcttacatggtagaggcaggggaatgccaaaacgatgtgagcagaaataatgtgacacttcagggctaaagtagatgtaggtgtttttcacttttgagcagaaattaagaagccatgtcttcttagtagtgtctgtccccattgccagctgaatggaaaagtctctgaggaaaagccacaaaatggtaaatacctgggtcctggaatggccacatgtgaggccatccccaaggtacatcagcattggactgtcacgttagtgagaagcaaacttctattgccaggccactgaaatgtggggatttaattgttaaaacaatttgtgttatattaactaatatatgggcattcattacaacaaaacacctttataccaatcaatctgtttgaccaacagttcataatagaagaggttttcctttgagaagaaactgtccttgtatgaaaattaaaaagattagcctggagaacttacttacaattctagtttgaattgattgagtgtctaccagtgattggttgaataataactttcattctaatcccatgcaagaacagttgatgaggggagatattattcttatttttctatatttagacatactgagcctggtgtaaaaacacagtgaccaaggtgattactaatgaccaaaaaggacatggaatctagaatgttggaagggaggccagttaataaaggtcacatatcagtaggaggcagcattttgatgacatagaatattctccattaggcttctagctaccttagttttcactcagggacagccaatagtttgaggtagatttattgagacattctcattatttggtatctcactgaggatatgaaatcacatgtcctaacttgcatgcatcacaaaagctagaggttcaactctagcctgcatgatgtttcttatgtccagacaacccaacacacacatcaaactgcttttctacctacactcaccaacaccctgtatattttagttcctgtacctaacttttacagtcagcaaattcaatgtcatagagctataccttcttaaaggatgctcactgtggagaatattgcactgaaaggaaatcttacctcactatgattctttttatgacaattgtcacttctctgtttaaaaagaaaagttagctctcaccatataaagcctttaaaggcattatttaccatgatatatgtgtgtgcatacaagcatgtgtgtagatgtgtgttaaaagaaacagaaagagattgagagggagagacagtcagttctatatgatgcaaatcacatcaggaccaggaaataaaatttaagttccttgaactagtgctcagaatatataatatttgaaactgatagatgactcagttaaatttattcagctaataggaattctaatgtcataattctaaggtaaaatttcacatgtccctccgtaacaaaatgtttctttaccatcctttcttttaaaaaatttcaaggaattttaagaaacggtaccctaaaatatcgtattttttttccctccaatctcctacaaattcactttggttatctaaccaaaaagagtctgagaattagggaaatatcagcatgttatcttcttctctgtgattgaggaaagatttggtttgaacacaaagagaaagaaagatgactgctatcattttgaagtcatgttaagtagaagggtagatcccctttaaagaactagttccttttttttttttttcttgagatggagtctcgctctgtcacccaggctggagtgcagtggtgtgattttggctcactgcaacctccgcctactgggttcaagcaattctctgcctcagcctcccgagtggctgggattacaggcacctgcaaccatgcctggccgatttttgtatttttggtagagacaggtttcaccatgttggtcaggctggtctcaaactcctgacctcaggtgatccacctgcctcggcttcccaaagtgctgggattacatgtgtgagccaccacgctcggccagaaatagttccatttttaaaagttaaagacagaaataaaaagcaactgctccttgaaagaaacaatgatagttcactttctaaattaagatcaaaaaaggtaaaatttcatttaatatattctcatcacatattttagacaattaaagtagaagcaagtatatacacagaacaaaaggaaaatagggaataggaaggtaagagccagatgaggaaggaaacaccaacatagtgcattggggatcttttggttcccccaagccaactcatcgtctctgcctctgttctttacatctgtgtatcctactaagcctcatgattcaacaaccagtcccacatataccctttcagccatctgcttttttcaatcaccaagtccctaaagtgacctcccatgattcactagctttataccaccacttgtccaatcctaccttggtcagtgaaacacaacagagcagtttttaccccctgcccattcccaatctcccactatctagcacctactccaaatcccctgagttctgtcacttgagtggcaaaccaaggcttaacctccacttccattctccaggcagtgcaacccttcttggcaaaactacaaggtctacatgactggtctttggagaccttcatctgttcagccttctccacacaaagcctaggcttaattaaatggtatcttggctaaaatgtgacatggactctttctctcttacccagtggttattaatcctgtctgaatttgcattaactaagataataattattcaaacaaaatttttacctactagatagcaatctggacaaggagctaggagagctggttttccaatcattagtcttgtcaccttaagcaagtcacttagcttcttttgtcttctttcatctacctaggtttttaagcctagatcaaggatggctaataactaattggattctaccagtttttgcctcacatattttgacactctgttgttagatgcatacatgtttaggataattcttggagaattaatctatatatcattatgtaatggtgctctttatccctgttaattgtccttgttctgaggtctgctttgtctgaaacatagctgcttcagccatcctttgatttgtgtgtgcatggtgtacttctctctttacttttaacctatctgagtctttatgtttaaattgggtttattgtaggcaacatatggttaagtttgtttttatatcctccctgacaatctttgtcttttaattggtatatttaggctattcacatttagaatgatgattgatatagttaggattaatatctattatgctctaagtgttttctattccttgtatctgttttttttttaatctcttctttttttgttttctctggttttaattgagcattttatataattacattttatctcctctcttagtatactattatatttctttctaaaacattttatgtggttgccctagaatttccaatatacatttttaatgaatctcggtgtatcttcaaataaccccatactgcttcatatgcagtacaggtaataatagagtatcctaaatttatcccacccttcatttctatcattcatttcccttatatatatgctataataacccagtacattgtggctattattactttaaacagttatcttttagacaaattaaaataaggaaaataaaatttttattttaccttcatttattccttccctgacactcttcctttccttttgtagacttgcatttctgatctatatcacattctttctacctgaaaagcttctatcaatctctcatgcagggaaagtctgctggtgataaattccctcagtttttgtttgtctgagaaagtctttatttctctttcacttttcatggataaagaactctagttttttttttttcaacattttaatgatttcactccactattttcatgcttgcattgtttcttatgatacttcagatccttgttcacattgcttcatatcaatgcacttcattgccttgttcctctttaggtaaggtattgttttcctattgtttttcaagattttctcttttttctttagttctataatatgcctggttgtagttttcttggaatttatcctgctcagtgttccctgagcttcctggatctgtggtcttacagctgtcattaatttcagaaagttctctgctattattacttcaacacttgaattacttcaagccattattttccattattcttctgctctgttttctccttcttctccttctgctattctaattatgtgtacattacacattttgaaattgtcgcacatttcttggctattctgttgttttcattcttttacctttctgaatttcagtttgggcaatttctattgacctatcctcaagctcaccaattctttcatcagctgtatccagtctactgatgagcctactaaaggcattcttcatttttgtgacaatgttttttatttctatcatttccttttgattccattgtagtttctatctctctacttatattaaccatgtatttttgcatgttgtctacttccattagagcacttaatgtattaatcatagttaaattctccatctagtaattctaataactatgtcatatataagactggttctgatactttgttcagactgtgttttttcttgcttttggcttactttctaattttttttgttgaaaactgacatgctgaattaggtaataggaactgaggaaaaagacctttggcgtgaggttttgggcgaggagttggactgtgtttgctatatcagtagatgccagaggcttcaaagccccctagtatccttgtttatgcctcttttcttcactttaggctttcctagttactcctcttcagagagaatttgtgtctggtgaactctatcagttgtattcactgttactgtgctgctggtgtggcagtaagttgtgggagaagggaagtgttctgtaactttatggttaaatctcagtcttttagtggacctgtgtccctgggctatgatcttcacctttttttcccagtagcatagctttccccctgtatgtaagacggaaaggctagagggggctagagtgtggggaatgccctttctcatctgggataaggcttggagagttggctttttttttttatggaaaatgctatggtcatatttcacaatgatttactctctctctctgacacagttactaggaaaccttttttggatcccacaaaagtgtggagccaaagactgcagctcccaggtttttaagctcaaattagttcatacgaattctccagcaattcatgggaattaccacttaagtgctgataccagcttatggcttcagcagtttctgctcttattaagcaaattttggtggtaactgtggattcacctgtctctccagatttcagggtggtgtttgctctgcaacatcaattctctgatgcattcaagaaaagtcattgattgtcagtttgtttagcttttgcttgtatgaaatttcagctttttcttgtataaataggaagtaacaacttcctattttcatgtttgaggtgaaaccagaagtccactgatggaattctcatcatgcatgtcaacactgaccttttgcagttgtgctgggaaatacccttaatctccactttgtattgtcaattagtaggttaatatgatcaattactttggtctgccatggttatgagagtaaggaataaaggcacatgtgatacacatgtgtcattttgatcaagatgctttctaaggccctttccagatccaagactcaaggtctcctctttgacacagtgaaatgataccatagggtgtcccctcaacacatatgaaggtactatatttcagtcagtgaaactgcattgtgtagaatgttgtccaacagatgtgaacaggataaaatccaacatgtgagaaaagcaaaacaaaatgactttcctaaaggtttcacattagtttcctatttgagttttttttttttttttttaattgagacagagtcttgctctgttgcccaggctggagcgcaatggcgcaatctcagctcactgcaactgctacctcccaggtttaagcgattttccttcctcacctcctgagtagctgggactacaggcgcatcccaccacacccggctaatgctttgtaattttagtacagatggggtttcactgtgttagccaggatggtctcaatctcctgacctcgtgatccacttgcctcagcctcccaaagtgctgggattacaggtgtgagccaccatgcccagccttgagtttgattttctacactttcatttatacatgagattgataaatcattgctgttttgcactgtccctatgcatgcctcttccttaatgtgggttgtgcttctatgcctttgagagaataagacagacaaagagcatttctattataccagatatcagcatccatgtcatcacataattgacttttttatgaggacccaccataagaatttatatcaaggcttagtatcaggaaaatgatgcttctcatgaaaacttactttaatttcttacttatagacactagattttgttttccactttgctttggccattatgaaacatagagtcaaacttataccccatctctcacaagagaatagaatcagctgataggtttttttttttttttttgggatggagtttcgctcctgttgcccagcctggagtgcagtggcctgattttggctcactgcaacctccgtctcccggattcaagtgattctcctgcctcagcctcctgagtagctgggattataggcacccgccaccacatccggctaatttttggtatttttggtagagacatggtttcaccatattggccaggctggtcttgaactcctgacctcagctgatccacccatcttggcttcctaaagtgctgagattacaggcatgagccaccatgcctggcctgatgggcattttttagagtactaattttctcatcactttattgctactctaaccctattttccatttactcttccttcctcagtttttaaaaaataatgttgctattggacagcaaagtaaccagaagagaggttgagagaagctgtgcaaaaaaaaaaagcattcaataattcccaaactatatacttagcccttatttatacaaagcaatgcaaagaccttcagtttcgtatcctgcttatgttccttccctctttcctccaaaatcctttttttttgtttgttttgttttgttaccactctgttacccaggctggagtgcagtggtgtgatctcggctcactgcaaactctacctcctggttcatgcaattcttgtgcttcaacaccccccgccccagtagctgggattataggtgcacgccaccacgcccagataatttttgtatttttagtagagatggggttttaccatgttgactgggctggtctcgaactcttgacctcaaacaatctgcttgccttgctctcccagagtgctgggattacaggcgtgagccaccatgcccggccccaaatccattttttatattataagatattgggaaagattcagtaagctctgttctcttattaagtttaaaaacactctttgtcagataaaatactgtatttggtataatacagtttaaggttgaatcacaaagacattaactttagtctgctgtaaatagatttccctttctgataattcttagatatgtttatgttttcctggggctggaattgaccatcttaagtggcaccaatagttggtaaggttgaaaaattaatataatcaggactacctggtatttttaggacatattttctcaaagatcacagagtacttcgcagataacaaacttaagggattttttggaatgagaacagacgaagttttgttttttctcttccttcataatgaagaagaaagtctgggacttcactgcagggcacattccatcagagtgtatatggtttgagggtggggaggatcagaaaagtggaggcagttttggggttatagggtaaagtatgggcctaaacgatacgatgaaggactatcgccatgcccggggtacacagactttttctggaaagggctagataacaagtaatttaggccttgggagctagatgttccctgtactcaactctgctatggctatatcaaagcaatttataattcataaatgaatgagcatagctgtgttctaagaaaattttatttgtgaatactagaatttgaatttcatatattaataattttcacatcacaaggtgttatttttgtttttgtttcaaccatttgcaaagacataaagcatgttgttaggcccactggccatacaaaaacccatgatgggcaggattggtaaatatcttctctcagttcgtgacttgatttatcactatcattgattgaaataaaatccaattaatcaatcttttttttttttagggttggtgagctttatgtcctatttaagaaatctttgcctaccctaaggtcataagagtattttatgctttcttccgaagcttcagtgttttccctttcacacaatacttttatatatgatgtaaggtatggattaagcaaaaatcctaaaaacagccaaagaaaaaagacattactttcaaaagagtgaccatattacttatatttgatttatcaacaaaaattattgggccagaagataatgaaatgacatttttagacagccaaatttggacttcagcaatttgactatgatttacatcgttgtggtttcttttgtatgtatcttgattgatactggcagagttttttttttttttttaattgagataaaacccacataacataaaattaaccattttaaagtgcaatttagtgacgtttagtacattcacaaagttgtacaaccatcatcattatctagttccaaaatattttcattaccctaaaaggaaatcctatatccattaagcagtcactcaccatttcccacctccctatagaacctggaaactactaatcattttttttgtctctatggatttacctattcttgatatttaatatacattcatccctcagtatatgtgggggattggttccaggacctccatgttaccaaaatccacacatagtcaggtcttgcagtctgccctgttgaccctgtgtaaacaaaaaagtcaggcctctgtacactcaggttctgcatcccagtaattttccatccacatttggttgaaaaaaaatccacgtataaatgaacctgaacatttcaaactacattgtttaagagtcaactataaatggaatcctacagtatgttgtcctttatgactggcttccttcacttaatgtttttgaagttcgttcacattgtaccatgtatcagtatttcatttctttttatggcagaataacattcgatggtattgatatattttatttattcattcatctgttgatggacatttgggatgattctacctttaagctattgtgagtactgctgtatgaatattcatgaacatatatttgtttgaatgcctgttttcaattctttggagcatacacacctatgagtgaaaccactgggtaacagtaacagtaggaaggtcctatggatggaaatcactctcacctcagaagagtcagtaaagagtctctttgaacaaatttccacatgaaaaattagaaagataaagaaaacaaagacaatctgggttagagtgaaattgaaattacacaggacaatgggttcacttagagaagaggaaaggaaagctgataatagatgccaagagtattagcatttttctccctaggagacttggtattgctaacttcactgagtacttgtgaggcattaataagctaaggatgggaaaagttaaactattttttcaattaaactttggttgcagcatcattaaaactaagctgttctgcatgctactgatttcattcttggctaccaggctggttatttgtttgttgtctgaatgaagagagaaagtgctgctggggggcagatcaaacagaagtacacatgaggggaaaagaatggtcatgtgttaatgagtaagaggcagctgatccctgagggattctcagcacaatcttctcattgcaaatttattttctaaatttgttagcactatgagtgcagaattatacaaatgcctgggatttcttttttcccttttcctgttgtgttgggtggttttattactttagaactggaagggactacatgatcataaaggtcttctcacttatagatgtagaaacccagagaggtgaaattgtggtccaaggtcatacaacttattattggggctcctttccatacctctgaaaatagttataagttctacttttaaaattagccactattaaaaacgtagattttaaaaggtgcccctggcatgccatagcctctcctggccataggaaaaattttggcaaagggctggcaagggagcccatttgaacagggaggcaattcttggcatcagctgtgtctctgcactttggctttcccataatggcccttatacactcaggatgaagtttcagagtttgaagatgaccttcatctttcctttccttctgtttcctttatgagggatgggggtagaaccagggaccttgcaacaatgctaccatatggtcatggcatttggtgtcccttgagcaattttctcttcacaatgaatccctgtctttcatctatatggaacccactatatttgccaagtaccttttcatctacactctcagtgaacctcaaaaccttcctagttaggttccattatcctaattttcaagaggagaaatttaaaatgtaaagagggagtaggctgaattggcaccagaggccaggacacatctcaggacacccaccttgaatctggactgctagccattctttagctcctccttgccctgacacagccttcctcccagggtgtatgagcctgtttggcataggataacctgcactaatgctcccctgggaatcacaagcccgatgcaggctgagaagacagagaggctgatgaaggtaatgggaaataattatctccttcaaaggatacataagaaaagtcactggaagcagcatgataaaacttggactaatgaagtcccaaaggattctggtcttggagaagaaaatatagtttactggtttccaaatctctgttgcatcagaatcacttaggattgcttttagtttatttaattttagttcctgagtagctaatatatgtacaaggctcagaaatcaaaaggaacaaaaagcatatggtaaaaagtctcctcccatctctatgtcctagtgactttatttccctccttggaggcaagcaacaaatgctatcagtttcttttatataagtgactttaagcacatataagcagagtatatatttccccaaaacatatttttatataatattctatgcacattgttcttaactttccttttttcacctaaacaatatatctttgtttcatatcagtccacaaagagcttcctctttccctttttaatctgaattagtattccattacaagcctgtaccataatttttatctagtcaattccctattactaaacattaagttgtttttaatttgttgctattacagacaaaggtgaaataaatgaccttgtgcaatgaatgtccaagagaactcaatttaagtctaaactcttacactatgcagctgtgtggccttgggcaagtcagttaggacttcagccttttcaaaatggaaggaatcttctttttgtttatttgttttattgagatggagtcttgctatgtcgccaggctggagtgcagtggtcttggctcactgcaacctctgccttttgggttcaagcgattcccctgcctcagcctcctgagtagctgggactacaggcgcgtgccaccatgcccggctaattttttgtattttagtagagacagggtttcaccatgttggccaggatggtctcgatctcctgacctcatgatctgcccgcctcggcttcccagagtgccaggattacaggcatgagccactgtgcctggccaaaatggaaggaatcttaacgaccatttgttgtagcatttttccaaagtatgttcatggaacactcatcccaaagggtgcccccccggaaactgacagtacacattagactgagaagaccacagtgaacatacatgaattaatctagggtttcacaaatatatttaataatactatgaagccataaaaaagaatgagattatgtcctttacaggaacatggatggagctgaaggccatcatccttagcaaacaaacacaggaacagaaaaccaaatactgcatgttctcacttataagtgggagctaaatgatgagaccacatggacacaaagaggggaacagacactgggatatagttgagagtgaaggatgggaggaggcagaggatcagaaaaataaccattgagtactgggcttagtacctgggtgatgaaataatctgtacaacaaacccctgtgacatgagtttacctaataacaaacctgcacatgtaccactgaacctaaaatgaacaattgtcatgctgtggaattttccttagaatgcactttgagaaaacaatgtctagtctagtccaacctcctcttattttacagctaggaactcatagaagttttggataatcagcatctaatacatgcttgaacagtatagctcaaaaaatactgtttgacttgcattaaacaaacagagatctatttagggaaataatacaagcctatataataaatttagaaagatttaaaaaacaataaagaacaacttgatgagaccaagataggacatgataggaccacaagagtttagaaatagatgaaggtcatttaatatttataggggaagtaagacttaatatgggtcacaaaggatgaacacacataagggcaggggtatgagggttagccattccacgaaaacacaaaacatgttctgggcataacgaaaatcagtttgattaggcccccagtcttcaccaatcttcctttagttccctcattcaacaatcactaccaagtatctgctatgtaccaggcactgttctaggtacttgggatagagcagtgaataagagacatggaacttatattctagaaggaacttagattctagaagggaactctgctctcatggaacttatattctagaagggtgaaaaaaacctaataagggactcatattgaggataagtgctataagaaaaaaaatagggctagagggttctagggctgactagaagtggctagtatgtgccactctcacagagaggaaacaaagtggtaaatagtgactcttcaagtggctcttttaagaaaacatgttgggatccaacaagggagcaaggggacacaggaagaacagagaagactgaagctgaggagccgcctgccctggactagtgcagagccaggagatgctccctaatatggggaaagaatgagaacgtaacaaccaccaggtgatcacagttcccacaaggacctgtgcaatcttgggaacaggagaactttcctgaaccccatgggcctctagactgatacagagagccacccagatttttgtagaggtaccactcaagaccacggggagccccacaggccttggatccttgagcagcctggcaccagctaccataacgccagtagtggtcacagtcatggtgccagggaacagtcagactgatccattcctctttgtcagacaaagctcggctcccacttccagcacggtgaccttgcccttgtctgaacactgtgggtaggctcagctctatgttggctggggaaaaggtgagatggctgactccacccacccctgctgcttctagtagagtgggactcgctggctcgggcttccagggcagcaactctgccactgcttgaactctgctggtgggtacagctctttgttaccctggtaggcacccagatggcagaccagatgactctacccatctcagctgctcctagccaggcaaaacttgcttgggctttcagtacagtggctgggaccctgattaaactctgccagtgggcacaactgtgttaccctggtaaacacccagatggtggaccgggtgattccacccacccccactgcccaagcaggagaagagcccccactctcagaacactgaatggggtgagatgcctgggtttgtgggctggcagggaagcagggcctaccttcttctgcagggccagtccaagaagggtgtagcctgtttgccagccagggaatctgcttgaggcagcgccatggctcagaacacctggcaaaggaaacgtgggcacagtaccaccgatcagaaggggctcttccaaggcccaggaatggacctggtaaagggatcacctctctcaccctctatcacagagcactatcgacaatgcgctgaaatacaaaagagcccggtggctaagggcttatctatcggccatcgctctcaggcgccatctactggatggtaatccaaattacaacactaaaaatatttcgcccgtatatagcgcctgtgaaacctaaggcaaaaatctagacacaaataaagatcttgttaagagcctttgccctctgaaagcacccagaaatgaagccaactgactatactcatcttacgtcacaaacaaagaaagacaagccctctcagatgagaaagaatcagcacaagaattctggcaattcaaaaagccagagtgtctccttacctccaaaagaatataatagccaccccaacccccaaatggttcttaatcagattgaaatgactgaaatgacagacacagaattcagaatcttgatggcaaggaaactcattgagatccaggagaaagttgaaacccaatccaaggaatccagtaaaatgatccaagaactgaaagataaagtagccattttatgaaagaaccaaacttaacttctagaattgaagaattcaccagaagaatttcataatataatcagaaccactaacagcagagtaaaccaagctgaggaaactctcagtttgaagactgactcttcaaatcaactcagacaaaactaaaggaaaaaaaatttaaatgaacaaaacctctgaaacatacaggataatgtaaagagacaaaatctatgactcactgacattccagagagagaagataagagagtaagcaacttggaaaacatatttgaagaaagagtccatgaaaatttccccaatctctctagggatgtggacatgcaaattcaagaaatacagggagcccctgtgagagaccatgtaagacaaccatcctcaaggcacacagtcatcagattcaccatggtaaatgaaaaagaaaaaatcttaaatgcagctagagagaaaggtcaggtcatttacaaagggaaccccatcaggctagcagcagacctttcagcagaaaacttacaagccagaagagattgcagccttttttcagcatcctcaaagaaaagaaattccaaccaacaatttcatatcccaccaaactcagcttcataagcaaaggaggatacaatccttctcagacaaccaaacagtaagggaattggttattaccagaccagccttataagaagtccttaagggagtgctaaacatgggaacaaaaggttgatacctgctaccacaaaagtcactcaagcacatagcccacagacaatataaagcaattacacgatcaaatttacaaaacaaaaagctaataacatgatgacaggatcaaaatctcacatataaatactaaccctgaatgtgaatggtctaaatgccccacttaaaaggcatagagtgacaagctggataaaatgactagacccaactgtctgctgtcttcaagaaaccaatctcacatgtaataacatccacaggctcaaagtaaagggatgaataaagatctaacatgcaaacagaaagcaaaaaagaacaggagtagctattcttgtatcagataaaacagactttaagtcaacaatcagaaaggacaaaaaggagtattgcataatgataaaggattcaattcaacaagaagccctaactatcctaatatatatgcagccaaattggagcacccacccagatttataaaacaagttcttcttgacctatgaaaagacttagacagccacacagtaatagcaggggactttaacactccactgacagtgttagatcattgaggcaggaaactaactaacaaggaaagtctagacttacatgcaattcttgaccaattggacctaatagacatctgcagaacattccacccaacaaccacagcatatacatttttctcatctgctcatggaacatattctaagattgactacatgctgagtcatagagcaagtctcaataaatttaaaaaaatcaaaataataccaggcatactcttgaactgcagtacaataaaaatagaaattaataccaagaagatctctcagaactacacaaaaacatggaaattaaacaacttgctcctgaataactcttgagcgaacaatgaaattaaagcagaaataaaaaattccttgaaactaatgaaaatggaaacacaacttaccaaaatccttgggatgccactaaagtggtggtaagagaaaagtttgtagcactaaacaccttcattaagtagttaaaaaatttcaaattaataagctaacattgcacctagagaaataagacaaaaaataattatttctagaagaaaaagagtaataattaagtcagagaagaactgaacaaaactgagacccaaaagtccatacaaaagatcaataaaaccaagagttggttcttcaaaggaataaaaaagattgttaaacatctagctagattaacaaaggaaaaaaaaagattcaaataagcacaatcagaaagacaaagatgacattaaaaccaatcccacagaaatagaatagaatagaaaagatcctcagggactattatgaacacctctatgtacacaaagtagacaatctagaggaaatggataaattcctagaagcacacaacctctcaagattgaaccaggaggaaagtgaaagcctgaacagaacaataataaactcagaagttgagtcagtaataaaaagcctgccaactaaaaggagccctcacacagatgaattcacagccaaattctaccagatgtacaaagaagaactggtatcaatcatactgaaactattccaaaaaataaaggcggaggatctcctccctaactcattttatgaagccagtatccatcctgataccaaaatctggcagagacacaatgaaaaaagaaaacttcaggccaatatccctgatgaacacagacacaaaaatctttaataaatattagcaaaccaaatttagcagcacatcaaaaagttaattcaccacaatcaagtaggcattattcctgatatgcaaggttggttcaacatatgcaaatcaataattgtgattaaccacataaacagaatcaaaaacaaaaaccatatgattatctcaatagatgcagaacaagccttcaataaatttcaacattgtttaattgcaaaaaccctcaacaggggctaggcatcaaaggcacatacatcaaaataataaaagccatctatgacaaatccacggccaacatcatattgaatgcggaaaagctacaaccattccccttgagaactggaacaagacgaggatgcccactcttagcatttctattcaacatggtattggaagtcccagctagagcaatcaggcaagacaaagaaataaaaggcatccaaataagagaagaagaaatcaacctatttctctttgctgatgatataattttatgcatagaaaacccaaaaggctcctggaactgataattgatctcagtaaagtttcaggatacaaaatcaatatacagaaatcggtggcatttcaatacaccaataacattctagctgaaagccaaatcaagaacacaatcacatttataatagccataaaaaataaatacctaggaatatatctaaccaaggagggtaaaatacatctataagaggaattacaaaatactgctgaaagtaatgaaattacacaaataaatagaaaaatattccatgctcattgattggaagaatcaatattgttaaaatggccacactttccaaagtaatttacagattcagtgttatccctatcaaaacaccaatgtcatttttcaaggaagtagaaaagactattctaaaattcacatggaaccaaaaaggagcccgattagccaaagcaatcctaagcaaaaagaacaacgccagagacataatgttacccaacttcactaaaaggctacagtaaccaaaacagcatggtatgggtacaaaaacagacttatagaccattgtaacagaatagagaacctggaaataaagccacacagctataaccatctgatcttcaatgaacttgacaaaaataagcaatgtagaaacgacttcctattcaatcaacggtgctggaataactggctaaccatatgcaaaataatgaatctggactacatttcaccatatacaaaactcaactcaagatggattaaagatttaaatgtaatacctcaaactataaaagtcctaaagaaaatgtaggaaatacccttctccatatggttttggtaaagaatttgtggctaagtcaccaaaaccaattgcgacaaaaacaaaaattgacaagtgggacttcattaaacgaaagagcttctgcacagcaaaataaattaacaatggagtaaatagcctagagaaaatattcacaaagtatgtattcaataaaggtctactatccagaatctataaggaacttaaataaacaagcaaacccaaataatccaattaaaaataggcaaaggagatgaagagatgcttatcaaaagaagatgtacaagtggctcacaaacatattaaaaaatactcaaatcactaatcattagagaaatgcaaatcaaaaccacaataagatgccatctcatatcagtcagaatggtgattattaaaaagtgaaaagtaacagatgctgttgaggctgcagagacaagggaatgcttatatactgtttgtgggaacgcaaatcagttcagtcattgtggaaagcagtttggagatttctcaaggaacttaaaactgaactatcattcattccagcaatcccattactgggtatatacccaaaggaaaataaatcgttctaccaaaaagacacatgcacttctatgttcatggctgcattattcacaacagcaaagacaggaaatcaacctacatgcccatcaatggtggactggataaagaaaatttggtacatatacagcatgaaatactatgcagccataaaaatattgtgtcctttgcagcaacatggatgtagtttgaggtcattatcctaagtgaattaacacaggaagagaaaaccaaattacagcatgttctcacctacaagtgagagctaaactttgaatacacatggacataaacatgggaacaatagacactggggactgctagaacagaggagggaatgaagggggtgtgggatgaaaaaccatctgttgggtactatgctcactacctgggtgacaggaccatttgtaccccaaacttcaccatcacataatacacccatgtaacaaatgtgcacaggtgccccctgaatctaaaattttaaaaaagaaaaagtaaagaaggggttacaaagagggttgagatggggagaaaagattgctcttttacaaaaggaggccaggaaaggccactttgacattggggcagagtcctgaaagaaatgaaggagtcatgcagatttctagaggaagactattctaggtaaaggggaagcaaatgcaaagatctaaagtgggagcgtcattgtcatgtttcaaggaacacgaggtatgccagagtagagagtggcagagtgtaggacagtggtgcaggagatgagttcaggcagccagttaagtagggccatgcaggccactctaagggctttggttcttattccaagtcagatgaagagacattaaggattttgagcagaggaatggtaggatcaacatagttgcttattggaatagggtataggtggaagcaagcagataggaatctattgcaatagtctggggaagaaataaaaactgtctttgaattttgctgatccaggtttagtatcccttagaaatgttcaagaccagaagtgtttcaggtttgggattttttcatatttgggaatatttgcatttatattgttactaattgagcatccataatctgaaaattcaagatctgaaatgctccagttgagggaagagagagaccctctcatattgttttatattgttttatactcagtacctgttttaagaaaaaacaaggaagtggaatcaaagacaggcagcccggcgccaggcccaaaaccaggcctgggcctgcctggcctaaacccagtagttaaaaatcaactcataacttagaaaccgatgttattcatagattccagacattgtatagaagaacattgtgaaactccctgccctgttctgtttctctctaccagtgcatgaaacccctgttacatatcccctagattgctcaatcaatcacgaccctttcatgtgaaatctttagtgttgtgagcccttaaaagggacagaaatggtgcacttggggagctcggattttaaggcattagcttgccaatgctcccagctgaataaagcccttccttctacaacttggtgtctgagaggttttgtctgcagctcgtcctgctacacagtaagcatttcctctgagaatcgtgttggtgttaaaaaaattttggattttggtgcatttcagattttggatttttgaattagggatactcaactgtagtagtaaaaataactagagtttaaaatctggatctattttgaaggcagaactaacaagatttgctaatgaattgcctggtggtagtgtagaagaaagggttctacacgaggaacataaaatcctgagttatggtctctcctgctactacttggtcattgatttggggacttaccccactgtaaaatggggtcacctcatcttcttgcttggagttagagagccaagtcaaatggtctctttatgtgccttcggtactaagatctataaatttgatttagtccatgcctgaaaattagcactctattacctactgttttgtattactcacatagtttcatgtaaaaattatagcttccccaccacactataaaggaggataatctaacagaccttgtctaatacttctctatgtcattcagcgttcacttatcaactaagaacaatcaatcctcaaataataactctaggtgaataatagtgttgcattcagtttgctaatacactttgtaattcttcacccccgccccttgtgggtctttaaatttagtgctaaagaacaggccccagtttcaaagggtgataaagggaagggaaagaaggaaattccaattcgatagttcctatgttgagatgtagattcattaagaaaggcttagtaaagaagatgaaagtttggcattgaagtgcaactttacaggaaaggtaagaatctgtaagatgacaaagggaatgaaaggcaccccagggagaaaaaattgcattagcttggaggagcacagtgtggaaaaataacccacctggccatatcccttcctgctcccctcaaagcttgtgaggctaacctcaaattaacaaaattacctacacagaacaggaaatgcaaatattgaagtgctcataatgtttgacgacatttttcatgtgattcacattaaagcactggaaaaactatactaattacatacaatgtacatgaataaaaaattacataaattttgaattccttgacttctataggccaagtacagaactttaacagaagtggttgctgttggtagttctttcatgttacccttaactttgcttctttttatttagatgaaatgaagtggcaaggaagagaaaaaggggaaaaaaatgacaggaaacagctatccaccttcataccaaaatacgagcagaaaaccacagttatgctgccatctaacaatggtatattctgtttaggaaactccctgatcccagaaacagccatgcaactctagacaataacgaaattacatcttacacaagctcaaaaccctcttccatagcttctaatgacatttgtttatgtttgcttttatgctttcccatgggttgttcttctgaaacaagctatgagtttcaaagatgatgatggcggtggtgatggtgggcacagacatgtaatataatttatcaggacttccagtttcagtgccataaatttgggagatgggataagagtgcttggccaattctcatcaaagagaggagaaagtggacacttttcctaaggagaacaaacgtctatcagagtaaatgattcatgcaaagcactcagccctttctctaatgacagtagctgggctcactctcaatttgtcatcaagacctcaatcatttctaagcttcttaagaggaaaaatgtaaacagctcttgaaatcacacaggtgcattcaattttgttttgtaaacctttaaaaggtgagtgtctcttgcttaatttttccagaaaaaaaaagataactactaatgataactcgtattgagatcaagtttgaaaagtgttgcttgcaaagatcacctaagatgaggaagtggaatatattatcagaaattggggatgactttgaatatctgcatgattttcccagatgctataaggtataatttgctcctgaaatcagcgttctgagggtggtaaatataaagatggttccaaaagatcctgggttccagtcacctatgaggttgccagcatctgtaatcctagaatgcaagctcccaaatgaataactgtctgtaatctgaggaatacaatcaaacagacgtgttcactcacagagtaggcccaaaagtcaaacatctacattgagataatacagctctcaaagggatcaaatgacactagagacaaatgtatcaagttgctgtggcaactgatccaaagtgtggtccagctgttaccagtctgttttcccagcatcagaggctactcactcaaggcaaaccataaaaatacctctttgctcataaaaaaagacattccctgtctcatacgccagattgttcatctcctcaggccatggtctgcctttccccatttgctcttgtcttctgctcatcagagcagaattttaggagaatcctgccaacaattacccttgggttccctaattcaacagaaaggcagattacctcaagagagcaggggagcatgtgactcatccacccacagccacacacaaactcaattatcatcttcccatccttcttctttggaccaggtgtttatactcagcctgtctgtctgggtaaatgctttcaaagtgcattcaagtgggagctgactgatttcttgtattttttttttctgtaaaacagattatgaaatatacctattaaaaagaagtagtgagggaaggtgcaggggaaaaagcatgaactccactccataaatagacctcagttaaatcctggaccaccatttactacctgtgagtacttagacaagttatcctctctctctaaagcatacttaccccatggaggaagatggtgttaatgatatttgtcttgctagagaagtacttctcaacttcatgtacatatgaaacacctgggaaatcttattaaaatacagatttctactcagtaggtccagattggggctcaagagtccccctttttagaaactcccaggtcatgcggatgctgttggtctggaccacactttaataccaaggtaggaagttctttcaaggatttaactttatataaagaagctacaacaatatttggcacatggaaggctttcaattaatgttatttcttaccttttattttcatcatcctcactcccatacagtatactacacaaaacactaatgtgcatgcaagaacttctatttctctgaggatatgcattttgagacagcaaaatagaattccaattacataaaatctccccactcttttattctaaaatgaagagagaaatggaaaagaaagatggctagattggttgggaataatggaaagtcctccctagaaagtggctgtgcttttgacggtagcagccttccagataaaaagcactgagaacttgataaaagcaactgaagacatgagaacagtaatcacatcttccatttagcttttggaaaattcttaatataacatagtttacaccattggcatggctcttgccaaggaagaaaataattcagaaataataaatgttttcatctcaagattgtgtataaaagtcaaaaatatatagagaagaaaatagccaggcgcaatgattcaggtctgtaatcccagcactttgggaggctgaggtgggcagatcacctgaggtcaggagttcgagaccagcctggccaacatggtgaaaccctgtctttactaaaaacacacacacaaaaaaatagccaggtgtggtggtgtgggcctgtaatctcagctacttgggaggctgaggcaggagaaccacttgaacctgggaagtggaggctgcagtgagctgagatcacaccagtgcactccaccctgggcgacagagaagaaaatagcaaattcaaagaggcaccactacatgaatgtgttctatggatcattttaaagattctacaacatactaaacatttagaaatgtgactttcataacaatgataattaataattataaaaaacgtattaaacacttgggattgcacatatgatgctagatgctttacatgcatcatctcatttctcttcacaataacactgtgtagtgggaactgttatgacacctaaaaacctctctcaccttgaagccttctatctagctgctccctctgcctggaacatacttccctaaggtgtctgcttagctacctccctcacttcttttacatctgtgttcagatctcaccttctaaaagatcactctattttacaaatgtaaaagctgaaattcagtgcaataaatgacttgtccaagataaatatgtattggagccagaattcaaaaccagatagtctgactccagactagtgcaatacttgtgtaacagatgaataaagaaagcaaggggctggacacagtggctcacacctgtaatcccagcacaggagggaggccaaggcgggaagactgcttgaacccagcagtttgagaccagcctaagcaacacagtgagatccctgtctacacacacacacacacacacacacacacacacacacacaataaccagccatggtggcacacacctgtcatcccagctacttgggaggctgaggtgggaggataacttaagctcaggaggttggagctacagtgaactatgattatgctactgccactacactcccgcatgggtgacagcataagacccctatctaagaaagaaagtgagacagaaaaaagaaagagagggttgtcctgtaattctagaactttgctgaggtgggaggattgcgtgagcccaggagtttgagaacagcctgggaaatttttttgtagagatatcaagacccatctctacaaacattttttaaaaaattagctggtgcagtggtgcacaactgtagttccagctactttagaggctgaggggggaggtttgcttgagcccaggagatagaggctgcagtgagctttgattgtgccactgcctgggtgacagagtaaaacgctgcctcaaagaaaaaaaaaaaaggaagtgagggctaaaccctttgaagggtagattggggatttcatgcctagtaagtctttaacaatagcccttttaacatccatacatttaacacatgccccgatataatgtatgcgatgtgcttgggaagcgttaatgagtggccagtgttattaactatgtgcaaggtcctaaaccagtttctcaaactttccctccttaggcagggagatacctgtgaacagagctggagtttgctcagactgttgttcagagttttaaatactgtatagccctccagccttactcttcaagtaaaatccagaaagatgcaactttgtttatcccatggctttgaatacttgctggacctacatctaggtctccatgaaatactgttcccttttggagagtacagccccaggcccttctagaaagaatcattacaatttcttaaggccactaccttagtcagtgagccagaagaaatcaattagctcatgaggcaggatctttctcctttggctaactgatgacctgcagtgaactaactgggcaagaatctggagaaagaaaaggaggtaaaaggactgagatatttggcagggagtgtagaggagaggattcatgtagaacactgttcactgactagggggtcactatgaggggacccctagagatctaggccatgagactctacatttagatatagagcttaggtccaagggagttagacagagagtataaagttcacttttttgctctcctgactgtgttttggattttattgtgcgtgcatagtattctctttcttaaaacaaatcactctttttgcttctttaacctgcttttagaaagttgtctttttctttctgttccattttctctctttttttttttcagctaagttccatatgtcattaatggttctctttcctccctttcccttttaaatcatctgcagcagatatttgtctagtcatagttctgtctggggcccatgagaattttctccctatggagtccttacttcctccaccaggagcacctctccctttctaccatctctttcagaagaaagaaaataagctatacttgtagaagtggtcactagagggagaaactccttgctaactaagcttcctggggtgagggattttgtttctttctattcccttgtctattcataacatctatcacagtgcctgcacatagtaggtgctcagtaactatcttttgaatgaattaataaataaaatgtaacagggttaccccacagaaccatctagtttcctcctttggctgaaatggccataggcaaaagccttgcaatatctgtagaatgtataaaaatgctcagaaatatgggctaaacatctgtatattctacagtgagacactttcataaatagagacaaattgtgagggatctagaaaaaaagaaggaaactcacattttatgagggctcaatgtattgtatgtactgagccaaacgcttttcatatgttaccttatttagtcttcatgatagttttgtgaaatggacattaaccccacttaacagatggggaaactgagctctgaaggatttatttttttctcaaggccacaaatctactaaaggtcagagggattctgaccaggcctatttgacttgaaagaccttgttgtttctaccaaaccatactatacaagagatagataatctatgctagagacagataacctctaaaaatagtggtggatttttgacaaaaaattgtgatggatttctttagcttttctttttaagcagaatttttgcttaacaagtcattctaatgtcccattacccttggaaatattcatgaatttccaatagatgctattattagagtcattttgctcacatttacttatattgtgggataattcatagctgctctttcaatgacttttgaaagtgttcatttttaggctttaaacatagctaaaaatctgaattatcaaatcgatctctttaagcctacagctgcagtatacccaccatattttgtttttctgcaacagcagaagtgaagaatgatgaatgtaagtgtggactaagaccaaagagagaaaaagtgctgacttttatataagagaaaaatgtattgaaaattagatgacttgaaactatgactttcagtataaagggcaggaattttctaaaggccaattccccaggacaatttttcttacatttttcccccatccacatgtcagagaagaagctactgaagaaagtttaatgccaaaaaatgtgatgatggatgtattctgagaaatcagatccaggcagccatcttctatggtactggtgctcaagctttaatgcacatcagaatcacctggagggtgattaaaatagactgcagggtcccattcccgaagtttatggggcctgaaaatctgcatttctcacaggttctcaggtgatgctgatctagaaactacacttagagtgtgctccatggagtttaagcacccaggggttattgtgctgagtcaggtggctccagggcagtagtagttcagactcacctaatgaacttcttaaaaatactgatgtctggatcacacagccagaaattttgttttgttttttacttcttttggtctctggtggaggttcttaaaaatttttttggtctctggtgggagctaggcactgggaacatctgagtttggctaactcgataaatattaaaaattaatttcatattttttggagataaaattgtaatttgccttattaaaaataatcctagagagagaaaaaaatgcagaaagtaggatttcaggttaaaatggtggtttaagtacaggcatttactaaagctgtctccctaaacaccaccaaaacaatagtaacagaaccaaaacaaacaaacaaacaaaaaacccagggcattagctcacaaggtctaaaagaattgggcaagaaaaacagcaataaaaatgttggtattagaaaacagaaggaagagtggtaactatcttagctgaccagagaaagttgaattatatacctgtggtgagggaagtctaaaagttgctgattcttgtgacagaaccccacaaaatctcaggagctggaaataccatgtgtctttgagaatgaggggatgcatggagtgaaacaggagaaatgaaaggcaattagacctgcagattcccatcctcactctacatcagcagttctccagggaatggtccagggacttttggaggtctctaagaccccttcagtagtccttgagatcaaaactattttcataacaataccaagacattatttgcctttttcattctcacctctcatgagtgcacagcggcattttccagagtccatatgacatgtgacaatgtcattgctctgacaattaatggaatgtatgcttgtatatccttgttttctaggcttttttaaggtatggttttggagtatatgtatatatgttttcaaaggtcgactcagtttgctctcaatactttctactgtgttttttttaaaataagctatttttatacctgctataaccagtataagctcataaacatccaataagttattattttgaagtcctaatgtttttcttgtgcctacatggaaataagaacactttgtgggattattttagttttcgttttctgagaaatagggtcttgctctgttgcccaggatggagtgcagtggtgtgatcatagctcactatataacctccaacttctgggctcaagaggtcctcttgcctcagtgtcctgtgtagctagaactacatgcacgccaccacacccggctaattttttttttattgtttttgtaaagatgggctactctcaaaccccttgactcaagaaattctcctgccacagcctcctaaagtgctggaattacaggcatgagccactgggcccagccatgttattctgttttccaataacattgaaacattttttgaaaactgatttttaaatttagaaaagcatcttagagggtaagttattgtgctgcattgactggaaaaatacacacagtagctcagagattaaaagagctttgtacagttgatattgctgaatgcccattggatgaaaagttattaaaataaatcatacccagtggcacttcccaacaattcaataacttgttaaatgaaatatttagttgcaaacatgaagacaaagttactatcttgttagtaaaagtgtacttttccttacaaatggataaatctatagacatagtttttttttcttgtatctatccagtatcagcactatcattgatcaagatcatttatgtgaatgcttggaaataaatacaagtgatgatgaaatatataaagtgttaaatcatttatttgactctcatggtttgtattggaaaaactatgttaacatttggactgactgtttaaagcaacagtgggtaaaactgcaggtaccttagcacaaatcaagtcaggaacatcaaactgtactggtggtcattgtcacatacttggaataaaacaaaaatgtcactttcacttaagaatgtccttgataaagtaattaaagttaattttattgagtacacatataaaaaaattctgtgtaactaaatgggaaatacacatactttgctccattagcaaaatatggttgttgtcttgaggaaaagcacttgtatgattgagctgcaaactgaattggtcatttgttatttttatttttttgagacaggatctcactctgtcatccaggttggagatcagaggcatgatctcggctcactgtaacctccgcctcctgggctcaagcaatcctcctatctcagcccccagaataactgggactacaggtgcatgccaccacgcccagctattttttgtatttttagtagagacagggtttctctactaagagatgttggccaggctggtctcaaacacctgggctcaagtgatccacccacctcagccttccaaagtgctggggttacaggtgtgagccaccatgcctgtccctgaattggtcattttttttttaatggaataactttttcacttgaaacaattaaagacaaattatttagagttaggcttttgaaagatactttctcaaaaatgaacaaagtgagcttgtcgagaaaaacatctgataaaacctgtggctgattataaaatttgagctgttaagtgaaaattaaaattttcaaaaatttgtatctgccaccgtgaacttgtcagcttttcaaaacttcaagacttctgactagataagtggtgataccagtgaatgtgatttaaaaaaatattttataatgaaatgcatcaacatttggaacatctttataactcataactggttttgtaatattttccaaatgaccaattcatgatgttataaaatcatgcatgggtaaaaggtctattccaagtacaagaccaatggaatttgatacattacaacatgaaaagttcatgcacatggtttaatagtccacattgtaactaacttttaagaaactatcacttgttgaattttgttatagtatatgagaacagctacaattacctgaaaaggatattcaaatacacctcttttttccagctacctctctctatgaggtcaaattttcttcatattcttaaaccaaccaaaatgacacatttctacagaatgcaaaagatatgggaatccacgtgtcttcaattaagtcagatattgaatagatttgtgagaatataaaataatgtcactcttgtaactaattgttctggttttggaaaatatactttccacaagaatatttatgttaaaatgtaatgggcttattatttttaagtaaataaatattttaaaatgtgttttaattgtaatacagatgctccttgacttactgtggggttatgtcataataaacctattgtaaattcaaaataccacgtgcatttaatgcacctaatctacctgacatagtttggatgtccccttcaaatctcctcttgaaatgtaatactcagtgttggagttggggcctggtgggaggtgactggatcatgggggcggatttctcatgaatggtttagcaccatctccttggtgctatccttgtgatggttagggatttctcccaagatctggttgttgaaaagtgtgtggcactctccccttctctgtctcttgtttctgctgtcatcatgtgatgtgtgtgctcccactttgctttccaccatgagtgaaagttccctgagtcctcccagaagtgagcagatgccagcacaatgcttgtacaacctgcagaactgttagccaattaaacctcttttctttataagttactctgtctcaggtgtttatggcaatataagaacagccaaacacacaaccaaacatcataccataccttaacctaccttaaatgtgcttgtgacacctatgttagcctagagttgggcaaaatcatctggtaacacaatacagagtattggttgcttaccctcatgatcaggtggctgactggcagctgtggctcactgccccttcccaccatagtgagaggatatcatactacatatcattaggccaggaaaagatcaaaatttgaaatttgaagtatattttctactgaatgcatatcactttcacaccatggtaaagtcacaaagctgtgtcaagccgttgtaagttgggacccatttatatagtctataaacatgatccacataaacaaaagtgatttggagtccttaatatttttaaagagtgaaaagggtcctgagacaaaaaagttgggaaaccacttccctatgtagttaacaaactgcctcatttccaagaaagcagagtgctagagactgaactacagtcaggaccatcaagcacagtgaaggcagagggtaatcacaatgaaacctagaggattatgtgaaaggctatattctaagcaataagacatccagccctttctctcagatgtcagtatgctagaagatttatacttccaaaatggtagaatagagaattcttctctggaacaactaaatatcccaagagaaaagatgaacagatatggacagttaagaatcccctaatgacctaatcaaatcaccttatgtagactgttactagttaaaaagaaatgtctataaacaaaatcatccaatcacctttttatgtctctctcctaaataagagtagagattcagggaccatcagatatttgaggaaaaggtttaaagtcaaagccagggagtaagacaaatagggagaagagggaaggacatagaggaaataacagtaattcagggaccatgaaaaaaaaacaaactacctactggaaaagcaaagaaagcaactgagtggagaaaagaaaaaaagaggaaagaaagaaaaaagaaaaaataggaaaagaagataaataaaactaaaattgatatcttcagagagaaaatagaaggcattgcatccaaaaacaagaaaacaagctataaaagggacattttgaggaataaaaaagagcttttggaaattagaatatgatagcaacatgtaagtttcaacagaaaatttagatgattaaggaggtttatcagaaaagagaggaaaagtaaagaagagaaaatatataaaaattagagtactgtttgaggaattccaatatctgactaataaaaatttcagaaggaatgcacaaaaaaggaaagaatgacattatcaaagaaaaaattaacatgaaaatttccctaaactgaagggcactaatttcagattgacagggtctaaccacatacctagcgaacagaataaaaagagagccaaataaaagatcactaggaacagggagaagatcttaaaagtatcaagacagaaaaaaagcaggaccaagaaaaggattggaaattttaaaaggtactggatttctcaatagttaaaggaaaactaagatgaaatggaacaaaaggatcaaaatctgagggaaatctatgtgcatccaaaatataaatcaaactctactacagggtctcaacgtgttgacctctcatttatcttttctcaggaagttcttggaagaaatgcttcaccaaaatgagggagtaaacctcaaaaagggcacaaatccaacaaataagagtcaaaaagaatccccaggataatggtgaagggcactcccaggacaacagctgttcaggaaacacggcaatcaacccgtccagatgggaacagaaggagggatggctccaggagcagatatctccaaggagaagatgaaactgatggttacctgaggtgtctgcatatagaaacaggagatttactactctggtacagtttagggatgaatttagaatagattaataggaagctaagcaaataaaaatagagatagttaataaataactccagggtaaacaaaagttgtgaaagaaagaaaatgtcatcatagcataccacatgtccctgctgtgaataatatttacatagtaacaaaaatgtaaaccataaattctgaccaatatttaagatataaactcttggaggatgagaaaagtatgtaaataagtaagtttgggtatatgaatggttaggaggtatgagagctaaattctcatcttccataggagcatcagactgttacttagaaacatgaaagcagatgtcagaagtgcctaacactgtgaaggttgcttctggagtggggaaatttggagtgggaagggaggagctgggcactgatgattttaaaattataaacaaaaatgtattagaagctcattaccaaaaaaaaggaagctacagaaaagtaaaaataagaaaaaagattccctatacttcctacatccaaggattaacactcctaacaaaattatttcccatttatgtttgtcatatatatttcaaagcaatatattatttcataatagataagtatatttgtttaggtgtaataggttaggttctttacccatattttattagaaaaaatttcaaagtgggaagaattgtatagggaacatcatctatcctctactaggttctgcatttaacagtttactgtacttgtttttcataaatatatcagtctgtctatccttctatacatccattgatccattgtatgttttgaggcatttcaaaataagttgctgactttggtacacttcatcctgaacacgtcatcaggcaaaccactaatcagagtttaatatctatttatggttctttttcttatgcaattttacatatgatgagatacatgaatcttaagcatatcatttgataaattttgattaaatgcatactcctgcataacacaaaaccctatcaaaatgcgggacattgcaatcactccagaaaattccctcatgccctttccttctcaatttgtatccctaccccgacactcactaaagcaatgcactgattttaaaaatttattccaaaacctcacataactgaaataatagaaatgtgcttttttataaggctttttcactcagcatattgagattcatccatgttgtggcacatatcattagtttatttctttatcttgctgagtagtatccctttgtatgactatacaatgatttgtttatccattctccttctgatgaacacctgggcttttacaaatttttgcctattaagaataaaactgctataaacatcttgtaaaagttttttttggtggcatatgttttcatttcctttgggtaaataactagaagtggaactgctttgtcataggacaggcatatacttagttatataagaaactgccagattttccaaaatgaaccagatattgcaggattttaagaattttaaatcttatatcacttttgtaagttgtatttttcaaagaatttatctactttgtcaaatttgttggtataaagctgttcatagtaatcccttgagtatttttaatgtctgtgcaatctgtagtaagaatccctctttcattcttgatacttgcaattttgtactttacttctcattctttctctgtttctctgtctagggtttttcacatttgttaatctactcatagaaacattctggttttgtaaattttctctaccacttgtctaacttctgctttattgatttctgcttatatctttatttccttcattttacttagtttgtgcttagtttgttcttttaatagcttcttcagatagaaatggagatcattgcttgtaagtgtttcttttctcacataagcatattagactataaatttctctccaagttctgcttttgctggattccacaaattttgatatattgtattttcataatcatttcaaaatagttttctaccttttctcatgatttcttctttgattcataggttatttatttatttagagatgggatcttgctctgtcaccaaggctaggttgcagtggcatgatcatagctcactgtagcctcaaactcctggattcaagggaccctcctacctcagccttctaagtacctgggactacaggcacaagccaccatgcccagcaaattttttaaaattctccttagagatggaagtctcgctatgttgctcaggttggcctcaaactccttgcctcaagtgatcctcccattgcagcctcccaagtagctgggattacaggcacatatattattttgaagtgtgttatttatttccaaatatttaggcattttatagatatttttgttactaatacctaacttagtttctttgtcatcccaaaccatactctgcattatttcaattgtttcaaatttattgagacttgttttacagttgagcatatggtccaacttggttaatgttctatgtacacttgaaaaaaatgtggttcaactgcattctgtaaatgtgaattgtcagtctgtttgacagtgttattaaaatctgctatatccttactgtatttattttaatctagtcctgttaattactgaaagaagtgtttctaaatttccaactatgatagtggatttttctatttttttctccttttgttgttattttttttctttgtatattttgaatctctgttcttcagtactgtatttgattgctgctctaaacaaatcatcacaaacagtagcttaaagcaatccaaatttattctcttatagttccacaggttagaaatcaatatgggtctcactggcctaaaatcaaagtatgtggaaggctatctttcttttggagatgctaagggaaaattcatattcttgccttttctggcttctatgggatacctgcaatcattggctcttgttcctcttcctctatcttcaaatccagcaattgtaggtcaagtcctgctaacactgcatttctccaacctcctctctattaaaactccctatgcctcctctttatgccttcctcttctactcttgtggttatattgggtccctctggatattccagaataagctccttactttaaagtcagatgattagcaactaattccatctgcaaccttaattcccctttgccatataatgtaacatatttacaggttctagagattagaatgcagatatctttgggggaggttgggggaggttcattattctgcctatcacaggacaatacatttacgattattatgtcttcctgatgaattgatccttgtattgctatgaataatctccttttctctggtaatcctcctttttttgaagcctactttgcctgaaattaatatagcctcaccagctttttatgataactgcttgcatgacatattattctcatccttttattttcaatctgtgtctttatatttaaagtgtgtctcttgtaggcagaatataattgagtcttctatagcatccagtctgacaatctttgccttttaattacactgtttaggacatttacacttagtataattattgatataatcatggttcagtctatcattttgctatttgatttttttcccatttattttttgttcctctctttctccttgcttttttgaggttaattcagtatttcttattttaatcctaatatggcttttcggctatactttttgtcattatttttaaagggactgctgtagtaatataattttcacccttgcttatcagtcttctcagagtaagtattgtactacttatataaaagaatgttgtaacactataattccatttactgactcctctttttctcatcctttgtggtattattgccatgtatttttacatctacatatgttatcaaccccataatacaatttatatttttgcatgaatcattattttgtaaataaattggggaaaaagtagccttttatatttagccacaaatgtaccatttccaatgctcttcattattttttgagatccaagtttccttctggtgctactgtctttctgtctgaagaatttcctttagcatttctttttttttttcttttttttttttttttgaggcagaatcttgctctgttgcccaggctggagtgcaatgatactatctcggctaactgcaacctccgcctctcgggttcaagtgattctcctgtctcagcctcctgagtagctgggattacaggtacttgccaccagcccggctgatatttggattttttagtagagacagggtttcaccatgtttatcaggctggtcttgaactcctgacctcaggtgatccacctgtctcagcctcccaaagtgttgggattacaggcatgagtcaccgtgcctggtctcctttagtatttcttgcgacacagatctactggctttcattgataaaaaaaagtctttatttaattttcatttttgaagaatatttttgctggatatagaattctggctttacattttttttttctttatcattttaagaatattgttctgttgtattctgtcctccattgtttctgatgtcaaataagtcatccttttccctatatatgaagtgttatttttgtctgaatgctttaaagatttttacgttatttttgttctcagcagtttgagtataatgtgcccagataaaattttctttgtatttctccatcttagggtttacctagcttcctgaatctgtaaattaatattttccaccaaaattgggagaagttcagctttgatttaaaaaaaaaatttctgccacattttctttttcctgttcgtctgaactctaattgtgcatatgttaggctatttggtattagcaatgaggtcactgacactttgttcatttttttccgctactttttcctttctcttctttaagttgtataatttctgttgctcagtatgcaagtttactctttcttctgtggtttccaatctcttgacaagcccatccaatgagtttccatttcagatactcttcttttcacttcaagaattccatttggttcttttttatagtttccatttcactgctgatatttctccaggctaatatttctcaatatggatattttccccataactctatgaatatataatatgagttataatagcttctttaaaatccttgtcagctaattctaatacctgggtcatctcaaggtttctatttattgcttatcctcttcatcatggtcatattttcctgtttctttgcatgtctggtaattttttttattgtatgtagcatagtgtggatgatatactacagagatagaagaatgctgattttgaatctagcaggaagttaaatgaatgactgatcttcttgttcttgtgaaggcatcagtttatgatttttttggacaagtctgttttggttatatttgagtcttagagcaaatccttagtcttgagacagactttacacctaaggcataactcttttagatttcactggataaaaacaaggtgtttatcaagtccttctaaatttgtgacattcaaattccaacctctgtctctcatgtgacaaatggcagctgaaatctctgttcaactttttcagacttccagctgtttcttttcactaggctccttggaatgtctcatgaatatatacatttcagggatcagacaaagatgtgagggaagtttatatgcatattttgtatttttaccttggagttccttctttttgagatttctaccctcaatttccagcctttgactccttctccttgacacttcaagccaatatgagcatgcatttctgtttgagttctagttacctcccgatgcatgaattgttaaataactacagagaaggccgggtgtggtggctcatgcctgtaatcccagcactttgggaggccaaggcgggtggatcacgaggtcaggagatcaagaccatcctggctaacatggtgaaaccccatctctaataaacatgcaaaaaaattagcctggcgtggtggtgggtacctgtagtcccagctactcgggaggctgaggcaggagaatggcatgaactgggaggtggagcttgcagtgagccaagatcgtgccattgcactccagcctgggtgacagagcgagactccatctcaaaataaataaataaaaataataataataactgcagtgaaaaagtcaaataaaagtagatctcatgcagtactgttcacttctttcaaaggttgaatactttcctttggtttctgccttttttggtcataagccagtggttttttttttaatactttatattttatcattgctctctatataagggttattatgatacaagctactccactatacttgtaattatactttcatcttaataactttttctgggttttctaaatgggttggtgggcaggaccaattattaagtcatatattttggtccacaaaatatagcaaacccaagaatatgcttccaaatcaaaatagtcaaactacagagatctgtttattcatgacttcagacttagaatttgggctgttcaagctccaagctcaacatcccaatactgaattgattcttctggccatccatatgtagtgacaaatgacaaattctatgttagtctcccccagcctttttttactaacaatgtccctcaatttctttacattattaggacatcttcacctcagtatttctcaggattgaagaaacgtggcatttggctttaattttcatgaagtcctcctggccagaattgcctgggattcttccatgacttttccaagtcttcactgaaaactatggctggaaaggataaattgtagattccaggtgctatttgtcctctaatgaatgctgatcctggagccaaaagaaatacaaccccctgcttgctttttagggtatttttggagtagttgcaaacagtgatatttatctggagatatggccaatattttttaagtagtcaataaacaaaatgtatttattaaaaatgtatttttgcatcataaaaataatactgtgctcatttcattccatttgtgccaggaagagtacttgaatagaaaagaaaagctttctcttatccctctctgtcagccataataattaaagccatacattcttagccaataatatttttatgctgatatcattatctttctccacaaatcctataaattcttaaaggttcagcctttatactacgttatccagatagcctttttggtgaggacactgaacagagtttcagtaaagggacattatcttgttatcaaagcagtagtagttaagacaataacccttggagtgagacagacacaactttaagtccaacattttccactttctgtgtaatctttggattttctacaatttcctctaagttaaagtaaaatagagataaaaatagtccctaactcatttggttgttgtgaggatcagatacaataaggcatataaagtttaagaacagttcctggtacattgttatttttattgtcattgttattttttccacatagtaaatgcctaataaactattgtctaaataagtacttggtgaattgaataagtgccattatggtagaagagaaaaacaaacaaattacaaaaacaagtcataaggaaaaaagtaattataaattattataagtgctattaaaaaagaactaagaaaaagaatgaaatgggggacctgtttttggatagaatcatcagggaaggcctctccaggaaatgacatgtaaggtgagacttaaaagatgaaaaggagctggccacacgaagagtagggagaacagcatttcaggcagaaggactagcatatacagagatccagaggcagatatgcacatggacctgaaagaactgaaagaccactagttagctgggacagaataagggcagagtggcaccagatgaaatcagaaagtagcagaggccaaacacaaaaggccagtgtggagagtttggcttttgctccaagtgcaaaggagagacattgtgggttttcaagcaagggaatgacaagatcctctagcttactcaatccatgactcacacaaacaaacttaaggccgggcgcggtggctcacgcctgtaatcccagcactttgggaggccgaggtgggtggatcacgaggtcaggagatcaagaccatcctggctaacatggtgaaaccccgtctctactaaaaaatacaaaaaattagccgggcatgggggcgggcgcctgtagtcccagctactcgggaggctgagacaggagattggcgtgaacccaggaggtggagcttgcagtgagccgagatcgcgccactgcactccagcctgggcgacagagcgagactctgtctcaaacaaacaaacaaacaaacaaactgaagaagaataagaatttctgaaaatatttggaacttgttttttagggaacttagtataaatgtagactgaaatatttcccattatgattgaagttattgattgccagcaaacaaaaacactttaggtggggaacttttcttcagagggagaagcaatcttaataaagatttaatccacttcattttctttcacatctgtaatgaatccacagtggatagtgtgacccacttcaaacagaggatagacagaaggagtacatacgctaggcaggaagggttagagtaattgagaaagagggccattgccaaggcctatgagggccctgagtaaaagcacagtctgagttgagagcaccacattagacaagagatgatttggaagatattgtgaaatagatttctcagagaaaagaagaacaggattccagtatacaattagtgagacattgactgttaagggctggaccttctggtacaaatgccctaagggaacttatagaatatttaaatttatttatcagataattgtatttttcattatcctgcagtaacaggtcttttccattgtaagattcttcctgcaatgttggagtttattccctttcttgaagctgcttcatcttgatactctttttttaaaaaaaagctgcttcattttagagactcacttggcaataattaagaccactgacattaatataacaaaatgtttctattttcccatgatatattgagcaattaaaattattgcctgtcttatacaaggaaatttattcccaaaggaaaagcctatgggaaaacagtggcatgctcagatccccattacctgttcactgatgacagattaatttaaaagggtacataatagctgaaatctccaaaatgcgttagttgttttcttaaatttttctgaaaacaaccaaacaaaattatagtactatgagacagtatgtgccataaaaacaactttggagttactttcaaattttttcctggaggatgaaggatagcttattaaatgtcagttatgaacttagtgacaactaattatctttcatttcacagcagctgataataagtaagagcaaaaatggtgaatacctactgttgccaggtaactgcatctactgtacttcctgccaccttcatgaatctgtaaggaatagaaagaaaaaagatattacaacttagattaaaccacatcccctaaatcaaaaggaaataaactgagacagattagaccaatccttaagcaggtatgctttctgagaggatcctccatagccacaatcatggcctagacacagctattggaggtcaaactatacagaaagtgaaagtaaccatacttccagctccccacacatccctcaccatctggaaatcaaaatcccaataaggcattctatctacatctgtcttcccaagcccacgcctgatgactcccacatcaatttcctcataaccaaaacttgtctgtcccatttcctattctctaaggactccaatctctgctaggaaacaaacagtaatatttcccaaggatgacagcacaaaagatgcctttgaaaaacttcaggctttcctagagcgagcatgggaaaacccagtttatttatacaagtaaaaagtaccatcaaatatgccccagtgagaggctgccacatctgtctcagtgtagaaagttgagcagcacaaagagaaatctatcatctacttttggagcagctaaatagagtactgagtgttatctgacaatcatgctcagctcaaaaggtaaaccagacttggttccgtgcagttaagcacacatcaaagccttgccagcagttccccagcttctgtgtttctggaggcttcaggaaaatcaataggccaagaagatgcatctgggggcccaaagatgacacagggtctctcataaattgcatgtttgtgaataactcaattacctatctccttctccctatccacatgttctgaggccatgtgctatcatggttataactactagttgagggagtcattacccaggcacaggaaaccaaaaggagtatctcagctctttaagacattcctttcagtccggacaccctggtggggaacttttcttcagagggagaagcaatctttaatggtacttcttaactgaagaattcttcctccagggagaaggatggtgttttgtctagaaggccctatctctactttaccccagcataatcttgcaaggcagatgcatgttgctcatgctgtgtgggttgctgtgtattgcctaaacagaggctctgatttgctgtgacagcagaagagaattgagtttctctggaggagtacataagagaaacatagggctggatgccaggactgttggttagcattaaagtgaagtttataaaaggagaggaaaagaagaaggggaaggacaggatgggtctgagaaagggggaagaaagagagaaggaagaggaggaggaggagaaggaggacgaggacggaggatgagaaggccacagaagccctggcttggcctttggctgaacggttttgcctttctttctccagtacgattcagcagtcctcaagcaagaaagtagaaaatgacacatgggaatgatcgaggaatagaactggtttgatgggcagggccaaaatgtcaacgtgggctggagggaatgtaacatttactacgtacctactgagtgccagccattcacatgttatttcttataattcttaaaaatgccttgcttggtaaggtggatattgtcagttccattatatagattaccagcttccctattgcctagagaagtacatctcctaacactccaaatagccaatttttgatggagtcatgccaccccccctagcagcagtcattgggaagcatggcacagatatcctctgcttttgaagcccatggatttctcttcctctttatctcatctcctttccccagcccaggacaatctcttttgggtttgggagagtagctccaatctcctcactatttctggccctatgcctctaaaattcctcttctggaattctaaagccagaaagactcatgcagtatttgccttttcctcctgtcacgtgctatcctgtcataggcacacaaccagctcttaaatgaatagaaggaaaattgaaaaatacaaggagaaagaaaacagattaatattcaaaatattatccctgccatctatgccactctaagcagggaagatctgataataatcttagaagtaggatggcccaagaataaagaggaagagatgaaattttgtacctccttctcagatattccaaaaattaaaaaacctagacaatcttagacacaaatgtcatttcaaagaaagaaatgtaaaaacaaatgtttacatggaatttacttctccaaaataatttctaaaatctctgaaatagaaatattttatgtagggacagggccaagatagccaactagaagcagagatgatcagaggctcccataaaaaaaaaaaaaaaaaaaaaaaaaaccataatagcgagccaatcctgcaccaacaaccaaggtattcagtttctgtcatcagaactgactaggcagctggcgtgacccacagagaggaaggaagagcagtgtggtgctgcagcccacctgagagccacacagggcagggaagccccgatcctcagtcaggaaaggcagtcagtgagtgtgctacccagcctgggaaaatgtgctttttccatggaactgtgtaaacccatggattggaagatcccatttataagcccacaccactggggcgagggtcccaaccatggaatgcgtagattctcaacagccactaagctagagtctgcttaagcctgctgacctcccaggaggaggggtgaccagcaccacagctgtggctccctgctgtctaagcctttgagctccttaggggaggggcgacagccaactctgggacccatagctgcctaacacactaagctcccagggtgggggaaggccggcagccatctctacaactccaggctgtgcttttcccctgctggagccatgaatagggcctgaactgaacccccagtgaaccgcagcagccctatagaacagggacctgaccactgcaagaaaaacaaacaaacagaagcaaaaacaacagcatcaacaaaaaaatgtcccacaaaaaccccatccaagggtcagcagcctcaaagattgatagtagacaaactcatgaagatgagaaagaagcagtgaaaaaaaaacactggaaacccaaaaggccagagtgcctcttctcctctaaatgatcacagtgcctctccagcaagggcacagaactggacagaggatgcgatggatgaattgacagaagtaggcttcattcagaaggtgggtaacaacaaactccgctgagctcaaggagcatgttctaacccagtgcaaagaagctaagaatcttgattaaagggtacaggagctgctaactaccataagcagtttcgagaggaacataaataacttgaaggagctgaaaaacacagcatgagaacgttgtgaagtatacacaagcatcaacagccaaatcaaccaagtggaagaaagaatatcagagtttgaagaccatcttgctgaaataaggcatgcagacaagaatagagaaaaaagaatgaaaaggaatgaacaaaccctctgggaaatatgggactatgtaaaaagaccaaacatatgactgactggagtacctgaaagagacggggaaaatgaaaccaagttggaaaacacacttcaggatattatccagaaaaacttcctcaacctagcaagataggccaacattcaaattcaggaaatacagagaaccgcactaagataatctacaagaagatcaaccccaagacacgtaatgatcagattcctcaaggtcaaaatgaaggaaaaaatgttaagggcagccagagagaaaggccaggtcacctacaaagggactacaatcagactaacagtggtcctctcagcagaaaccctgcaagccagaagagagtgggggccaatattcaacattcttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagatcagaaattataacaaactgtctctcagaccacagtgcaatcaaactagaactcaggattaagaaactcactcaaaaccactcaattacatggaaactgaacaacctgctcctgaatgactactgggtacataacgaaatgaaggcagaaataaagatgttctttgaaaccaacgagaacaaagacacaacataccagaatctctgggacacattcaaagcagtgtgaagagggaaatttatagcactaaatgcccacaagagaaagcgggaaagatccaaaattgacaccctaacatcccaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttctgaaaggatcaacaaaactgatagactgctagcaagactaataaagaagaaaagagagaagaatcaaatagatgcaataaaaaatgataaaggggatatcaccaccaatcccacagaaatacaaactaccatcagagactactacaaacacctctacacaaataaactagaaaatctagaagaaatggataaattcctccacacatacaccctcccaagactaaaccaggaagaagttgactctctgaatagaccaataacaggctctgaaattgtggcaataatcaatagcttaccaaacaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaaaagagaattttagaccaatatccttgatgaacatcgatgtaaaaatcctcaataaaatactggcaaaccgaatccagcagcacatcaaaaagcttatccaccataatcaagtgggcttcatccctgggatgcaaggctggttcaatatacgcaaatcaataaatgtaatccagcatataaacagaaccaaagacaaaaaccacatgattttctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagagatgccctctctcaccactcctattcaacatagtgttggaagttctggccagggcaattaggcaggagaaggaaataaagggtattcaattaggaaaaggggaagtcaaattgtccctgtttgcagatgacatgattgtatatctagaaaatcccgttgtctcagcccaaaatctccttaagctgataagcaacttcagcaaagtctcaggatacaaaatcaatgtacaaaaatcacaagcattcttatacaccaataacagacaaacagagagccaaatcatcagtgaactcccattcacaattgcttcaaagagaataaaatacctaggaatccaacttacaagggatgtgaaggacctcttcaaggagaactacaaaccactgctcagtgaaataaaagaggatgcaaacgaatggaagaacattccatgctcatgggtaggaagaatcgatatcatgaaaatggccatactgcccaaggtaatttatagattcaatgccatccccatcaagctaccaatgactttcttcacagaattggaaaaaaactactttaaagttcatatggaaccaaaaaagagcctgcatcaccaagtcaatcctaagccaaaagaataaagctggaggcatcatgctacctgacttcaaactatactacaaggctacagtaaccaaaacagcatggtactggtaccaaaacagagacatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaattaattcaagatggattaaagacttaaacattagacctaaaaccataaaaaccctggaagaaaacctaggcattactatccaggacataggcatgggcaaggacttcatgtctaaaacaccaaaagcaatggcaacaaaagccaaaattgacaaatgggatctaattaaactaaagagcttctgcacagcaaaagaaactactatcagagtgaacaggcaacctacaaaatgggagaaaatttttgcaacctactcatctgacaaagggctaatatccagaatctacaatgaactcaaacaaatttacaagaaaaaaacaaacaaccccatcaacaagtgggcgaaggacatgaacagacacttctcaagacattcatgcagccaaaaaacacatgaaaaaatgctcaccatcactggccatcagagaaatgcaaatcaaaaccacaatgagataccatctcacaccagttagaatggcgatcattaaaaagtccggaaacaacaggtgctggagaggatgtggagaaataggaacacttttacactgttggtgggactgtcaactagttcaaccattgtggaagtcagtgtggcgattcctcagggatctagaactagaaataccatttgacccagccatcccattactgggtatatacccaaaggactataaatcatgctgctataaagacacatgcacacgtatgtttactgcggcactattcacaatagcaaagacttggaaccaacccaaatgtccaacaatgatagactggattaagaaaatgtggcacatatacaccatggaatactatgcagccataaaacacgatgagttcatgtccttcgtagggacatggatgaaattggaaatcatcattctcagtaaactatcgcaagaacaaaaaaccaaacaccaaatattctcactcataggtgggaactgaacaatgagaacacatggacacaggaaggggaacatcacactctggggactgttgtggggtggggggaggggggagggatagctttaggagatatacctaatgctaaatgatgagtcaatgggtgcagcacaccagcatggcacatgtatacatatgtaactaacctgcacattgtgcacatgtaccctaaaacttaaagtataataataataaaataaaataaaataaaatgaaaatagttttaaacccagaatttcaaatccagccaaactaagcttcataaatgaaggagaaataaaatcatttccagacaagcaaatgctgagggattttgtcaccaccagcctgccttgcaagagctcctaaaggaagcactaaatatgtaaaggaaaaaaccagtaccagccactgcaaaaacataccaaaatataaagaccaatgacactatgaagaagctgcatcaacaagtgtgcaaaataaccagatagcatcatgatggcaggatcaaatttacacataacaatattaaccttaaatgtaaatgggctaaatgccccaataaaagacacaggctgtcaaattggataaagagtcaagacccattggtgtgctgtattcaggaggcccatctcatgtgcaaagacacacacaggctcaaaataaagggatggaggaatatttaccaagcaaatggaacactcacacaaaaagcaggggttgcaatcctagtctctaatgaaacagactttaaaccaacagagatcaaaaaagacaaagaagggcattacataatgttaaaggaatcgattcaacaagaagagccaactatcctaaatataaatgcacccaatacagaagcacccagattcataatacaagttcttagagacctataaagagacttagactcccacataataatagtgggagactttaacaccccactgtcaatattagacagatcaacgagacagaaaattaacaaggatattcaggacttaaactcagctctggatcaagtggccctaatagacatctacagaactctccaccacaagtcaaccacatggcacttattctaaaatcaaccacacaattggaagtaaaacacttctcagcaaatgcaaaagaatggaaatcataacagtctctcagaccacagtgcaatcaaattagaactcaggattaagaaactcactcagaaatcacacaaccacttggaatttgaacaacctgctcctgaatgactcctgagtaaataattaaactaaggaagaaataaagaagttcttttaaaccaatgaaaacagagacgagacaacgtaccagaatctctgggacacagctagagcagagggaaatttacagcactaaatgccaacatcagaaagctggaaagatgtcaaatcaacaccctaacatcacagttaaaagagctagagaagcaagagccaacaaatccaaaagctagcagaagagaagaaataactaagatcagagcagaattgaaggagatagatgcatgaaaaacccttcaagaaaaaaaacaatgaatccaggagctggtttttagtaaaaattaacaaaatagatagactgctaactagactaataaagaagaaaagagagaagaatcaaacagacacaataaaaaatgataaaggagatatcaccacttaccccacagaaatacaaactaccatcagaaaatgctataaacacctctacacaaacaaacttgaaaatctagaagtggatacattcctggaaacatataccctcccaagactaaaccaggaagaagttgaatccctgaataaaccaatagcaagtactgaaatttaggcagtaattaatagcctaccaaccaaaaaaggtctaggaccagacagatcacagctgaattctaccagaggtacaaagaagagctggtaccagtccttctgaaactattccaaacaattgaaaaggagggactcctccctagctcattttatgaggccagcatcatcctgataccagaacctggcagagacacaacaaaaaaaagaaaacttcaggccaatatcgaagcaaaaatcctcaataaaatgctggcaaactaaatccagcagcacatcaagaaacttatccaccgtgatcaagtcggcttcatccctgggatgcagggctggttcaacatatgcaagtcaataaacataatccatcacataaacagaaccactgacaaaaatcacatgataatctcaatagatgcagaaaacccctttgataaaaatcaacatctcttcatgttagaaactctcaataaaataggtattcatggaacatatctcaaaataatgagctatgtgtgacaaacctacagccaatatcatactgaatgggcaaaagctggaagcattgcctttgaaaactggccaagacaaggatgccgtctctcaccactcctattcaacatagtattggaaattctggacagacaatcagacaagagaaagaaataaagagtattcaaataggaagagaggaagtcaagtagtctctgtttgcagaagacatgattctgtatttagaaaaccccatcatctcagcccaaaaactccttaagctgataaacaacttcagcaaagtctcaggagacaaaatcaaagtgcaaaaatcacaagcattcctatacaccaatagacaaacagccaaatcatgaatgaactcctattcgcaattgctacaaagagaataaaatacctagggatacagctaacaagggatgtgaaggactcttcaaggagaactacaaaccactgctcaagaaaatcagaggacacaaacaaatggaaaaacattccatcctcatggataggaagaatcaataccgtgaaaatggccacactgcccaaagtaatttacagattcaatgctattcccatcaaactaccattgacatttttcacagagttagaaaaaactactttaaatttcatatggaacaaaaaaaaaaaagcccagatagccaagacaatcctaagcaaaaagaaggaagctagaggcatcatgctacctgacttcaaactatactacaaggctacagtatttaaaacagcatggtacttgtcccaaaacagacataaagaccaatggaacagaacagagacctcagatataacaccacacatctacaatcatctgatcttcgacaaactggacaaaacaaacaatggagaaaggattccctatttaatatattgtgctgggaaaactggctagccatatgcggaaaactgaaacttgacctcttccttacaccttatacaaacattaactcaagatggattaaagacttaaatgtaaaaccccaaaccataagaaccctagaagaaaacctaggcaatatcattcaggacataggcatgggcaaaggcttcatgacgaaaatgccaaaagcaactgcaaccaaagacaaaattgacaaatgggatctaattaaactaagagcttctgcccagcaaaagaaactacaatcagagtaaataggcaacatacagaatgggagaaaagttttgcaatctgcccatctaacaaaggtctaatatccagaatctacaaggaacttaaacaaatttacaagaaaaaaacaaccccataaaaactgggcaaaggatatgaacagacacttctcaaaagaagatattaatgtggtgaacaaatatatgaaaaaaagctcaacagcattgatcattagagaaatgcaaatcaaaaccacaatgagataccatctcacatcagtcagaatggcagttatttcaaaagtcaagaaacaatagatgctggcgaagctgcggagaaataggaatgcttttacactgttggtgggaaagtaaattagttcaaccattgtggaagatggcgtggcaattcctcaaggatctagaaccagaaataccatttgacctagccatcccattactgggtacgcacccaaaggaatataaataattctactatgaagacatatgcacatgtatgtttattgtagcactatttacaatagcaaagacatggaaccaacccaaatgccctttaatgatagactaaataaagaaaatgtggtacagacacaccatggaataatacgcagccttaaaaggaatgaaatcatgtcctttgcagtgacatggttgaagccggaagccattatcctcagcaaactaacacaggaacagaaaaccaaacactgcatgttctcactcataagtgggagctgaacaatgagaacacatggacacagggaggggagcaacacacactgggtccagtcgcggggtgggggagcgaggagagggagagcattagcataaatagctaatgcatgccgggcttaaaacctagatgacgggtttgataggtgcaggatgccaccatgacacatgtagacctatgtaacaaacctacatgtcctgcacttgtatcctggaacttaaagtaaaattcaaaacaaaagaaatattttatgtgaaactgttttataatcatatacaaataaccataatgaaaacaatactgacattaatagagctttgtcataaaatgcttttcagtttcttatatgtatagcttcccatagtcctcaaaacaatccagtaaggtagatatttctgtatttcagtggaggagttgtgagattatgagacttgctcaaattcatgtagttagtgcaggctaaactcaggttctgattccaaatccgaccatctttccagtatcttatgctgcctccaagctgttttcactgaggctaggaagtatagtaaactctaagatacaaaaaattagctgaatttttgcttggagaaaacgctaccatattgattagaaaaaggaaaaagctggagcaccttctttgcttgttagcttcctctcacagacttgagcccttcaatgcttattgtaagacaatgtgctggatgcaggtatcagaagacgactggctcagggcctctgctacaagacaaccacaatgaagcccaggagacagaaatgtggacaaggacataccaaaatttctgtgtgctgtaacagattattagtttgtaccagtagtacagtaagaggacctcagtaagaggagcagttaggtctgccttatggtgtcagaaggaatacagattaagaaaaccttcatattgtctacaatgttgaatatgagattgaaagaagggtaggattttgccaggaggagcagcccaggcaaagaacagcatgagcaaaacaaggaagagtcaaaatgagctgttcacagaagtccagtatggctagatgtcagggaacaagtaagggaatggcaggaggtcaggttggtcagatcactaggagctaccctgtgttgcctttataagtctggcctttacccttaacaacaaggtacaagtccaggtcctatttacctttgtatgattagcacccaacataatattgtaaaatatagccagctcgtcttccacgtatgtttgttgaatttattccatctttaaacacacacaagggattctcaggatcagatttgcatttcaggatctggctaaacactgaaatgaaagatactggtgaagataagctggcaagagattactacagagacatgggaggctttgaaatgtaggaatgaaaaaaaaaaggcccactttagaaacactgttggtgtgctcaagagaaagaagggaatgccaaaatgttaattgcaataatgaatgctattatccaagatgagacccaggagaggactttcaatgccactgctggtaaatatattccagtccttctgaatatgcctcaaataacttgaagtactagtcattgatattaacagccctatattcataagaaaattaagaccaaataaatcattaatgccctacttggctaaaagtctctggacaggcaattcagaacatttctaatttggcatgttgaaaattggaaactggtccttcatgacactataatcaggagatcctcatatgcactgaatagttttctctgctatatgtgagaattaagtcctcatataatgttctattaactaaaggaacattatataaaaaatgagaaaactattatttaaatgttagtgatatttaaagtactgttattgtattctctccacatctgcaccctatatctcaaagaaaatccataatatctataattaaataggaaatatcctgagcccataagtagaatagtatatagtttacagaaaaatagtttaaaatcagatataggaaaagagctaccatgatcctacagaggaaaatcaattattcttcttaaaccaatttataggcttaatgaaattcgaataaaaagtcccagcagatatttttcaagctttacaaaaccattctaacattcatctggaagaagccaagaaaattttgaaaaactggaataatgaaggggcatttattggatctaccatatattatcatgaaatttgtaatgattaaaacattcaagatttagtaaggagatctatggaataaaatttaaaaaactatataagaatttattacataaaaaggaattcagtatgtgaaaaactgaagcattttgaaatgtgctatgtgatttgttgtctacttgggaaaaaaattaaagtcacagatcctcacctaatattctgtataagaaatcaaaatattaaaatgtagtttagtttcattatatttaaaaaatttcaggccgggcacggtggctcacgcctgtaatcccagtactttgggaggctgaggtgggcggatcacgaggtcaggagatcaagactatcctcactaacaatgtgaaaccctgtctctactaaaaatacaaaaaattagctgggcgtggtggtgggcacccgtagtcccagctacttgagaggctgaggcagaagaatggcctgaacccaggaggcagagcttgcagtgagccgagatcacaccactgcactccagcctgggcgacagagtgagactacgtctcaaaaaaaaaaaaaaaaattcaatcccaatttaatatttttagacaaattatattattttttaaccgtagtggtatattgaagcagtagaaaagttgttttacctgactttgaggaaacaccattattaagtatgtgctcatgtaaaaattgctgtaagctacattttttcctttttccttcctaacaaaatgatgagatcaacttcaaccatatggaagcatttctacacttagtttgaggaggaaaaaatcaaatttgcaaacaatgtcaaacaaaatatgcatttccaaattctagcaagatgaccaaacacatccttctctttttagaaagacctcatctaaaataggacaactattctgtttccagaagtcttcgaataatatttatattttttaaaaactagaaaaggaaagccaaccacagaaataactcatgaagaaaaataattagatacaattccaaagaacagctattacagtcaatgagtttggagtattctccctgcccccatgaaccttccctgaacgttaggctttctatatcttatatgcagaaatctataccattcctatactccatttttatatctgtattgacactgtggaggacaattccaaaaagatcattattttctttgttcaaatctaacattgatagattgttctgctctctagttctgcctgtttctcggaaactggcccaaaccacataaatgaacaacttcaacacagctgcaaaatgctcagcaacagtaatattagaggtggaataacatgcacacggaatagtgctgtcaggagtgaaattccactgggagagtgaaattctgtttagggtctggtattatccaaggactttctaccattcacttccattctaatccctagatttaggtctatgaaggtacaagttaatgatgactcaggctgtgaatactgacaagagtggaagatcttggttttccaaggttggatgtttccatagctgaattatggtgacagaaatctggactatgatctcagaggacaaggggtctttgccctcatgctgatcttcagtcacacagaaaagtgtaagagagggaagaggacagggcctgtatctaatgaaattggccagtgccaggcagacatttcggtatttgggggccttcccatcagggccattctgctactatagaaaataacaaaatatctcctttcattgtgagagttcctacccccacccaacaggggactccaaatctaggagaatttctttcctttgttatccacctgcacatatgatgtatctgaaatattgttgagccttctctcccagggcatatcacagctctctattataataaggcccatctttactcatggtctttggggtttgatttctacttctggatcacagattgcaaccctaaaatctgatttctgaattttgctcccaggaaaggggataaatccttcaccaggaactggatatctaactgagtacatactttaataagagcatagtagcctgatctttcctgtccacaaagagaatctttggttatgctaactaacacaaataagatgtgacagccgttctacacaaaagcctagggaaagcttgtgagaaaataattcatcctgagttatagtaaaccaggctgaactctagataaacaacattttggggcatctttcatttggtccaaagccacttactttttcatggttaattatatgtcgagctagactgggtgctacatagaagaaatgaaatattgacctctctctctctttctccctttctccttctctccctcaccttcagtcctccatttctttctcctttactcactccttgcctctcctctccccatccctatttatgtatattaataatatcacattggcagtggaccaataaaaagtatatagttatatgtttgtcgactttaatggctagtgcagatctctatttaggcttcccttggagcttatgtttcccttagtttgataggtttatagaggcttaaatatacaggaattaagatgggtgagactctttgaccaatccatcttgttgataaaagttacttccttgcagtttaatttaaggagaatcctgaatgaagaaaggaaaaaataagttaattaccatttgccgactgacaggcatttggtaagcagattatctattttacaactctgtaaggttggtattattaatctcattttctagataagaaactgtgctcaagatcacacaggcagttaattgcagagctgggattcaaacccaattctgattctaaagcccttgttataaccatgcagagttggcaaatttgtaccacatgtggtattgttcctttttgctgagcctatagtaagagagctcaatactccctcatttatctcacaattggcctaagattttttctcaagatagagtgccaggccctgtttactaaaactggcacccaagatgaagcctatttgctgccagtgaagggttgagagatgggaggctataggacaatgtctggaacaagatagaggcagatgtgagagaataacacatataggaagaccaaatagatttgcttgattggaaagaagaaaaagacagggaaatgggggatgatgagaaaagatgatgaaagagatctggaaggctctggctggagctggaaggtgctggttagaagatcatgatacacaccccttgacagtccaaaatgctgctgaggaagttgtaaagacttggattcaagcaaagaaggctctaataacctgaaatgatttgacctggctgtagagcctggtgagaaggaggaaaaatgcatcaggattttgttatttatttcacatgaaaaagcaaactttttcttttggagctcaagccctgctataaacctgactgtaagtgtgaacattgaggaactgaggttgagaagaactgtattttattttgtatgctagactatttagcttaattgaaatatgaagattcagaaaaatagcatcactgaatagcaagagcatgggccccagagtcagacacttatctgatttgtgacctggctccacagttcattagccatgtgaccttgggtaagttgtttaacttccttgatccatgtcatatggaaagaacagaacctatttcccaaaagtgttgtgagaattaacaagaaaacgagaaacaaaggtagtgtctggtacactgttggcactcaataaatgtcagtttcctcttcttggttctggtttttgagctttgtaaatcatttaatatttgtgcacctacattctttgatctttaaaataaagataataaaacttgctttgcctatattacagggtagtggttctcatacattagtgtgtaaagaattatttgaggtctttattcaaaatgccaatatctggctcacatccccacacatctgcttcaggaggtctgagctggagcctaagaatcatgctgcatgcatagcaatccctctaggtgcttctaatgcaggaggaccatggactatacttctgacaaattctgatcttagcagcacctataaggggagagcattcttggaggggaaagcagggttgtgagggaaagaagagggaacagaggaaaaactggaaaataagaaagtgaggaagaatatttctcaagaccatctgactagtaaagtgtcaaatcgaagtctatgtttcaggactccagcctccatctccaatgttcgacagactgacttctctggtattagagacagagagaaacatcctccattataatgacagtatttttgttgttgttgttaaaattagaagaaaaaaaaaacaagtttaaggttgaaaaaaattgttatatgtctttataccaatggagtgtaaatataatttttaatatgtctttaaggaagggactcatgaagtcaaaagtgccttgggcccataaaagtcacaatggaagtctgtgtataggaatacagtaaaatttccatcctcatccacttatacagctttcatacctacccatgctttgaggaaaagatggaatcgataaatcaggattaggcacttagtagaagtgttgttgattagacacaactaaagacagaaatctggatataaaatggcaatttttctatttgtgctttattgaacatatagcatatatcatgtggtctgccgtggtggcaaagaccattatttgcttcctagttttgtcctgcttctatctcctttgctcaactttaaatgcttcccatagctctctgagccacgataggagcagaaaactgtctagctttctattctaacacaggttcaggttagaatattccactagcaattctgtagaatgttggattaacttccattcttcattcttcactcattcaacaaactggagtacctattatgtaccaggcttgttgctagcactgcatatacaatagtaaatacaacatacttcttgcccttatggaatttataatctataaaggacaagcaaacaaacaataaatatatagttagaaagtataactatctatagcctgttagtttagatagagaattacttcgctagatgactcaagaaagcactctgatggatgagaagaaaccagtcatgtggggaggagactgctctagcatggtactagcttagcacataaccaggcccatgaggactgagtgaggtaagaaaaagagaatgtggtagaagataaaaatgaagatctggatagaggtcagctcattcattgtaaagccctgcaggccatggtcaagagattacattttattctaagagaaatgaaaagtcattaaagcatctttagcaagtgactgacatcatatgaactaggtttgtaaatgattcttctggcaactgagtgaacagataggaggggaacaagatgcacgcaagcagagtagtaatgagggtactgaggcaatccaggttctctgaatcctccaaattgtaattcttttttttaacgtttcctttactgccatcacccaccgaaaccagagtgcatattcgaagtcaatgtgatccaaacatgttagtggaacattaatccctcaagatggtctctgaaagtaagatgctgtggtcaaaaaaattcagaaaattctgcatgctaaatccccttcttggagattccgaatgtaaactaatatattaaaagcacaggtaagtgtttcagtaaatgtgtggatcccagcatttctcaagcttacttgaccatggaatgttttatttttttttcctccacataatgttaatatcctgtagaagtgatattctccagagcatacttaagaaagtgctgccataagtcattctaaccaagagtcaagcaaattccatgtgcttggtttactgggtcccttctcctttacctctccatttattattctaatagtttagacaatattttctgaatcatcatatattatgtaaggatatcacccctcacatatggtatttcttctctccatttctaccttctatttctatcaactgtccctttacttttatattgccaaggttggcaaagttttcattctttctgtaactatagttctctttcttgttttgggatctggctgtcctataagccagctgttggatatccttaattgattctctatatcaataatatttctctgtctctgtataaagcttggtgtataggagctttatcttttatcttctaaatattttattagactcttaaacgctttttggaaatataatttacatatcatacaattcactcagagaagtgttcaattcagtagtttttattatattgtaagtgttgtgcaaccattaacaatctaattctagaatatttcatcattccaaaaagaaaccctgtatccattacagacactcttcatttccccaaaatcttcaccagccctaagcaactactaaactatgttttgtttctattgatttgtgacatttaatataaaaggaaccatacaatgtatggccttttgtgactggcttccttcagtgaccataatatttttaaggtttatccatgttataacatgtattggtgcttcatttcttttcattgtctaataatatttaattgtatggatataccacattttccctattaatcaagtgatgaacctttgtttctattttttagctattatgaatactgctgctatgaatatttgcgtacaagtttttgtgtggatatatgtttttatttctcttaggaagtgcttagccttatgttaattacatttaacattttaagtaattgccagactgttttccaaagcagctgaaccatattatattcccattagcattgtatacgggttgcaatttttctacatcctctccagtacttgttattgtatataatctttttgattatagctattttagtggatgtgaggtggtatctcgctgtggttttgattagcatttccctaacaactaacaatgttaagtatctattcacgtgcttattggccatttgtataacttggtaaatatgtccactcatatcctttctgtccatattttagttaggtaatttgtcttttcattgttgagttgtaagaattctttaaatatattctggataccattctcttatcagatatatgacttgcaaatattttctcctattctgcatgttatctgttcacattcttgatggtgtcattcgacacacaaaagttcttagttttggtaaagtccaatttatcattgatatattttatcacatttgcctttagtgttgtatctaagaaatcactccttaaactttattagaaaatttcagcaagaatatatttactttcaaaatgatctttttgtactgattcatagctttttcatggaaattgcttttactccataaataccatatatttctatatcattataaggataccaattacagatttttatttttaaagcactggatcttgaattataattcttcttgggtcaattgtttaattaatttatcttggtttttttctttcatgctactgatttcttttttgtgtcttgtgatctttggctctctacaggcataccacagaggtattgcaggttcagttccagaccactgcaataaagtgaatattacaataaagagagtcacacaaattatttggtttctcagtacatataagagttatgtttacactataccatagtctattaagtatgcaacagcattatgtctaaaagaacaatgtatataccttaattcaaaatactttattgctaaaaatgataacgatcatctgagccttcagtgagtcataatctttttgctgatagagggtcttgccttgatatggatggtgctgactgatcaaggtggtgattactagaaggctgggatggctgtggcaatttcttaaaataaaacaacagggatgtttgccacattaagtgattcttcctttcatggaagacttctctgtagcattcaatgctgtttgatggcattatacccacagtagaaactctttcaaaattggagtcaatcctgtcaaactctgccactgttttatcaactaagtttatgtaatattctaaatccttttgtatcatttcaacactgttcagagaatcttcatcaggagtagattccatctcaagaaacctttttatttgctcatttatgagcaactcatcatccattcacattctatcatgagattgcaacaatcgagtcacattttcaggctacacttctaattccagtcttcttgctatgcccactacatctgcagttacttactccactgaagtcttgaatccctcaaagtcatccacaagggctagagtccacttcttccaaactcctgttaataatgctatttcatctagcattaggtgcagcacaccagcatggcacatgtatacgtatgtaactaacctgcacaatgtgcacaggtaccctaaaacttaaagtataataataaaaaataaataaataaataaataaatttaaaaaaataatgctatttcaaccttttcccatgaatcacaaatgttcataatggcatctggaatggtgagtcttttccagaaggttttcagttaaccttgcccagatccatcagagaaagaatcactatctatggcagctatggccttataaaatgtacttctcaaataatgtatttcttaaataataagacttgaaagtcaacatgactccttgatctctaggctgcagaatggagggtgagttagcaggcttaaaaaattaatttcttttgtacatttccatcagagctcttgggtgaccaggcacattgtcaatgagcagtaatattttgaaaggaatctttttttcctgagcagtaggtctcagtagtgggtgtaaactattcagtaaaccatgctgtaaacagatatgctgttatccaggctgtattgttccatttatagagtacaggtggagcagatttaacataattcatagagaccctacgattttcagagtttcagatttccaagagaaggatgtctcatccatattgaaaatcggttgtttagtcactttcattaattatctaagttgcatcttctgtagagcactggctgctttcccttgtactttttatgttatggatatagtttatttccttaaacttcataaacaaacctctgctagcttccaactttccttctgtagcttcctcacctctctcagcctttatagaattgaagagagttagggtcttgtcctggattaggatttggcttagggaatattgtggctggtttgatcttctatctagatcactacaaccttctccatagctgcaataaggctgtttcactttcttatcattcttgtgttcactaaagtagcacttttaatttccttcaagaactttacctttacattcacaccttggctaactgtttggcacaagaagcctagcattcagcctgtcatggctttcaacatgccttcctcattaagcttaatcgtattgagcttctgccttaaagtgagagacatgtaagtctttcacttgagcactcagaggccattgtagtgttatttattggtgtaattttaatattgttgcatctcagggaatagaaaagcctgagaacagggagagagatgcgagaatggctggtgggtggagcagacagaacacacatttgttgattaagtttgccatcttatagttcatggagctccaaaataattacaatagcagcatcaaagatcattgattacagatcaccataatagatataataataatgaaaaaacgtgaaatgttgcaagaattaccaaaatgtgacacagacacatgaagtgaggtactacaaaccttcaatttataaaaaattcaatatatgtgaagcgcaataaatatgaggtttgcctgtactcatttttaaaaattagggactaagtagatttgtcaaggtagaggtataggtttttctctgttattggatatataatttttttagataaatctccttttgactaggatttctattttgtaggcagagcttgttgaacaatatgagacaagaaaaaccataatgaaaagaaaattctaagacaataaaaacatcttttaggacacacacaagaaaagcactagattaagataaaattgtcattacatagatgatgcataaaagtttacaaaagaaaaacaagaaactgatataactctaaatagtaattctcatgcctttagataaaactgatgattaagaatagccagttcccaaataaggaaatgaaaacaataaaataggcactttattaagtaattcccattttccaggccacaggctgatccctgaagatactaaatacgaacatgaagattctatctctgtcttcatagagttcatatcctaactggaaagacagtcctgtttagttctgtaactacctcaataaaaaagcttacccagcaatcccacctatgggtatgtatccaaaatagaggaagtcagtatatcaaaaatattatgcacacctcaatgtttatttcagcaatattcacaatagtcaagatatggaatcaacctgtgtccattaaaggatgaatggataaagaaaatgtagtatatatacacatggaatactattcagccataaaaagagtgaaattctgtcattttcagcaacacggatggaactggaagacattatattaagtgaaacaagccaggcacaaaaagacaaatattgtatgttctcatgcacatgtaggagcaaatgaaaaagtggacctcacggaggtagagaattggtggtaaccagaggctaggaagggaaggagagagggaggataaagagaggttggttaatgggtacaaaaacacagttagatagaaggaataagttctagtgttcaatagcacagtagtgtgacaatagttaacagtggcttattgtatattccaaatagtgagaagagatttggaatgttcccaacacaaagaaataatttaaaaattgtcataaatatgtacaacaaatacgtacgatttttatgtatcaataaaattttttaaaaacttagacattggtatagtttcataaaactgaagttagtcatgatttataaaatcaacataagccattcaaatcattatttatacaatgcttttcaatgcttcataattacaattatgcatactgtttttacgttagatgaccttaaaatcagttgttgaataagacagatactactcattcaacaagcatttataacacacttactatgttcctagattctgaagatatagaatgaataaaacaaatggggtcctgaccctactctgtggtttatcatggctggcagatatataaacaaatgttatcatcaatttgataagtgctatagcagaaaaatacagtgccatgcaaggacagaggaggccctaagaaaccctgcctcaacatgtcagagaagatctagagaaaggagaaaaacaagaggagaggctggtattcttaacaaaatgaaacaaaataaaaagatgtaaaggtataaaagagtagggtatcttccaaaatttacattaaaaatttactgtactttgatgtagttagatgtaattagagggcaagggggtatcactgcttattagctgcaaatttaggcaggcgcagaccctaaacgtcatgagtgcatctgaaagggtttggatttcaagcagaagtgacttgaccagatgttgcattaaaaaaaaaaaaaaaaaaagaagaagaaaaaaaactattctgtaatcctagcactttgggaggccgagacgggtggattacctgaggtcaggagctcaacaccagcctgaccaacatggcgaaaccccatctctactgaaaatacaaaaattagccaggcatggtggcacacacctgtaatcccagctactcgggaggttgaggcaggagaattgcttgaacccaggagatggaggttgcagtgagccgagatcatgccactgcactccagcctggctgacagagtgagactctgtgtttaaaaaacaacaataaaaaataactactcaggaatctatatggaaagattattagagtttgaggctagctagataccaagaaatcacttagaattaaaaacagtaaggttgaaaataaaataaggtttaaaataaaaatgaaaagaaaatgggatatgagggataataagaaatcagaaattacagtacttaataacgaattgagtgtgtgaacaaaggaaaagactgatctaaaacggcttccatgtctgggtctcaggcaaaatggttattgcattactaaccaaatttgggggataagaggaaacataagaatttggttgtgttactaaccaaatttgggggataagaggaaacataaggatttgaaaatgctgagttattttcatagttaacagaattcaagttaaaacaaccatgcaacatgatcttgcattaattaaaatagggtaaattaataaaattgacaacatttattgctatagatattagggaaaaagatatactaatacattgctgccctgaaacctgatgaaattgttctgaaaaaaatttggcaacaaatataaaagccataaaaatgatcatatactttgaccaagaaaccctactttttggaatatagcccaaggatgtaattcaaaagaaataaataaccgatttgtataaaaatgtttatagctgtgctatgtattacaagcaaaatttggaaacagtccaatgcccaacagtgagggaatgcttaggcagactttggtgcactaatgcaatggtatattttattgctattaagaatgacaatatgagaactatgtagaaataaggaaagggtcatgtgaagcaatgagtaaaaaatgcagcactcaaaatgatgcatatacaatgatcacaactatgtaaaattatatctgtataaccaggaggattagaaaggaatacagagctggtaatttagagtgctgacatttttgttattgttagttcaagttgctggggatgtttatgtgtttctagttatatttcactgtatatttagtacatacacattaagagagataaatctctattttttttttctgacacataaaagaaaaattcctgatcagtatctttccttgccttgcgtgatttttaaaaatgattgtcagattcagtcaaaactaaataggaaaagtggtagcaattctctagaatatctgctaataggcctattaagacctttaatctaccagtatttgtagtgttttgcaactttttaacccagctttgctggccaagattttgtaaagcttcactttctacaagaggacactggtatagagtaatttttttttgttttaaaaaatataaaatgatgctataagatgcataatattaattgtggtttttcaaacaatgtttcctttccaacccatcctagagattgtgatataccttccccatcccaccaccccctgttgactatggaaggcctagaaagatgagaaagatggagaatctctgtcttagagtgggtgaagccactatggaaagagtccctccttttttcttaagaccaaaataaataaataaataaataaataaccaagagaaatgcaaatacattaattcattaaatgaacaatgtcataagaaaagctaaataatctgacctacccatctaggagggcgatgacattcttcctcggccgcccaatattagggccatataagctggctctggaataaatccggatgggctgcaacaggctcttcagctggatgtaatcctttcccaactggctgccatttactgcccggccatgcatggtccgatagttatttggctctagattaaaagcagacatgtaagtcagaatgagaagtgtaaggttctgccaacactttcctgtccacagatctctctgcctttttcttaataatatgaaaaaaaaaaacaataaaaaagtgggtgtgaattattttaacttaaagaaccacccaaacaaaaaaaggtcaagttagcttgctgttccattcattttcaaactaattttcacaaaaagataacctaatcaacaccggagaccatacagattttcaggtgctacttcataacgaattgtatactggattgaacagtgtcccccaaaatttatgtctaccagaatctcagaatgtgagctcatttggaaacaggatctctgaagatataattagttatgataaggtcatactagattacagtgggtcctaaatccaatgacttctgtctttataagagaaaggagaaggaagttcagatacccagacacagagagaagaatgccacgtgacaacaaagattggagagatgttgctaggctaagcattgctggcagccaccggaagctaggaaagaggcatggaatagattctctctcaaaactcccagaagaaaccaatactgttgatgctctggtttcagatttctggcctcctaaaatatcagagaagcaatttttgttgttttaagccacgaaatttgtgataatttgttatggcaagcgtagaaaactaatacacatggtaagaagtgaaatcttcataaagatgttcactgccaaaaagtcagaaaaaatattaatattcattaataacaaagtagctaattgaagtaattttgagcaaagcctcctctttcagcttccattaccttggtagttctaaaaggggagaaaaattccctgaaacgagcagctccacagctggaggaggctaatttgatttggaatggtgtgcataccccaggaaaggccaacatctcagctggcttgagactatgatactggcaggtacaagaaataaacctgtagacttgcaagaaatataataggagattttgggctgagacgatggggttttctagatagacatcatgtcatctgcaaacagggacaatttgacttcctcttttcctaattgaatgccctttatttccttctcctgcctgattgccctggccagaacttctaacactatgttgaataggagtggtgagagagggcatctctgtcttgtgccagttttcaaagggaatgcttctagtctttgcccattcagtatgatattggctgtgggtttgtcatagatagctcttattattttgagatatgtcccatcaatacctaatttattgagagtttttagcatgaaggtggttgaattttgtcaaaggccttttctgcatctattgagataatcatgtggtttttgtctttggttctgtttatatgctggattacatttactgatttttgtatgttgaaccagcgttgcatcccagggatgaagcccacttgatcatggtggataagctttttgatgtgttgctgaattcggtttgccagtatcttattgaggatttttgcatcaatgttcatcagggatattggtctaaaattctctttttttgtcgtgtctctgccaggctttggtatcaggatgatgctggcctcataaaatgagttagggaggattccctctttttctattgattggaataatttcagaaggaatggtaccagctcctccttgtactgctggtagaatttggctgtgaatccatctggtcctggacattttctgattgctaagctcttaagtattgcctcaatttcagagcctgttattggtctgttcagagattcaacttcttcctggtttagtcttggcagagtgtatgtgtcaaggaatttacccattacttctagattttctagtttatttgcgtagaggtgtttatagtattctctgatgatagtttgtatgtctgtgggatcggtggtgatatcccctttgtcattttttattgcgtctatttgattcttctctcttttcttctttattagtcttgctagcggtctatcaattttgttgatcttttcaaaaaaccagctcctggattcactgattttttgaagggttttttgtgtctctatttccttcagttctgctttgatcttagttatttcttgccttttgctagcttttgaatgtgtttgctcttgcttctctagttcttttaattgggatgttagggtgtcaattttagatctttcctgctttctcttgtgggcatttagtgctataaatttccctctacacactgctttgaatgtgtcccagagattctggtatgttgtgtctttgttctcgttgggttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttctttgacatttgctgaggagtgttttacttccaaatatgtggtcaattttggaataggtgtggtgtggtgctgaaaagaatgtatattctgttgatttggggtgcagagttctgtagatgtctattaggtccacttggtgcagagctgagttcaattcctggatatccttgttaactttctgtcttcgttgatctgtctaatgttgacagtgggttgttaaagtctcccattattattgtgtgggagtctaagtctctttgtaggtcactaaggacttgctttatgaatctgggtgctcctgtactgggtgcatatatatttaggatagttagctcttctttttgaattgatccctttaccattgtgtaatggccttctttgtctcttttgatctttgttgatttaaagtctgttttatctgagactaggattgcaaaccctcaggacacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagacgatacaaacaaatggaagaacattccatgctcatgggtaggaagaatgaatatcgtgaaaatggccatattgcccaaggtcatttatagattcaataccatccccatcaagctaccaatgactttcttcacagaattggaaaaaattgctttaaagttcatatggaaccaaaaaagagcccacattgccaagtcaatcctaagccaaaagaacaaagctggaggcatcatgctacctgacttcaaactatactactaggctacagtaaccaaaacagcatggtactggtaccaaaacagagatatagaccaatggaacagaacagagccctcagaaataatgctgcatatcttcaaccatctgatctttgacaaacctgacaaaaacaaggaatggggaaaggattccctatttaataaatggtgctgggaaaactggctagccttatgtagaaagctgaaactgaatcccttccttacaccttatacaaaaattaattcaagatggattaaagacttaaatgttagacctaaaaccataaaaaccctagaagaaaacctaggcaataccattcaggacataggcatggtcaaggacttcatgtctaaaacaccaaaagcaatggcaacaaaagccaaaattgacaaatgggatctaattaaactaaagagcttctgcacagcaacagaaaccaccatcagagtgaacaggcaacctacaaaatgggagaaaatttttgcaacctactcatctgacaaagggctaatatccagaatctacaatgaactcaaacaaatttgcaagaaaaaaacaaccccatcaaaaagtgggcaaaggatatgaacagatacttctcaaaagaagacatttatgcagccaaaaaacacatgaaaaaatgctcaccatcactggccatcagagaaatgcaaatcaaaatcacaatgagataccatctctcaccagttagaatggcaatcattaaaaatcaggaaacaacaggtgctggagaggatgtggagaaataggaacacttttacaccattggtgggactgtaaactagttcaaccattgtggaagttggtgtggcaattcctcagggatctagaactagaaacaccatttgacccagccatcccattactgggtatatacccaaagcattataaatcatgctgctataaagacacatgcacacgtatgtttattgtggcactattcacaatagcaaagacttggaacccacccaaatgtccaacaatgatagagtggattaagaaaatgtggcacatatacaccatggaatactatgcagccataaaaaatgatgagttcatgtcctttgtagggacatggatgaagctggaaaccatcattctcagtaaactatgacaaggacaaaaaaccaaatgccgcatgttctcactcacaggtgggaactgaacaatgagaacacatggacacaggaaggggaacatcacacaccagggactgttgtggggcagggggaggggggagggatagcattaggagatatacctaatgctaaatgacgagttaatgggtgcagcacaccaacatggcatatgtatacatatgtaaaaaacctgcacgttgtgcacatgtattctaaaacttaaagtataataataataataataataataataataataataaaagaaatataataggaaaatttggggaataaggcagccacagtgaaccttgacaatctcacacatactccctgtaatctagaaggctaaatatgcttaggagggactacaggatagaagtgtggatagtaggaggattcctagctatccacacatttccagataagtgtgaaacctaggacacttataaaggaaacatcagaagccatgactgagagtaaaatcccagttagacttgtaaaagacctaaatttttaatgtgtttcccaaccaacacagagatgcactggcaaaaggtggaaggcttactggctcacgggaattaagcaaaacctctgatcaatcttcagctcaccattaagctatgttgactcaagtgcaacccccaggagacttgtcttaacaattaaaaaatgattaagaaataaaaaaacttaagagatatcagtagctacacgactcaagggagacagactctatagagttagtccaagacctatggtatggaagtacagaattcagagttggtccagtatattatctaaaatatgtagttttcaacaaaaaagctattatacatgaaaaaaatagaaaagtttgactcataccagcaaaaaacatagaaactgcctctatattaggggccctaaatattagacttggcagtcaaagacttataaatatgttcaagaactaaagacagtctgggcacagtggctcatgcctgtaatcccagcactttgggaggccaaggcagatggatcacttgaggtcaggattttaagaccagcctggccaacacagtgaaaccctgtctctactaaaaatatgaaaattagctgggcatggtggtatgcgcccatagtcccagatacttggcttgggaagctgaggcaggagaattgcttgaatccaggaggcggaggttgcagtgagccaagattgcaccattgcactccagcctaggtgacagagtgagacactgtctcaaaaaaacaaaaaacaacaacaacaaaaaaaaacaaactaaaaataataaagagctaaaggaaagtataatgttaatgattcatcaaatagaaatatacataaagaaaaagaaattataaaaaacagtcaaataaaattattgaacttaaatgactaatctcatacaggagaacacaatgagattaacagctcagtttttatcagaaaaaaatggaggccagaagatggtaggatgatatattcaaaatgctgaaagaaaacaaaacaaaactgataaccaagaattccatatgcagcaaactatccttgaaaactgcatgcaaagttaaacattctgagaaaaacagagagaagagattttgttgtgagcaaatatgccttataagaaataaaaaaggaagtcattcagattggaataaaatgataccagatggtaactcaaaatcacacaaagaaataaaagacataaataaaggtaattacatgaataactgtaaaaaatattcattactcttttcttctcttaactgatttaaaagacagtgcataaaacaaaaatacacaactctattgttgggcttataaaatataaagatataatatttagaataataatagcacaaaggactggggaatgaaactgtactgaagcaagtttctgtattaaactagaattaaggcctaggcatggtggctcacagctgtaatcctagcactttgggaggccgaggtgggtggatcacctgaggtcaggagtttgagaccagcctggccaacatggtgaaaccctgtctctactaaaaatacaaaaattacccctgtgtggtgctgggtacctgtaatcccagctactcaggatgttgaggcaggagaatcgcttgaacctgggaggcagaggttgcagtaagccaagatcacaccattgcactccagcctgagtgacatagtgagactctgtctcaaaacaaacaaacgaacaaacctagaattaagttagtattacttgaaaatagattgtgatgagttaagatgtattgtgataagaaactactaagaaaataacaaaacagggtgggtgtggtggctcatgcctgtaatcccagcactttgctaggctgaggtgggaggattgcttgagcctaggtgttcaagaccatcctaggcaacacagtgaaaccccatgtctacgaaaaattttaaaaattagctgggtgtagtggcatgcacctgcagtcccagctactcaggaggctaaggtgggagaatcgcttgagtccaagaggttgaggctacagttggctgtagttgtaccactgcactctagcctgggcaacagagcagggccttgtatgaaacaaaagaaaagaaaagaaaagaaaagaacaaaacaatgaaaacagtaccttagacaatatttcttttacataaaaaggcatgaaaagtgagacagaggaacaaaaatgccacgagataaatggaaaacagcaagatggcacatgtaaagtcaattatatcaacaatctcaaataatggaaatggattaaatactccaattaaaagcagaaattatcagactgaataaaaaatagatcctaatatgagacatatttcagattcaaaaatacaaacagattgaaggtaaaatttttttttaaaaggtagactatgtaggctgcagcatggtggctcacacctgtaatctcagcactttgggaggccaagatgggtaggtcacgcggtcaggagatcaaaaccatcctggctaacacagtgaaaccccatttctgctaaaaacacaaaaaattagccgggcgtggtggcgggcgcctgtaatcccagctacttgggaggctgaggcaggagaatggcgtgaacctgataggtggagtttgcggtgagccgagatcacgccattgcactccagcctgggtgacagagcgagactctgtctcaaaaaataaataaataaataaattaatttaaaaaggtagactatataaacagtaaccataagagagcagaaataactatactaatatcagaaaaaatagattttaagataaaaacattactagagataatatgaggcattttataatgataaaaggcattttataatgagaagaaaggtctcaacatcaggaagatataacaattagaaacatatatatacctaacaccaccatcaaaataccttaaacaaaattgaagagagaaatagaaaattcaagaacaattgaaggagacttcaacactacattcttaataatagatgaaacgactggataaaaaaatcagcaagaatatagaagacttgactggcactatcagctaactttacctaattgccatctacagaatattccacccaacaacagcaggatacatattcttttctagtacatagagaaaacatccttcaggacagatcatattgtaagacataaaacaaatctcataaatttaaaaggattaaaatcatacaatggatgtgctttaatcacaatagaattaaactggaattcaacaaaaattgagaaatccccaaatatttgaaaatttaacaaataatccattgatcaaagaagaaatcacaaggaaataaacaaaattaaagtggaataaaaatgaaaataaaatacataaaaagatatgggatgcagcttaagcaatgctttagggggaaatttatagccttaggtgcctatattagaaatgaacaaagatctcaaatcaataacctaagtttcctccttaagaaaggaaaaaagaacggaaaactacacccgagcaaaacaaaggaatgaaataataaaaattagagtagatatcaatgatatttttaaaatagagaaaatacagggaaagcgaaagttggttatttgaaaagaccacaaaaccgatatacctttagttagactgaccaccgaaaaaagagagagagaagtcacagattaccaaaagggaacaccactaaacaatctcacagtaattaagttgataaggaactactatgaaaatctttgtgccaataatttagaaaacttaaataaaatggtaaatttttttaaaaaatgcagaaattattaaaactgactaaataagacacagaaaatctatatagacacataacaacaacgaaaacccattgaggtagtaattaaaaatctttccacaaagaaagcccagatccgtatggattagttggtgaattctattaaatatttaaataagaaacaccaatgctttacaaactcagaaaatggaggaagagggaacacttttcaacttatgttatgaggccaatattgccctgacaccaaagccagtcaaagacatcactagaggctgggtgcagtggctcacgcctataatcccaacactttgggaggctgaggcaggtggatcatttgaggtcagaagttcaagacccacctggccaacatggtgaaaccccgtctctactaaaaatacaaaaattagccaggcattagaggtgcacacctgtaatcccagctactcaggaggctgaggcaggagaatcgcttgagtctgggaggtggagtgagccgagattgtgccactgcactccagtctgggcgacagagtgagaccctttctcaaaaacaacaacaacaacaacaaaacaaagacatcacaagaaaactacagacaaatattcctcataacatagatgtaaaatccccaacaaaatatttacaaagtaagtccagcaacatatgaaaagtattatacactatgaccaagtgggatttatgccaagaacgcaaggttgatttaatattaaagccttttaactaatgtaaaataccattgtaatagaacaaaagaccaaaactaaattatcatctcaatagctgcaacaacaccaccaaaactcatctgacaaaatgcaacacccattcctgataaatattcccaacaaactgaatagaagggaactttctcaacttgataaagcgtatctaagaaaaacctagacctaacatcatacttaatggtgaaatatggactgtgtgcccctaagactaaggagaagacaaggatgtctgctcttgccacttaagagtcaacatttgtactagagattctagccagtgcagtcaggcaagggagagaaataaaaagcatccaaattggaaagaaagaagcaaaactgttattattctcagacaatatgatcctacatacagaaaatcctaaggaatccacacacaggaggggaaaaaatacaaaatctaaagaataaattcagcaaggttggaggggatacaatatcaatttataaaatcaattatatttctaagtactattgatacacaatccaaaagtgaaattataaaaatacttccattcccaattgcatcaaaaagaatagtatacttaagaacaagtatttaacaaaagaagtacaaaacttatacactgaaaactacaaaacattgctgagataaattaaaaattaaataaatgggagataatctaagctcgtgataggaagattttgtattgttaagatggtaattctccctaaattgatttatagattcaatgctatcccattaaaattccaggaggctttgatgaagaaattaacaagctaatcccaaattttacatggaaattcaaacacccaggatagccaaattaattttgaaaaacaaaggaacaaagttggaggatttacatttccaaattctagcactctttgtaaagctattgtaattaagacaatgtagtcctagcataaggaaagacatacagatcagcggaacagaattaagagtatagaaacaaaactatgtatggtcaattgattttttttttacaaaggtgccaagataagtaaatggggaaaaaatggtctttttaataaatggtactgggaatctctatatccacatgcaaaaagactaatttatagccttacttcacaacgttcacaaaaattaactcctaatagatttagggccaaatgtaagagctaaaacaatgaaacttttagaagaaaatataggaaaaaactccttgttatcttggattaagcaaagattatagcaccaaaagcataatccataaagtaaaacctcataaattgaactttatcaaaattcaaagcttttagactaaaagatgccatcaagttacaaaagacgaagtaaaaaaattatttgcaaatcatatacttgaatttttaaaaaaatacgtgtatccagaatatataaagaactcttacaattcaataataaaataacccacttaaaagagcaaaagctttgggctgatatttcacaaattaagaagtagaaatggctagtaagtacatgaaaaggtgcccaacaacattagtcactagggaagagcaactgttttcaggtccttctatttaatatctatctcttctataaggatgtaggcagttatattcatctgttatttactattgtgtgtgtatgtgtgtgacacagggtcttgctctgttacccaggctggagtgcagtggtgcgaccttggctcactgcaaccttgagttcctgggctcaagtgatcctcccacctcagccacctgagtagctgagccacgggtgcacgccagcatattctgcttattttttgtatttttttgtagagatggggtttcattatgtttccaaggctggtcttaaactcctgagctcaaacaatctgcccaccttggcctctcaaagtgctgggattacaggcattagccaccatgactggcctgttatttaccattgtatctctctaacctagtgaagaaagccaagaaatctaaacataatttaaaaagtaataaccatagggcagtagaaaacgtacttcactttctattagatttcccaagttcctgacatagatttggtacttactgctgcctttagcaaatcacgtcacctctttgaatgtgtttcttcacttgtttaatactttatcaggcactttatttagtattttgaggtccaaatagaagagtctatttggaagtgctacataaactaaatactatgcaaatataggatgacaatattgctgataattacaaatataagcctctaagagagtaacactaagtctttgtaatcaaccggtggcaagaaataggcattttataccctttaaaatgaaagataaacatgttattctttttaaatagcttcattgagatataaaacacatacaattcaccaatttcatgtgtataattcaatggtttttagtattttcacacagttgtgcaaccatcacaacacattttagaacattttaataatcccagaaaaaactctgtgccttttagcagtcacccctcacccctcatgggctccccagccctaagcaaacactaatctactttccgtctctgtagatttgtctattctggacatttcatataaggggaattatacaatgtgttgtcttttgtgactggattctttcattcagcataatcttctcaaggttcatccatttgtagaatgtatcagtacttcattttgcagcacatagtatttctttgtatgtatttgtcacgtttcatttatcaagtcatcaattgatggtcatttaggttgtttccactttttttgctattaaaagtaattctgttattaacattcatgtagaagtttttgtatggatgtatgttttcatttctcttggatatatatctagaagtggaattgttgggttacttggtaattttatgtttaactttttgaggaactactggactattttccaaagtggctgtaccatttgacattcccaccagcagtgtgtgaaggtttcagtttctccacaaccttgtcaacatttgttactttacttttcctttttaaaatttggccatcctagtaagtgtgaagtggtatttaattgtggttttgatttgcttttccatgatggctaatgatgttgagcatcttttcatgtacttgcttgtcatttgtatatcctctttggagacacaaaatattttgtccaaaatattcttttaactgcttcttgtgttgtccttaatatcagtgaaacaagacagcaaatgatattcatatttccaagaagtaggtcttcatcatgactcacactttttttttaattgataaactttatttttatttttagagcaattttaggtttacagaaaattgagtagacagtacaaagagtacccatataatttgtcccttacacacacacacacacacacacaaacacacacaaacacacacaatttcccattattatcttgccttggtctgatacagttgttacaaatgataaactaatattgacacatcattattaactgaaatccatagtctacatttgggtttactcttcgtgttatacagttgtgtgagttttgaaaggtgcaaaatgtcatgtatccaccattacagtaccatacctctttttctttataaattacccagtcttggatatatctctatcagcagcaagaaaagggactaatgcagtaaattggtaccgggtagtgggccactgccataaagatacccgaaatgcgaaagcaagtttgaaacctgttgctccagaaggtgcaagccccaagccttggcagcttccacatggtattgagcctgcaggtgcatagaagtcaagaattgaggtttgggagcctctgcctagatttcagaggatgtatagaaatgcctgtatatccaggcaaaagtttgctacaggggtgaagccctcacaaagaacctctgttagggcagtgtggaagggagaagtggggttgaagcccccataaagagtccccactggggcactgcctagtagagccatgagaagagggccaccaccctttagacctcagaaaagctccagagactcaatgccagcccatgaaggcagccaggaatggggctgtactctgtaaagccacaggggcagaactgcccaagaccacgggaacccatcttttgcattggcgtgacctggatgtgagatatggagtcaaaggagatcatttgggagctttacgatttgactgccctgcttgatttcagacttgcatgtggccattagcccctttattttggctaatttctcccatttggaacagctgtatttatccaatgcctgttctaccatttatctaggaagtaactaacttgcttttgattttacaggctcataggcagaagggaattgccttgtctcagatgagaccttggactgtgtacttttgagttaatgctgaaatgggttaagactttggggtactgttgggaaggcatgattggtttttaaaaatgaggacatgaggtttgggaggagccaggggtagaatgatatggtttggtttggctgtgtccccactcaaatctcatcttaattgtagcttccataattcccatgtgttgtgggagggacccagtgggagataattgaatcatggggtcagtttcccccatactgttctcatggtagtgaataagtctcgcaagagctgaggattttataaggggtttccccttttgcttggtttttttttttattcagttctggctgctgccatttaagacatgcctttcaccttctgccatgattgtgaggccaccccagtcacatggaactgtgagtgctttaaactctttttctttataaattacctagtctcgagtatgtctttatcagcagcatgaaaatggactttatacagcagctgtcccacaaatgttttctgtaactatctaactgtgacagtaaccagaattttagtgagagaacatgattctccaccatgataatgaactccaagaaccaatgtaattcaaacttcactcacttcccttaataatcaaaggataattaacttaagtgcttaaaaatgtaagctatgaatttatgaatacatttgtgcattaatttatacttttattatatattatttgttggtttaacaattttcctgattcagttcttcacttctttcaaactataagagattcctccagttctagcatataagagtttaatagtttaatagttttaagtttatcctaactttacctttagatactaaactcctggagactagaatttctttgttctgtatattcactctgtgtcatagtatgttatgccaagctataaagtagtggccagagaaggaattcaaggattcctccaactcccatttcacacttggcatattttgcaggtgctccacacatacatagttaatgcaagaatgactaaataccatgagagtatgtttctggataagagtctgtggggaaagaattgagaagatgaaggttgaaggagagaagcagacaggaagagaaaactgagaaaagaagcaggtaaaaagactatatggtttcttgtttttttcttcctcctcctcttttcccctcctctccttccctatcaaaactctatgttctgaaaatacagttttctaaagctcttagctgtgacctaccctcataaataattgacaatatgtgtgaagactgtgactgaatcttatgtttggctttcacctgttatatacacataaaaatacaggaccaaaatatataaatgcacatttatatattaaacataaaggaacataaatgcaattccctggcaagatggccaaataggaacagctccagtctgcagctcccagcaagaccaacacagaaggaaggtgatttctgcatttccaactgaggtacccacttcatctcattgggactggttagacagtgggtgcagcccagtgttgtatctgggccagcaagcactatccatcacagcatagtccctcatggcttctcttggctaggggagggagttctctgaccccttgcacttcctgggtgaggtgatgccccaccctgcttctgctcaccccatcatctcagccccaaaactccttaagctgatagcaacttcagcaaagtctcaggatacaaaatcagagtgcaaaaatcacaagcattcctatacatcaataatacacaaacacagagccaaatcatgagtaaactcccattcacaattgctacaaagagaaaaaaccacctaggaatccaacttacaagggatgtgaaggacttcttccaggagaactacaaaccattgctcaaggaaataagagaggacacaaacaagtggaaaaaccttccatactcatgaataggaagaatcaatattgtgaaaatgaccatactgcccaaagtaatttatacattcaatgctatgctcatcaagctaccattgactttcttcacagaagtagaaaaaactactttaaatttcatatttcatatggaaacaaaaaagagcccatatagtcaagacaatctaagcaaaaagaacaaagctggaggcatcacactacctgacttcaaactatactacaaggctacagtaaccaaaacagcacggtactggtaccaaaacagatatatagaccaatggaacagaacagaggcctcagaaataacaccacacatttacaaccatctgttctttgataaacctgacaaaaacaagcaatggggaaaggattccctatttaataaatggtgttgggataattggctagccatattcataaaactggaccccttacttataccttaaacaaaaattaactcaagatggattaaagagttaaacgtaagacctaaagccataaaaaccctagaagaaaacctaggcaataccattcaggacaaaggcatgggcaaagacttcatgtctaaaacaccaaaatcaattgcaacaaaagccaaaattgacaaatgggatctaattaaactaaagagcttctgcacagcaaaagaaactatcatcagagtgaacaggcaacctacagaatgagagaaaatttttgcaatctatccatctgacaaagggcgaatatccagaatctacaaagaacttaaacaaatttacaagaaaaaaaacccccatcaagaagtgggtgaaggatatgaacagacacttttcaaaagaagacatttatgcagccaacaaagatatgaaaaaacgctcatcatcagtggtcattagagaaatgcaaatcaaaaccacaacaagatactatttcatgccagttagaattatgatcattaaaaagtcagagaacaactgatgctagagaagatgtggagaaataggaatgcttttacactgttggtgggagtgtaaattagttcaaccattgtggaagacagtgtggcgattcctcaaggatctagaattagaaataccatttgacccagccatcccattactggatatgtacccaaaggattataaaccattcttccataaagacacatgcacacgtatgtttattgcagcactattcacaatagcaaaaacttggaacgaacccaaatgcccgtcagtgatagactagaaaaagagaatgtggcacatatacaccatggaatactatgcagccataaaaaagaatgagttcatgtcctttgcagggacatggatgaagctggaaaccatcattctcagcaaactaacacaggaacagaaaatcaaacactgcatgttctcacttataagtgggaggtgaataatgagaacatatgggcacagggagggaaacatcacacactgtggtctgtcgtggggagtggggtaggggagcgatatcattaggacaaatacctagtgtagatgacaggttgatgggtacagcaaaccaccatggcacatgtatacctatataacaagcctgcccattctgcacatgtaaaaaaaaaaagaagaagaaaaaaagaaaaaaaagtacataaatacatcatacatttatccacctaaactcaggctaaaagcttaataaatattgagggaatgcattaatcaagctgtgctgccagaatcataagaatcatcatctctgactttctaaggtcagaaacttgattttacaaaattacttagtagacaggctccagagaactgagtcatataactaattcttataaaagaataacatgtgaatgtatataggtcaggttatgggtatgaatatataatattgattcaataattaattatagtagcttttacttgcttatagaaatgggcagatatatttgggaagcacatttatagttcataatgtagttcagtgttcattcaattagaggtattacattatcttaaggtaatttttgtgattaagtatagctctctagagaacaaacaccatttccctgaaatggagttggactagaatttatatacacttccagagtttgagtcccagcttcaaaaatttctccagttctttcttactttagattcaccaatggttaatataaatgtaaaaatctgtaatcattacattaatcagttacagagtttacaatttatggacatttagggaaatatgttatatccaaagaaagtaattgtaaaaaagtatggtgtcaagaaagtcatttttttttgttttgcttttgattttcttttcttttgtctttttttttttttgagacagggtctcaccatgtcacccaggttcaagaacagtagcatgatcatggctcactgcagcctcaacctcccaggctcaagtgaccctccagcctcagtctcccaagtacccaggatcacaggtgcatgctaccacgcccagctaattttctagttttttgtagagatggggtcttgctatgctgtggctggtctcaaactcctgacctcaagaaatcctcccatcttggcctcccaaagtgctgggattacaggtgtgagcaaccatgcctggccgaagaaagtcattctttcatattctttaacatcctaacctttctcatctttgcctcttgatattgggtatatcttgcttttgtggtctgtagcccacactattcactgctttcaaagaagaggaaaagaggtaggttagtcacttaaagtttagccactctagaagaaacaatcacagaaacttatactttgttttttccaatgctagatttgctctagagataaaatacttgttaacatggtgtaggtatatggaaagatgagtgataagaagactgacctgttctattgtcctttcctgaatgtgaatataatgattaaatgattacctctgtccaaaaagataaggttacaaagcagaaatggctagaatattggagaaacatgtctaccatgaaaatattttgagggggaagaggctcaatatacaacacagaatagttttgagcagaatactgtacattggatatcttaagagagatgattctagtacaagaaaaactatcagtagttgtaaaatgaattagagaaacagcaaaataaatcttcaaacaataaaatgtattctttagactctaaaatgtagctttaataaatgattatttatcattaataatcatttattatttattaatcatttattatggttacagaaaaaatagaaaggcactctaaggggaaaacactaaatctagattttctgacgagattcataatgacctatagaaatacacattattggctatttttcactttattgagttttttttgttcttttcctatctatattcctattttcttatcaatgacagtgccctttctcctctttataaataattctttgttgttgttaacccctgaggaggcactttaaaagacaatgatgggaaccaaatgatgtgtggttaaggtgtctaaataacatttttttaagtgtaattagctccctttctgaactatgtagcacagtctgaaggaaggaggttgatggggaggggcaagttcttacttgtctggaacagatatatacagaaagatgtatatattctcttctccaacccacccccgccacaaaatcactccaattatgccagttgtagatttatttaatttaacaagctcccacattcagagatgccaaaaaccctagaataattattcccatcaatcacttgtaggtaagttttaattgctttgggcgtatctattattagttgagatgttttacaaaccagttttatgtaggcagcacaatatttttacaagaaaaccaaacaaagcctttgggcatgtattctccagttcaacaaaagccccaccattctttagtgtctgatactcacctcttttaaccattatgcctaattggtctctcatggcaggtgtcatgccctgtttgaagaatattttgccctgtttggagaataaagctaagttgggcagagcctgatatttgaggagggtaaggttaggtgagtggtcatgagtatacaacataaaataccaaaaaatgtcaaaaaatataaatagaagatgggatggaaagggatcagtaaaagactttactgacaatgtaatacttttgcctacttcaaagctgatcatatcattcctgcttttgttgtcaaatgtatgatactcaggcaagtctggaatacgaaaaacttcaggctaccctagttgagactcctacagtcatggtatcctgagtttaactcaacaggtctccatttggtcaactaactatccccaaatttccacaggtaaagaagagagaaaagcagagaaagaggaaagaaactgagggctacgttccagttagtggctactggtaggaaagttggacatttattcttttcttcccttgccatcttattttgagaaatccaaattccaagatgcaataaatacacatgggcacacacacacactcacacatatagtgctccaaacaaatatgggttagctagagacatataagactgttaatgaaaatgttggaatcaatttgcatcagtaattttaagagaattcttggtttgttcgattcaattgttttgttctaaagtataccaaaaggtcttttaatttgagaatcacatattttcatatctatactatcaataattttaactataatccatattgactcaatattacagattcatgaaatctacagaataacatatgtcacaaataaatatatatcattgagaaaatagcacgatttaggaaatatttctccaaattgtgttccatggagtattgttccatggaatgaatgataacttatgttacacatacacacacacacatacatacacacacacacacacacacacacactttaatgattaaacaggactggctacataattttcaggtccccatgaaaaatgaaactatgagtcccctcgttaaaacattattatgaatttcaagatggtgactgcagagaatgaaaccaagaatgggtctcttcttttttttccttttcttttcttttttttttttttttttgagatggagtcttgctgttgcccaggctggagtgtagtggcatgatctcagctcactgcaaccttcgcctcctgggttcaagcgattctcctgcctcagcctcccaagtagctgggattataggcggctgccaccacgtctggctaatttttgtatttttaatagagtcggggtttcaccatgttggccaggctggtatcaaattcctgacctcgtgatccgcctacctaggcctcccaaagtgctggtattacaggcctgagccaccacgcccagccaagaatgggtctcttctaagcatgggccctatgtgactgcacaggctgcacacccttgaaactagcctcggttaaattgtttaagaaatgctgggttaaaaaatgtctaacagatttctttgcaacaagacttcttatagccttttatatactaatgtgcactgtgaaccttcaggaggttcacatactgtataaaggtcctcaaatatatttgaccaaagctcttttcaattattattttagaaggatcatcttgtaggaccaatgttccacagaacacacattgtaaaaggcagctcaggctgtgcaaacaggttataaaatcaatttgttagtcataaatcactatatatttcccattttgtggcattttccccatatttggaatgaggtaactagagataactatagatgcaaatggtgtgtattcactaaatatactgtccttcactatttggtcttctaccatttggatagtcaactcagtggccaaacatcacaaacgttttctgggccagggtactagagatggtctgattgagactgtatcacaagccaacttatttttcccctttattttgtcaattcagaggaagtaacatccttacttaccattacccagttcccaagaaatgttgtactttttgctggcgctgtacttcaacagactcagggcactagaactgttccaggagttattgggattacgacgcagtgcatttagagcaaatatcaggtggagtccagagcaatcagcaaagttataaagtttgtctagagacctggctgggaagaagcagagaaaggcttgtaactttcaaatcaacattccaacaaaaggaaaatagtagctaatataaaaagcctttctatgagcttcccactaataaggaataacacagacaggcttctaaaagggactattaccttttggtctgggtacatttcaagttgactttagaaagcagcagacagggctgggcgcggtggctcacgcctgtaatcccagcactttgggaggccgaggtgggcagatcacctaaggtcgggagttcgagaccagcctgaccaacctggagaaaccccatctctactaaaaatacaaaatttgctgggcgtggtggtgtatgcctgtagtcccagctactcagaaggctgaggcaggagaatcgcttgaacctgggaagctgaggttgtggtgagccgagattgcaccattgcactccagcctgggcaacaagagcgaaactccgtctcaaaaacaaaacaaaacaaaaaaacaaaacaaacaaaaaaaaacaagcagcagagagaattccagacagaggttgcaaattggcaaccaaatctagtccatcatatgttttatttaacaaagttaaattgctgatgtttgaaaatgggaagatttcacaaagtagctgaatttcttaattttccttgaaaagtcagacaatatggcactgctaggtccatattcctacaggacataagatgaataatagggtacaaggccaggaaggataactggctggtgagtcttggaaaatagctcagcctagtatgatttccaaaaattttcactgaagtccagatttctaatatttctgacaatggaaatactatgaccactactacaaatacgttcattgccgggcgtggtggctcacgcctgtaattccagcactttgggaggccgaggcgggtggatctcgaggtcaggagatggagaccatcctggctaacacggtgaaaccccgtctctgttaaaaatacaaaaaattagccaggcgcggtggcggctgcctgtagtcccagctactcaggaggctgaggcaggagaatggcgtgaacctgggagacagagcttgcggtaagccgcgattgcgccactgtactccagcctgggtgacagagtgaggctccgtctcaaataaataaataaaataaaaaaaagaaatatgttcattatcaggttgataccagataccatcaactctatcaccatgtgtctcctatttatcccattccttcatttctattgccaccattctttttctggctgtcatttacacttggataacttactataatctctgtacttgcctgtctacttctagattcttcccatccggccaattcatcttcccccagtcactctcagccagttttactcaatcctcaaaaccagtggattttcaagaccattttcttccttaattcaaggcttctacaactcacccataattttcccctcaactttaggcctccctatttctcttaatgagttctttgttgatgtcagccagtttatttgttagagaactccttgccccattgacctttgctctccttatttgtcatgcccttactgctttttaaaacatatccatattttacttgtccttttacacagtgtatcccaaggtatggataatatgacttcaggtagtacacagttttaaaaagcttcttagattaataattatgtagaagagtttacgttatcctagtagccgttaaagctaatgcagagtttctcaaatggggttctgtgaaacactagggttccacaagaggtcaccagaggttctgcaagagatgatgcagagtgtccaagttaccccattagcaattttgttatagatcttttagtcctttaaaaaagaaccattatcattgggttgagtattttatcagtttttgaagcaggatataggaagactgccattttcatcttcttacatatataagaaagtatttcttaagaagcaccaagaacaaggacagaaattgtctcatttctgtcaacttatatcatactctacccagaaataaaatcgatgtcaacttacatcatactctacccagaattgagtaattgggcaacaacaacaacaacaaaaggaataaatttcacattcaggaaatacatttaattattatttttagttccaaaataacaattaaaattaaaatgcatttatagcttagtaaagtgatcatgaaaccagtatataataattttataattatctacatgccattaggtaaaaaaataatttttgtcaaagtatcatataaaattgtatcataggctataattttattcatattgctttgatgtatagttttacatgctttactattcaacatcattaatacattttatattcaaaataatattaaagtaaattcataacctttatttaaattaaacctaacaaacctacccttagaaaaattttatcccattgtggcttaaactagttacttaacaaaaacaaattatgtttgccttataagattttcaaatttatgaaaaggaaatgatgaaattaatttcaagaaagacagataactactcttttttttcttttcaatcatagttgtctaaaatagttgtcctatttagttttaaataggacttgcatttaccatacctcagtagtattgatacaacagaaatttgtgttaagactttgaggcccacttgtataagatacaaaaaaaatctagtaggatttttttttaaaaagaaaaactgaagtttcttttatctataccattagaattggtatcctttgtggggagagggaaacaatgcaaaaaataaataggttaagaaactggccaaactaaacagattctaaggaaaatataactctctatttaacagaacactggcaatattggataattatatatctacaactcaatagtcattctaatatactatgagctttagatataataacttttatccagaagtttccttgagatttgagaattattattctaggttactcaaaaaataatttgagtattataagatcaacagaggtccatttttaagtcctctattattcatgtcatgaaagttatattatcataaaaaatactcaatattcaattaaataacattttattcatccatagtttcaatgacatctattaagcatgcaataaaattacttattttcataatttttggtttcatttatatactaaaatccatatcaaatgtttgcatcaaaatttaatatgaatgactgatattccttttggatagattgattccatttaagtcatctttttctaaaactatttccatataatgagtattttactgtgtatgtttcacatgtattagaaacacaaacacacatcaaacacaaaagcatatcaaacctttgatttcatggatttgatggtttaaggcaaggcaaaatgtatttacaaaaaatgtgtcaacataaagagcagtatgggagaaacagtatggatagtttgttcacatagcaaaaattgggaactagaatgctaaaagtttgggaaatacttctttaagaataagtttaagtcctgcctcttccatgacgccattcctgaacacaccaacctcccgaaagtgatttcgactttctctaaactcaagagctataccattttttggcatctcactgctctgtgacatattatctgtgacataatattatcttgggatttacttcttgatttattcacttctccagagtgaacaacttgttttcccagttaaactgtgaagtttcttaagtttggtaccgtatcttatatccttcatagcatctaacacacagcaattttctgccttaatatcatgccgaagagttctcaaggcccaaatcctttgtgttgcataaaagtggcctataagaagtagaaagaggcaaaagagagatctgtctaaaataattattgctaggctgggcgcaatggctcacacctgtaatcccagcactttgggaggctgaggtgggtgaatcatctgaagtcaggagttcgagaccagcctaaccaacatagtgaaactggtctctaccaaaaatacaaaaaaattagctgggtgtggtggcacatgcctgtaatcccagctactctacttaggaggctgaggcaggagaatcgcttgaacctgggaggtggagattgcagtgagccaagatcacaccattgcactccagcctgggtgacaagagtgaaaatccgtctcaaaaaataataattattgctaatctaagacatatgttctacagtttattagaaaagtacatatatttgaatatagagaatttagtagatattcaacacatgtaatctcccttagaaaatttgctcaggttccatcaaaacaaatagatacttaaagattactttctactccctccaccagagggggccaatgcctctatgtcttatagtcagggtgcattgacatttcacaggcatataattctaagaagcactggatagtgggcagttgaagatgaggagctgggacttgagaaagatgtaaaagtatacaggcttgggtgtcactcagtgctgacagttgatgctgtgaaagttcttgagatttctgaagggcaaaatgtagaaagatggctgaagagaaaaccttaagaaatgtccacatataagggtcatggagaacaacaacaacaacaaaaagagaagaagaagaacccagatatgcagtcttaaggaacccaaaataagagagttgcaaggaggtgctgttccataacagtaggtgttcatgacaaactgaggaggaaaaggactgagaaaaaaaaaaccattagattaatcaaacagtgaggttagaaattagatttaggttgtgatgagaccttaaagaatgagtagatgaacaaggaatagattctgatacattcagcttacttattgaagttctgtggcaataaaaagaagaaaagaaacaaaatagtaatgagagaagaaccagattgttttttttaaatgcaagatccaaggtaagctacttctttaataaagttaatctcagttttctattaggaaaatgtagataagggtcaatgaattcacactaagatatgaatgacagattatttctcttagtttccctagtacttgacactttaaaaaccaaacagacaagcaatccaacaaacaaaaaattggacattcattaacttattaaattactcaacaaatatttattaagcagttactacgtgacaggcactattatacaccatatatatctgtaaatatacacatatgcatgcatatatatctatatatacagatatacatgcgtgtatatctgtacatatacatgcatatatatatctgttctgtatatatacatatatgcatgcatatatacatatatacatgcatgtatatatacagatatatatatgcatatatacatacatacaagaagatagatatacatatataaaagaagattatatagtatataatagtgccagctttatgatggtgcaaaagcaatacacactcagtagaaatcgtacttcaaatacacaaccattttgtttttcactttcagtatagtattcaataaattacttgaaatattcaatactttattataagataggctttcagttagatgattttgcccaacagtaggctgatgtaagtgttctgagtgcatttaaggtaggcccggctaagctatgatgttcagtaggttaggtgtattaaatgcatttttgacttaccatagtttcaacttatgatgagtttattgggacataacctcataagttgaggagcatctgcatgtgtaatttatatattttatatatatatattaaacactatatatatatatatatacacacacacttacacacacatttatattgcaatgagcaaaacagaaaacaggccctaccctcatggaggttacatttaatgtggctggcaggagaagtaaagcagggtaggagatagtatagaaccaatagtagctagtatgctattttaaataagcatcacaattaaggtgtcatttgatcagagacccaatggaaagaagggagcaagtcaagtagataactatggaaagaattccaggcagagggtcctacagtaagggcaaaggcccaagactcatgtgagactgatgaatgtgaagaacactgagaggctggtgtagctgccccagaatgaatgagagggagagcagtaggagatgagatcacagtggtagcaaggacatgtcacgaagggccttactggtcattataagaactttggcttttgccctcattgacatagaagccattagatggttttgaatatgacccaactcacactgtgaaatcatcactctggctgctgagctgaagagactgaaggggatgggaagagcaagggtgaaagcaaggaaattaggagtctatagcaataattgaagcaagggatcattgtggcttggaccagggtggtagcagcagagcggtagaagtggttggtttctggggatgttttaaaggttgagccagtaagatttgctgaaggattggaatgtggtgtgtgagaaaaaaagagtcaagaaactctgaagtttttggcttaagcaacagaaagataaacttgatatttatgaaggaagtgtgaaagattgggagaagagagaagaaggccaagatgagaatttgggcttggggcatgttaagtttgtaatgtccttagatgtataggtaaataatttgagtgggcagaatatgcaaatccagagttaagcagtgggatgtggatgggaagtataaagctgattaagcaaaacattttcaaaggttgggagagatagagaaccttttactggaaagaagagagacaggagctgtcatagggatcttccagtttacagatgccaatgtcattaaagtagcttagtttccatcccagctcttccccctcctccccttaatgctgagcatctacttgagtctcaccttccttgattccgtattcagaattaacttcccacctttttatcctgtttttgttacgtatttccctcaaagtcacagctaccttactttccctccattatttgacagagacgattaacattttcttcatgttttgtaagctactatgcaaacaaagcttatagacatggctccagccctcacttttcaaattgatggccccctctaagctcctcttccatagaaatgatggagcaacaactgttacctgggaattaaattggcacaaattttattagactagtgtttgagaccaagtgtatgcaagtttcacatagaaaacatagttaatttgttttaaggactcagttcaatactgttcttttcttaattggcaaaaataactctaatacccctttgtgactattttattcttttgcaaccttcacatgaagaaagagtgttttttctgtgtggttaagaacttgggcacatgatccagacccttagctcttggaagacagggctggtgactccagaaggaaaaatgggtgcctatagaacagtatcaacttattctaattgtgagcatgtgagaatatggacagattatcaagtcacatgaacaacaaaatctagagactggacatacttgaacagaactcaacgctttgatgtcaggcctctgagaacagcttccccatagttccccaagggggaaaaacatgcaatggaaaggggcctatttggggttgggttaatactagggatgacatcttaagtattgagctatgaagaagctttaatgagttgtgatagaactcaagaagcaaaattggaagtcaaaattactgagaagttaaaatttaagggtttacttttgtggaaagattttttaaaaagtaagtctttaatgctattgcttaactcttcttcataaactctgttctttttaaacacaattctcaatctttctatcagtctattccatgtatattttggagaggacaggctccctactcactgctcttaatataaccttgcatttggttgtagtgagacaaagaacatttggattcttcttatctaggtttatgaaaggaattttcaggctctgaaaaataaacactattatgaaaaggatagaaaaatatgtgactgtgacaaagacacattttataaggaaaaaagtcagaaaaacttgggaacaaaagagctgcataagaaagtcaagtccaatatgaaataaactaaaatgtgatatggtcttaagcagttaaaagagtacaaagtaaagacagacaaatttgaccttgaggataggaagattctttgggtagcctatgggttttaacattagactatatagcagaaaatattaacctaacatagatcttgtcccagcagtaaatgacatttatatcatcataattatataaatactcttcattgcttttcagtatctggatactttctacagaaaactgtaaataatttggctgggattgcagaacaaaatgtaataacaccaatgataaagtaaaaataaacgtgttagtgaaaatggcaaaagtcttgaaagggtataggggacatagataaaaggacatcagtattaatattctcatcttacagagctgtaagagcatcaagaaatattgccaaaagaccaaaaagatatctgcactcccatgtttatcacagcactatttacagtagccatgatatggaatcagcctaagtgtccatcaacagatgaatggataaagaatatgtagcacacatacacaatggaatactactcagccataaaaagaataaaatcctgtcatttgtgacaatgtggatgaacatggaggacagtacgtgaagtgaaataagccaggcacagaaagacaaatactgcatgattttactcatatgtggaatctaaaataagttgatctcaaagaagcagagggtagaatggtggataccagatgctgaggactttagttgggaggtgggggtgaggaggtgttgattaaagaatacataattacagttacataggaggaataatttccaagagatctattgtggaacaaggcaactataggtaatgatgatacattgtattctgtaaaaatgtaaagagaacagatgttatgtattatcactaaaaaaatgataactatgtgagaaaaaaagtcaggtaatgacaagtgctggcgtgggtaagagaaattggaacgctttgcattgctggtgggaatgtaaaatgctgcagcctctgtggaaaacagtggtggtttctcaaaaagctagatctaaaattaccatatgattcacaatttcactcctaggtatatatccagaagaactgacagtggggactcaaaaggatacttgtacatcaatgttaatagcagcattattcacaatagccaaaaaggtggaaaaaactcaagtgtccattactaataaatatataaacaaaatgtggtatatcaatacattggaatattattcacccataaaaaggaatgaagcacttttgctggcaccttccatcagagtgttgtggccagcagactgggaacatattggcccctccagcacagcagcaagtgcttaaccttgggggccggaggacaaagccttgggcctggtaccagccccccagggttagagcatgcagcccagaaatgcttagctgagcctcggcccctgaaatccagaaaagaaactagtcaactgaatccagcttataccacagtcaaaccttcaagggcatcaaagaatataaaagcaaaaaaccctatccaaatgacagtaacttcaaaattaaaggaacatcagcacccacagatgagaaagaaccagaataggaactctggcaactcaaaaacccagagtgtcttcttacctccaaatgaccacactagcttcccagcaatggttcttaaccaggctgaaatggctgaagtgagatatagaattcagaatctggattgcaatggagatcactgagattcaggagaaagtcaaaactgaatccaaaaaatctaaaaaatccaataaaatgatacaagagctgaaagatgaaacagtcattttaagaaagaaccaaactgatctgatagagttgaaaaactcactacaaaaatttcgtgatacaatctggaagtattaacagcagaatagatcaagctgaggaaagaatctcagagctcgaaggctagttctttgaatcaagtcaatcagacaaacatagggaaaaaagaatacaatgtaatgaagaaaacctctgagaaatatgagattacgtaaaaagaccaaatctatgactcgctggcattcttgaaaggagagagagagcacaagcaacttgaaaaacatatttgaggattttttccatgaaaaattccccaacctcactatagagtttgacatttaaatttaggaaattcagagaacccctgtaagatactatccaagaagaccatctccaaggcacacagtcatcagattctccaaggttgatgtgaaaaaaaatattaaaagcagctagagagaaggggcaggtcacctacagagggaactttatcaggcaaacagtggacctttcagcagaaactctacaagccagaagagactgggcacctgtagtcagcattcttaaagaaaaaaaatttggggttagaatttttctttaagaatgctgactacaggtgcccaatccagccaaactaagattcataagcaaaagagaaataaaatccttttcagacaagcaaaaggtaagggaatttgttaccacctgaccttccttaaaagaggttcttaacagagtactaaacatgaaaacaaaagactgttttactggtcattacaaaaacacacttgattgacactataaagcaactacacaatcaagtctgcataaacaccagctaataacaagatgacaggatcaaatctatacatgtcagtagtaaccttgaatgtaaatcagctaaacgccccacaaaaaaggcacaaagtggcaagtaggataaagaagcaagacccaactatatgctgtattcaggagacccatctcacatgcaatgattcataagctcaaagtaaagagatggagaaaaatctaccaagcaaacagaaaacaaaaaagagtaagggttgctaatccaatttaagacaaaatggactctaaaccaacaatgatcagaaaaggcaaagaaaggcattacataatgaaaaaaggttcattcaacaagaagacttaaatatcctaaacatatatgcactcaacactggagcacccagattcataaaacaagttattagagaactatgaagagatttagatacccacacaataataatgggaaacttcaacaccacactgacagtattagatcatcgaggcagaaaactccaaagatatttgggaactaaaactcagcacttgaccaaatggacctaacagatatctgcagaacactccacccaacaacaacggaatatacattcttctcatttgcacatggcacatgttctataatagaagacatgctcggtcataaaacaattttcaaaaaaattttaaaaaatcatatcacccaccctctcagaccacagtgcaatacaaatagaaatgaatactaaacagatctcttggctgggtgtggtggctcacacctgtaatcccagcactttgggagtttcaggtgggcagatcacgatgtcaggagatcgagaccatcctggccaacatggtgaaaccccatctctatgaaaaatgcaaaaattagttgggcgtagtagcacatgcctgtaatcccagctactcgggaggctgaggtgagagaactgcttgaaccagggagttggaggttgcagtgagccgagatggtgccactgcaccccagcctggcaacagagagagattctgtctcaaaaaaacaaaaaacaaacaaaaaagatctctcaaaaccatataattacatggaaattaaacaacctgttcccgaatgacttttaggtaagcaatgaaattaaggcagaaatcaagaaattctttaagacgaatgaaaacaaagatacaacatactagaatctcggacacagttaaagcagtgttaaaaagaaagtttatagcactaaacacccacatgaaaaaggtagaaatgcctcaaattaacaacctaacatcacacctagaggaacaaggaaaacaagagaaaacaatgccaaagctagcagaagaaaataaataaccaaaatcagagctgaactgaatgaaattgagatgtgaaaaaccatacaaaatatcaataaaactaaaagtttgttttttgaaagaataagattgatagaccactagctagactaataaagaaagaagaaagaagatccaaataaacacaatcagaaatgacaaaggggacattaccactgaacctacagaaataataattaaaaaaaccctcagagactgttatgaacacctctatgcacacaaactaggaaacctaaccaggataaattcctggaaacatacaacctgtcatgactgaacaaggaataaattgaaaccctgaacagaccaataacaagttctaaaattcaatcagtagttacaagcctaccaaccaaaaaacaaaaaagccctggaccagaaggatttacagccaaattccaccaaacatataaagaagagttggtaccaatcacactgaaactattccaaaaaatccaggagaagaacctcttctctgacttattcatgaggccagaatcattctggtaccaaaacctggcagaggaaggaaacaaaaaaaggaaactttaggccaatgtctctaatgaacatagatgcaaaaatcctcaacaaaatactagcaaactaactaatctggcagcacatcaaaaagttaatccaccacaatcaagtaggctttattcctgggatgcaacattgcatattaatactcaaattaataaatgtgattcatcacataaatagaacaaaaaacaaaacccacataatcatctcaatagacacagaaaaggctttccataaaattcaacatccttcatgttaaacatgctcaacaaagtaggcatcaaagaaacatatctcaaaataataagagccatctatggcaaacccacggccagtaatatattgaatggacaaaagctagaagcatttcccttgagaaccagaacaagataagaatggccactcttagcacctctattcaacatagtactggaagtcctagtcagagcaatcagataagggaaagaaacaaaatgcatctaaataagaagtgaggaagttcaaatgatctctcttcacagacaatatgattctacacctagaaaaccctaaagactccaccaaaaggctcctggaatggataaacaacttcagtaaagtttcaggatacaaagtcaatatacaaaaatcagtaggatttctatacaccaacattgtccaagctgagagccaaatcaaaaatgcaattccattcaccatagccataaaaaaattataaaatacctaggaagacagctaaccagagaaatgaaagatctctacaccaaaaattatgaaacgctgctgagagaaattagagacaacacaaatattaataagtggaaaaacatttcatgcacatggatagtaagaatcaatattgttaaaatggccatactgcccaaagcaatttacagatccagtgctattcctatcaaactaccaatgacattttccacagaattagaaaaaaatattttaaaattcatatggaacaagaaagaacccaaatagccaaagcaatcctaaacaaaaagaacaaagccagaggcatcacattacctgactttgaattatgctacaaggctacaaaaaccaaaacagcacagtactggtacaaaaactgacaaataggccaatggaatggttacaatactgagaaataaagctgcacatctacaaccatccaattttcaacaaccttgacaaaaacaagcaatgaggaaaagactgcctattcaataactggtgttgggataactggctagccatatgcagaagattgaaactgaaccccttccttccaccatataaaaaatcaactcaagatgggttaaagatgtaaatgtaaaatgtagaactataaaaaccctagaaaaagacctaggatatagcattctggacatatgccctggcaaagatttcatgatgaaaactccaaaagcaattacaaaaaaaaaaaaattgacaaatgggacctaattaaactaaagagcttctgcacagcaaaatgaactatcagcaaacagacaacctacagaatgggagagaatatttgcaatctatgtatccaaaaaaggtctaatatccagaatatataaggaacttgaacaaattaacaagcaaaagccaaacaatcccactaaaaattggccaaagggcatgagcagacacttctcaaaagaagacatacacatggcccacaagcatataaagaaatgctcaacacattgctaatcattagagaaatgcaaatcaaaaccacaatgagacatcatatcataccaggcagaatggctgttattaaaatgtcaaaaaataacagatgctggtgagcttgcggagaaaaacgaatgcgtatacactgttggtaggaatgcaaattagttcagccattgtgggaagcagtttggagatttctcaaagaattcaaaacagaactagaacttgacacagtaatccctttactgggtatacacccaaaggaatataaatcattctaccataaagatacatgcatgcatatgttcaatgcagtgctagtcacaatagtgaagacatggaatcaacctaaatgcccatcaatggtggactggataaagaaaatgtggtatatacacagcatgaaatagtatgaagccacaaaaagaatgagctcatgtcctttgcagcaacatggatagaactggagaccattatcctaagtgaattaatgcaggaacagaaaaccaaacactgcacattctcactgacatgttattgctaaacactgagtatacatggacacaaagaagggaaaaatagataccagggcctacttgagggtagagtgtgggaggagggtgaggattgaaaaactacctattgggtgctatgcttattacctgagtgatgaaataatttgtatgccaaatactcatgacacacaatttacccatgcaacaaacctgcacgtgtctcctctgaacctaaaataaaagttggaagaaaaggtaattgcccagaccaatgtcaagacacttttcccctgtgatatcttctagcaattttacaagttttgggtcttattgttttagtttttcatccattttgaattaaattttgcatatggtgttaaataaggatccaatttcattcctcagtgtgtgtatatccagtatcccaatatcatacattaaagacattatctcttccccattgtgagttctcagaaccgttgttaaagatcagttgactaaaaatgtgtgggtttattgctgggttctctgttctgttacattgatctatatgtctatttttatgccagaaccattctctttttattagcttagctttgtaataatattttgaaatcagagagtatgatgcctccaactttgttcttcttgctcaagattgctttgactattcagggtcttttgtggttccatgtgaattttagaattgttttactatttctgtgaaaaatgccattggaattttgatatgaattgcattgaatctgtagatggctttttgtagtagagacattttaacaatattatttgaattcataaacatgggtatcttcccatttatttgtatcttatttatttctttcattaatgttttatagtttttagtatgcaaatctttcactttttggttaattttattcttaagtattttgttctgatgctattgtaatggggttttaaaaaatatcattttcagatagcttgttgttaatatatataagcactactgatatttgtatgttgattttatatcctgcaacctgtactgaattcatttattaattctaacaattttttagtgaagtatttagggttttccctatataaaacgatgtcatctgtaaacagacaatttcactttttcctttttattaataatttgtttatgatttagccttggcaggtttcatttcttttttgttgtccacttggtctgggtaggacttctagtactatgttgaatataagtgataagaatggacatccttgtcttgttactaatcttagaagaaaagcttttggctttttactgttgaatatgattttggctgtgggcatgtcatatatgacctttattatgttgagatacattctttgtatatcaatttgtttagagttttatcataaagaatgttgaattttatccaataatttttctgcatctattgagatgatcacatggtttttgtcctttagtctgttaatatggtatatcacatttagtgatttgtgtatactgaacatcttgcatcttcggaataaatctcacttgatcatgataaattagtctcttactgtgctgttgaatttgctttgctagtattttactgagaatttttgcatttttgtccatcagtgatactttcctataattttcttttcttgtagtgaccttgtccagctttggtatcaggtctttgatatgagctttggtatcactaaagttggtctcataaaatggctttgaaagtgttccctcctcttcaattttttggatgagtttgagaaggaatggtattaattctttaaatgtttggtagagttcacttgtgaatccatctggtcctgggctttactttgttagaaggtttttgacaactgagaatcttacttatttttggtctgttcaggttttctatttgtttatggtttaatcttcataggttgtatgcttccagaaatttctccattttgtctaggttatccaatatgtggtgtacaattgcttgtagtagtctcttataatcctttgtatttctgtggtatcagttgtaacatcccctttttcctttataattttatttaagtcttctctcttttttgtttagtctaactaacatgggaataataaaaatgagaacagaaataaatgaaatagacattagaaaacccgtagaaaagatcaaggaagctaagagttggctttttgaaaagataacatcaacaaagcaactcctagctttcttgatcttttctatttgtttcttaatctctatttcatttacttctgttctcgtctttattatttccttccttctgctaactttcggtttcatttgttcttctttttctaattccttgagataaaaagttcattaagatctttcttttttcttaatgtaggcatttattactataaacctccttcttcatttataattctgacagtgaaaatttcaacataaaattatttacccagaacaaaatagcttccaaatatgaagacatgactgccattgtcaaccaatatggagtaagccaactacagtgtatatttcatactgactacaactaaaatctctggacagaatacaaatggcaatgacctaagaactccgaaaagtaaacagtagcaagcggactggggacttaacttacaatctggacaatgatctgtaatgaaggtgagtttcatggtcttatgttcttcctttacctccagtctttgactaagataaggcccaagtggcagaacagtgtgataggcgctaaaagtagaaattctgaaaaacaaagcattatttctagccatagaatcagaaaaagaggccccccgcaacatgccagacagtttgagaatactcatttaccttccctcccctcccctcctctcccctgtcttcccctcccctcccctcttctcctctcctttccttccctttcttttcttctcatttctctcccagccctgcccataggactagccacttacagagttttatggctatgacattgatgacagaggcacctaagatcctgaaaagggacttgtctctctgcacagaagaattgaaaaatgggaccttgttccttaaataatgtggaagaatttcctttttaaaaaatccctctttctcaccagtttgcctctaaagaagtcccagtctcacagaactgaaaacctggcgggggtggggggtggggggtgctaaaaccttgagaaaaaagataatatatttggaacaaaagaagtgaggaaaagtctcttaaatccagagagaaggagagagacagagagaaaatgttcggggctggaggattcccaagaagagaacactggagaaggggactcatctaattctggatatgaaacagcagaagtaccaggatcatgctggagttacctgcaggcaaaagagacccaaagaagcacagaaaagtatttaagaattgaaatgtgataaaaccatgggccaagtcccaaactaatttctgagtggtacatgtactgggtagactcaaactttaataacagaactgacattgaaaccaccatgcatgggagatgagaccaaatttacagtctgaacataaccacattgatcccatacttttaaaaaaaaatgggacacaggttctgacaatgtaacattcaaaatgtccagaatatgattcatattaagccacatgaaaaaaataataaaacaaaacaaaaagaaaatctgaccaattctcaagagaaaagacaatcagcagaggacaatcctgagatgatccagacattgtattatcaaataataataacaattatcaaagacttgaaagcagccagtatagccatcacccatgatgtagtgatgaacatgttttaaatgaataaaatatgcctaagaactagaaaccataaaatagaaccagatgaaaattttagagctaaaatatataatatttgaaataaaacctttacttgatgggcctaataccagaacaaaaatgacagaagaaaaaaatcaataaacttaaagataaaacaggagaaatatacaatttaaagacagatttttttttaatgaacatagtctcagtgaactgtgagacaatatcaaaaggtttaagactcatgtcattggcatcccaaatgagaaaagaaagacattactacaggaaaaaaacatttaaagaaacagtagttgaaaacttcccaaatttgatttaaaaaataaacttaacaaaatcaagattctcagtgactctcaaaacaatgtaaactaaaaaccaaaacaaaacccatacatacccagacacataatcataaaactgattaaatccaagtataaagaaaaaaaatcttgaaaatagccagagaaaagcaacatattacatataagagaaaaatgatttaaatgatcatgtacttctcatgtgttctcttctctggaatcttctgccagctctcaaacattttctctatctggatttaaaagactcttttcctcacttcttttgttccaaatatatatttttctgacgagaaaagagggtttttttcttatatatttatcataagaaactatggagatcagaagaaagtgaaatatcttcaaagtgctgaaaaagaaaagactatatctagagaatatatttttcaggaataaaggtgttacaaagacattttcagatgaaaaaaaaaaaactagtagaatccattgtgaagaaacttgctctaaaagaaatgcaaaaggaagtcctttaggctaaacagaaatgatgccaaagggaaatgaacaaaggagaagcaacagaaatagtaaatttgggggtaaaggtaataggctatttttctcctctcaaataatttaaaagatgtatggcagtttaaagcaaaaatcacaacactgtctgaaggaacttcaacatacatagatgtaatacatcaaacaactatcctcttgcccctagttatttaatgtattaattacatctatgtatgttgaaattccttcagataatgttataattttggttataattataatttttgttataatttagtaaaaatggtagaaatggtcaaatactaattctaagtaaactgagaaaggttatgtatgtattttttaattcctgaagaggtcattaaaatactgcaaatgtagtcaaaaatcaataaattcaaatggaacactaaaaatattcatttaatccaaacaatgggagaaatgggggaatagaggtaccaaaaaaacatgaggggtataaataaatttgttaaaagcaaataaaagacaaaaagaaagcaaataaaaacaaatttagaaatctatagaaccatatcaataattagattaaatgtaaacgtaccaaaaagtacaaacttgttagatttgatttttaaaaataaatccaattatacactatgacaagaaacccacttaaaatataattatataaataggttaaaaggatggataagccaggcgtggtggctcacgcctgtaatcccagcaccttgggaggcagaggcaggcagatcacttgaggtcagaagttcgagaccagccagaccaacatggtgaaaccctgtcttctactaaaaaaacacaaaaattagccgggtgtggtggcacgtgcctgtaatcctggctcctctggaggctgaggcaggagaatcacttgaaccagggaggcggaggttgcagtgagccgagatggcaccactgcactccagcctgggtgacagagagccagagagccagactccgtcataaaaaacaaacaaacaaacaaaaaaactagagtttctgtattttccttggagaaaggaaacttaggaataaaaaaggccataaaattatgataaacaggtcaattcacaaacaaaatataacaatcctaaaagtacatgtacctaataaacttccaaaacatatgaagcaaaaattgacataactcaaagaagaaacagccaaatctgcaattacaaatggagacttcaacacttctctctcagtaatcaatagaacaagtagatggagacctgaacaatactatcaacctacttaacctaacagaaacttgaagaacactgaagacaactatagtaaagtacattctttagcagtgctcataacactcaccaagacagaccatattctgggccataacttaagcaaatataaaagaactcaaatcatacaaagtattttatatgaccataatggcattaacccagaaattagtaacagaaaggtaacatctggaaaattctcccaaatattgggaaattaaactactgctataagttacttttaggtaaaagacaagtcagaagggaaatcataacatatattcaatggaataaaaatgaaaatagaacatatcgaaatttgtgtgatgtagccaaagcagtgcttacaggaaaattgatagcaaaaaatgctcttatttaaaatgaagaggccaggcatggtggctcacgtctgtaatcccagcactttgggaggccgagacgggtggatcatgaggtcaggagttcaagaccagcctggccaagatgctgaaaccccatctctactaaaaatacaaaaattagccaggcatggcatggtggcacgtgcctgtaatcccagttactcaggaggctgaggcaggagaatcacttgaaccctggtggcagaggttgcaatgagccaagatcacgccactgcactccagcctgggtgacagagcaagactctgtctaaataaaaaaataaaatgaagagaggtttcacatcattaatctaatcatctaccttaagaagctataaaaagaaaagcaaataaaatctaaagcaagcagaaagaaatagagtagaaataaaattgaaataaataaaaatcaatcaactaaaagctggctcttcaaaaagatcagtaaaattgataaaactctaacagaccaaaaacgagctgagagacatacaaattaccagtatcaagaagggaagagatgaatcaatataaaccatataaatattaaaaggaaaataaaatattatgaactatccactatccataaattcaagaataacgtccataaaacagaacaatgccttgagagacacaaactaccaaaattcattcgagaaaaaacagaaaataggaataatcatatatctaccaaggaaattgaattcatagtttaaaaccttcaacaaagaaaaccacagaacatacactagttgatttcactgctgacaccaattctacatcagtaaacatttaaggaagaaataataccatttctaaacaatctcttcctgaaaacagaaggaaatagttcttaatgcattttgaggccagcattatccttgtaacaaaatgaaataaagacattacaagaaataaaagatataagccaacatctctcataaaaatgtaacaaaaatccccaacaaaatattaacaaattaattcacaaatgtaaggaaaaataacacaaccaagtggagtttattccagcaatgaaaggctgattcaacattcaaaattaaatcaatgggcagggtgtggtgacgcatgcctgtaatcccagcactttgggaggctgaggcaggcagattgcttgagctcaggaattggagaccagcctgggcaacatggcgaaacccaatctctactaaaaatacaaaaattagctgggcatggtggtgcacacctgtagtcccagctactcaggagactgagatgggaggatcacctgagcctgggaggtcgaggctgcagtgagccatgatcacaccactgcactccagcctgggtgacagagcaagaccctgtctcaaaaacaaaaaacaaaacaaaaaaaaccccacaatattaactcaatgtaattcaccatattaacagactacataagaaacagcacatgataatttcaacagatgctgagaatatatccgacaaaattcaacattaattcattattttaaaaaattcatagctatgaacttctttagtttgataaatggcatctacaaaatgttccagctaatgtcatatttaatagtgaaaaattgaatgttttctctctccagagaagctttttcacttgtgtacaaggagacaagaacaagaattttgactgaaaggctatttgcaataagaataaattagaaatagcctaaatgtccatctataagaattgataagtaattttttgaaaaataaaccagagttacatgtattaacagaaataaatctcaaaaacataatttacagagaaaaacaagggagttgcctaataatacatgcagcatgatactatttgtatgatggttaagacatacaaaatagtactatacaatttattatggaaatacattatatgtttatataatacatgatatatacatgtatatgttatgcatattgcactatatatactatatatattatactgtatatacatatatgtatattatgtaatgctatatataatatgtagttatatacaatactataacatgtatagtatatgttaatatgtaatatttattaatatttattttaaatatattatttatgtatctataaattatatcaatatttttatacatgatatataataaattcatatataaacatacatgtatttttaatgtatcaatactatatagttatatattactacatcatatataaatatgtataaatttaatatactatacacttatttaatatatattactatataaacatttatatccttgaaagacatatgttctatataaacatttatatagaaatatatattaaataagcatataatatattaaactgatacatatttatatatggcatagtaatatataactatataatagtgatacattaaaaataactatctgtttatatagtataagtaaaataaaacaaagggaaatgtaaattaaaaattcaggatactttacctcctctgtgttatactggaaaataatgggattggagagaaatactcaggcaggtttaaattatgtctatactcttatttcttctaaaatattggaagcaaatagtccttgtgtaaagatttatcagtcttaacaaagttacttactggtgggtgatgggtgtttgtcacataattccctacacttttttgtatagttttattttttcctaataaaaatactagaaggaaaaaaagttcaacacacttacttgttccaattaaaaagtttgtctccggagagaagggctgggataggtggtggtaggaggaaagcgggcaggagactcttgcttttcaccgtgagctcctctttactatttgatttgtttttgtcagtttataattctcacaaaattatttttgttttaataaaaatgaactgatagtagaaaatggtgagcacaatttcagattctaaattatttgatgacttgatcatatttgatcttgtagttttcaagtttagcatcagtacccagcacagagtggttactaagtacatgtttactgtttgttttattttatttactaaatattatagtccacatatataaatatgatgtctgttttctaatcactggccccaaatttattctgttcccttggacaaatcatttaactctatggtacttcagattccttgttttacaaaagtcaataataatacttgtctcagctggtcatggtggcccacgcctgtaatcccagcacttcgggatgttgaggcaggtggatacttgaggtcaggagttcaagaccagcctggccaacatcgtgaaacctcatctctgctaaaaatacaaaaattagccaggctggtggcaagcacctgtaatcccagctactcagaccgaagcaggagaattgcttgaacctgggaggcagaggttgcagtgaagggagatcgcgccactgcactccagcctgcatgacagagcaagactccatctcaaataatagtaataatcataataataacttgtctatgtcccaacattattttaagtttcaaataagaaaatggatatcaataaactgttcttgaaaggtataaagtatacgcaaattgaagaaatgtaggagaccactggaagattgggaagaattctcaagagatcatatcatcacataaatatccacagtccatggttttccagaacatgttagtgaccataaaaaacaccctctttccatatatgtgtcttgaaagtctgaatatagcttgttgttttggtggagtggaggtgggagttgggggatgatattttgtgtagaaatattatggaaatggacatctttagtcataattaaagatgttttcttaggaagaaatttcttaagatggcatgatgacacactactcagtttctggcaaaggttccactgagcctgtgataaagcagtaacaagtataacacttcttacttgacttaaaaccattttggctctaggacagacctggctgtcccatgagtgcggggtgtgggtgctaaataatccagggaagagcaatgactatgtagagatatggggcctctctccaaatattgtgattctaatgtgagactataaagagctagcctcggaaggaaggagatggttaagaaaagaggtcaccaaatatttgttggcactgaattagtcacttgggtactgagtataatcaaagctgagacatggtccttgctttcaaggaatttataggctgagacataagtaacttggacaccaccagcagactatcaacatgggatggaataatgagtcaaaaacatatgcactattcatattgatcacatacaaaagccacacttttatattactagtatattatttttcttttggatacaaagatggaatgttattgctaagtttgaagagtctatctaaaaggtccaaagtatatctagaaagagaaatccctttgcccaaaccactgaaatagtaatagggcacgcacttggtgacatatctcaaagttcccagaaatagtccaagtggccttgcatggctagaaagttctccgcttttaattttgttgtgttccaaagacttacttgtgagtcagctgttggaaacttggtatgtgttttcacattgaaagaaagccacaagtgagggtcatttctttagatgggccaaaaaaaggttgtacaaatccattctgaataaggaattataatactaatggaatggtggaatctgatccctaggtgtaactatctgtgtgtatatatgtgtttgtgtatgtgtgtgcatgtgtatgtgtgtgccatgaaaatgcaccactcacatctgccacagggagcataactgattaatggttctagctactcctcttctacatatatcactgcatttgtgccaaggtcacacttcccatgagctgcttctagtcaatgactgaacacagtagccaaggatattaaggcaggtttattccagcaaattataggactcttcctgcagataattttggcttgaggactccccatgagcctggctgaatcatttttggaaatgccctagtctaagatgccttcccttctcctcgcctccccttcccccaaccacagacattagactggtctgaaggctttcttcaccttcaccagttcctccctgcttccaatcaatctctggaacatctaatcgtatcttagtgtctgcttcttggtagactcaatctactgcaagtaacagtgaaaatggagcaaaaaagcagggaatacgatggggatttgtgactgactcatcaaccaaaagggaaaaggggggccatcctgaatggggtaggtgagcatgaacagcccctgacaaaaggtgatggctcatttactaaatatttcattagtggttatctaagaatttagccaggtagagggatgcagctgcaataattctgggatttaaaagacatgaggagaaaatatctatcaagagagcagagttgcaggctaccgcaaaattatattgaggccctgggaaaaaatgagaaactgagggagttaacaagtaactaatggctaaatgggagagccagaggacttctctggtcattaataaaagggctgttatatcctgtggtggaaaaacagacatggctaagcagaaaactgaagatctgatggagttatagggattcagagatgtttgaatactcaatcaattaagctggtctgttatgctatcagggctatattggaaaaacccagtaccctgaaatatgagataggcccatttagatggatttcagctccaaatattggagctgaagacctccctgaaccctcagagtttagtgaccacccttccctaataagaggtagcacctgccctgtgttggaaaacctggcagaagcctatccctgcaaggcaacagttgatccctttgggagccactcccacctcctctcctggataccaggctgataactagaattaaagcccaggatagcccaactaagaaaacaaatgagactatgtagccaggagttatgaaaattagctaagatgtatcaataggagccagagatatactcctaggattggattttgaaagagcttgatcaagggggccaggatgtacaactggataaccaagaattcagtgacttcaggttactctcttgagatgtgggatttaacactctggcatggatcccagtggatggggcaaactccctgctagggtgacttttagaggtctgcaaaaagtaatagccatgttgagcaacgtagaagtacctgagttgccctggcagatggtaaagacaggtatgtataaaagagactgaaggaagtggttggaatggatatattaataaggacagaagattcatcagaggatgttccaggggagaacccaaaggacaccatttgctaaggccattaggaatgtgctggtgagaggcacacagcatcactaagaagttcagtgatggctgttatctgcaggccagttttggactgggcaataaccgtaaggatggtggttggagaggcaaagcaatagagccttaggtgtcggtgcttaacttccagaagccaaaaagttacaattactataatgactagcaaggtcagaggggcagccaagggtccttgactggcagacagttacacaaatggttaacagagcatgacatccccaggggcaaatataatagatgagcagactacatgagtgttagttaacaactgtaatcacaaaaaaaagacaaaaatggatgactgggaaactgaggatggttgccccaatcaagagtcctgatcctttgctagttagtccctggtcccgagccaatttgcagatccagaaccctttgactgaagacatggccaggactttaggaggggtgctgtagcattatatattataattctccttcctcaaagggacctatggtcatttactcaggtgactgtaaactaaggaaaaggagaaaacaaatacattttgaggaatatttaatacaggctctgagcagacagtgacacctggaaacccaaagtattatcatgccctccttattccagaggaatttatggaggccaggcaataagtggaatcctagaattgtgcttaatgcaaattagatgcctattacttattgactgatttgattcactacaagaatggttatgaaaaataaggagaaagattttattccttggacatgactacaaaaaataatcttccatgtacaaattctacaggcaaaaacataattagcaaaaaatgttgatatgagagttattgctaggaggttgaaattctaagcaagaatttattagactgaaggtttctaggaaaggcaagaattgcaaggacagttcttccattaggctgaaataagctcacgaggtcaacaaagaattatgattgattaggaaggacctatttcctcttcttttggaggcctttaacttctacttcacttgccctccatttaaaagctttcttcctatggtgatctgtttcaagatcctagccagaggcataggagcctccaaccagcagtcaagggcattctgagtatcagaagtatttaattcagtagggacatatgcaagaatctattcctttacagtttaactacttttgtacacaacattatatccttatattctcctataattttttaaatgagactagctctaggatcctgtgggttcctttctctaattaatacaccatcaatagagaatcaaaggttcagttatcagattgtctttctttctctaagccagtccagaagggtggataggacttactattgcatagtcttcaaatataactacccaattaaactggtctagatacttttaggatatatagcagtgatctcccttataatttgtaattccctgctgtaaactccaatctgcatgtggaaattttaagttgggtcatccttataagtctccaaaaacacttctggaaagggacattttggcaatatgtatcaaaagctttaaaaacgtatatatgctttgactaaaaatctccacttctaaaatttttttctgaggaaataatcagaatgggatgcacaagtgcataagaatgttcatctcagctttatttcacggcaaacagagaggatgactaaaaagaagagtgaataaataaatctatacgatgaaattcaatcaataaaggtactatagaaaaatttatcttttgaggccagggacagtggctcatgcctttgggaggctaaggtgaaaggattgcttttgagctcaggagtttgagatcagcctgggcaacatagtgagaccttatctctacaaaaaattttaaaaattagccaggcattgtggtacatgcctgtagttccacctactggggggctgaggtgggaggatcacttgagcccaaggaggtcaagggtgcagggtgcagtgagccatgactgtgtcactgcactccagtatgggtgacggagtgacatcctgtagcaaaaaaaggataaaaatcaacatcagaaaatttggatcaacttttggataaatatatatacttaaaacatattttcatatgtctgtaaatacatatatacattcctatctatacacacatacacagtaaaagcagagagacagtaaggactagaataaaaaagaacaaaataattgagtattagtgctctgatcatcttttacagttctccttggcaagactaatatattcaagagaaaaattcctatttgctccatatatcaagcagaaaacagaagctagacatccacagctattaaaacaacaaccactaccaaaacaaacaacaaaaaaagtagtattctgtttaaatgattgtgtcagctctctctttctctctcttgcttcttgggacttgactgtattgttagtgttatccatgtgggagaaacctaagtcagctgcacaatcagatcagaaatctggtggaggctctcaaggggttcctattcatcccaacccccttccccactaattgtatcctccattccttcagtcttcatggatctggtgggtgaggcatggggctgctcaggaaaaagcagcagggcagatgctgcagttttaagtgaaatcaggtgttgctttccctgaagtaagatctggaaaatgtcaaccttaagtaaccggtactggcagctgaacacgtagtcttccccactgggctcagtgtttcctttccctgcaagaagtacctaggcttttccctttcctcttgcattgccccatctccttcatcgtgggactctttagagttcattgaataaaaatttccattttgtagatattcatctgacatgattctaagtatgttggaaatggaaaagtggcaatagaatccacaagtgtcaaataaaacacactttagtgttgttggtgacctaggcttcaacctgtggaggaaatataaaagatttcttggaggaatggggagaaacaactgagtcctggctcttttctccatatgctgagagatacaggcagaaacacagcacacaaatttgataaagccaaagtattaaatggagctgagagaacattccttagatttcctttctttttcttctgctaggccagtctggaactatttcattgcagaattgcaatccagattgcagaaacacacatgtgcacatgcacagctgatatatgatcatctttcttgtctctggttgatttgcatattgtgcctcagcacattctgggattgaaccaagtaatgatggaggaggtctggaaccccatcttaactagggcacatctccattgggagaaaccagtctcacatacatcgaagggtaccaggatgaaacatagatcactatgagtatggggtgagtgccagttattctctagtctagttggggcaaatgcaatctgtgatgaagcccaacaattataagtttagttgatatctaaagagcaaatcagtgggacaaccttagaacttaaaattctgaaaaactgtgcaacaactataggaaaagagcactgtactaggaactactgctaaatcttcactaagaatgctttatcacctatctctcttcatctaatactctgtctaggcaaactcatctatcccttatggctttaccccctacctatatactaatattgtagtccgaaatttaaatctccagtccaggcttcttctgaactccaggccagcgatatcaatcatttctatctgaacaactcacaggcatttcaactggtgcatgtgaaaaaataaattcatcagctaccccaataaatctgtttctttttttatattccctgaattgatgaataacacagtcatatttcagtaacctggaaattgtcctaggttcctctctattatctaatcataaccaaaacaggtcatcaagttcatcttttaaactcttcctagatttgtccctcctcagtccccacaaccattactctaactcaggcctctatatcattcactcaaatagttgccacagccttcccatttagcacccttcaatcccacagaatctgcacatttcttcccggggagctttctaaacagcatatctggccaggcacagtggcccacgcctgtaatcccagcactctgggaggctgaggcaggtggatcacttgaggtcaagagtttgagaccagcctgaccaacatggtgaaaccccatctctactaaaaatacaaaaaaaaaaaaaaaaaattcagctgggtgtggtggcgcatgcctgtaatcccagctactagggaggctgaagcaggagaatcacttgaacccaggaggtagaggttgcagtaagccgagatcacgccattgtactccaggctaggcaacaagagtgaaactctgtctcaaaaataataataacgataataataataataaacagtatatctacagatcacctatgtagtattcttgccaaacatatttaaacagaatctaacaataaggaagcaatcagataaatccagatttaggtgcattttataagaaaacttgcttgcactcttaaaaaaatgtcaatgtcacacaagacaaaatataattagggaaacgagtctagattttaaaagactaaagagacaagaaaactaaatgtaagtgtgattcttgcttggatccgagattggtggggtagtgggtgggaatagccagcatacacattattgaataattaggaaaaattagtatacaaactgtgtattagatgattattgaatcaatgaatattgggtttcttaggtgtagtaatagtattgtgattattcaggagaatgttcttagtataggagatgcatgctaagggctaaaatgtcatgatgtttgcaacttactctcaaacaattcagccaatcttacataggtgatagagagaaaacaaatttggtaaaatgtaaacaattgattaatttagtctttcaactttcatttctgtttaaaagttttcaaaataaaaagttaagaagaaaaaataagaagaaagaaaagatctttgccagtcaccactgctaaacttttcttccagtagacaactttcatgttacaaaaacaacttgaagttccgggagattaaaaaacaaatggtagggaggtcagtaaggttaaattaccaaagccatttactctcatccctatcaccttgggcaggcttaattagagagtaaacacaataacacaattgacccaaaacctaaaagctatatatagaagtagataggtagttcaacagacaaactgaattcaaaccagtcattttgttttttacatacacgagaatataaaaacaattacatgcaaactctcattgaatcttcataataaccaaatgagatacttagcttcattttagaaatgggaaaaccaaggcaaaaccaaattgaattccatactagagtttttataactgtcaaaccaataatgtgcattattatataatattagaggttttccaagagtaaacacattacccttttaaaaacaggatggttgagtcttggtttctcttctattagcattattaatttgttgtttgtcctctataattttcttttgccttataacaaaacaatttttaaaaacctctatgttaagccctgataaaaattcttattgcatttagacgagcaacccagaggttgtttatggaggagtccctgcctccttgtccttcttcttcccttgtcacatcatgctcttttatgccctaagctacagccacatttaactacttgtacttacttgaaagcacaggttctgtcaggccaccaggatttcttgatggtagtttaaattaagggaaacatgatgtggtccttcatggcacaggtatgcctaacgcaaacatactagacacagcaacacgcaagaccaactctatacatacagggagtcaggacaccatgattctgcttgctatgatttcttctggtttggccttgaggtttctctccatagaggccataatccaggacacccactttcagggagagccccaaatgggaggaaagttagggtcaggtgtgtcagttaggtgggacacagaggtgggtgcataacaaaacacatgaaataacagaataattttattaaagatccatgggagaagcacatgcccatgaggaccaacaagaaatctggagactgcaggatgctcagtgagagagagacagagagagagagagagagagagagagagagagaaagcaagaaagacctgttagccaaagcctttattgggatctagggtattacccaactaggtttctcttacgaagctctaactggtgggtttagagcaagaaggcatgagttctggggggtcacactgtgactgagatgtggtctctgtggcatatctacacagttagtgcgggatgtgagggtcagtggggcaagtcaagtaagttttatctagctgtcccacagggaagtggtcaggaggcagttatatctggatcaaccacactgagaaactgggaggaggtgtaaatggaaactgtcaagggtgactgagccctgcttctggtataaggaagtaaaatttatattcaaaatggatgccgaggcaatgcacacttacaagaattcactacattgcttccatattggctacttaggcaaatcccttatcctcaatgagcctcagtttgttcatctataaagtagatgattaaatcagatgatctccaatgttcatttgctctgtgctctcaatgtccatgaatctatgaacttgctatgaataaattacaaaggagattaaattttagcaaagaagagattttcttaggagaaattatcttaaagaagttgtgaaagtcaaataaaggataaagttccaaatcacagtcaggtttaatggacttcactgatgatataaaagaaatccaaaacatgccatctttaagatttatatcaaattgcaaatgaatatctaaataacatgttgaaaaagacattaagagacagattaattttaaactgcagtatgaaattcagctcctctttcggttactaggcagaagacaggctcagagtctgtgaatctatgtaaatgtagcccatgaaggagaaaaattagtttcttagtgtctcattttccatcacctgttagattcagagataaattatttaaagctctggggaagactagtacccaatataactaataaaataatacttttaaatcactcaatctctcaactctcttttctttcaaaagactcaaagctctttccacacactgaaatggacacttgggtggggtggaatcaagtgtcttaaagctagagaaaggacccctcccacattattcaactcactcaatgtgagcagtggaagaacaaatgaggagaggtaccactttccacaatttcacccctttattcaggggatagctcaggcaaatagtgataccagaaaaagcagatgtatttacacacaccatgggttctcctctacccacataagctctaacagagttatcttcagaattcaaatattaacatgtattgttggtcataaatttttattttaaaatgttcttagatcttcagaagcaaaactaataaggatattttaagaggactctagcattcattcattaatttattcaacatttattgaatatcgagtcatagcatgcactgaggtaaaaggaatataaaatgaataagacagtccctaatttctaaaagctcacaaactagaaaccagacctaatactgccagtgtttttgagagtaattatattcaagtccaaaccaatggaagtaacttggaaggtttttactaagaggctgacatcaaagggtagggaattgcctgatttctaagagacttgctagagagccacacattagttacaagcacgggggtctctcataatatatatttttttctccttcaagctcagatttctctgagaaaaatttttaaaaattccatgaactaaaattgttttctctatgacaataaaatggagggaggaagagagaggggaaggggaagaaatggtatatgtaggaaggcagaattagaaaggaggttctgagatctgtttacaaagtgctcagaaagcaggtgatgtcttctttctggtaaattatgggcagaaagtttaagagctgagggaagcttgcaaagtgctgatataaaaatgaaaccataatcaaacacaaaagacagaagatctctaattcttatagaaaatttagtttatagtgttggcaatgattaaataaatagctaaatttttattagaaggtatttcatttgtacttaaatgtttatattttctccaaacttgctctttgttataacttttaagtcatgtacaaataatcgtagtgggaaaatcacagatgcatacttagaattgagtttgttatatcaataaaacatcttttaaggacaattaaaaatcaatagcagttttgtttgagaactttcattccaactacagcagggaagatggccgggggactgaatagtggagattgagaaagaaagagaatctaggagatcactgcaataccatagccacaaaataggcttttgattgcttggctagggaagatgaaaaaaatgcaagatgactgcaagttttcaataggaaggaagttgtgagtaataatataattgaaataaatagatcttaaaacagagcaaaacttctgagaaaatttctcaggacttgactcaaatgtcactttttcagtgaagtcttgtgtggcaggaaacaaaaatggaatgatcactgcaccatttcctcttcctgggcagacaaaagaacatttcctggattcccttgtagttagggtgggagcatatgacttagttttggccagtgggatgtatgtaggagtgatgtgccacttccaggccaagaaacttgctgaatactgatctacctttatctctttctgcccctagaaacaatgtctctgtggcggcatcacgatatgtaggaagcctggaatcctgagtcactagatgacacgatgagccacctatatcagacttattctgaacaaaagctaaacttttgttgggctaaaccactaacatctagatttagtgctacagcatagcatagcttatttttattaatacatcttgcttggctaccatacccaaaatttccacaagcctctgcccctatgaaagaaaaacacccatatatccacttctttttttttttttttttttatttttaaatttggtattggagtaagataggctttcctaagcacaaatgaaaaagaactgaacactgaaaaatatttgactttatgacagtttaaatttatacattaaataaacagtggcaaaattacaaaacaaataaactgaaaataaatgtttaaaacttatatgagtaatggatatcatatcgttaacataaacgaagtgctaaccagaaagacgtacacctaaatagaaaaattggcaaaagacgtaagcaagtaatttataaaagaaaaaatataaaaatcccaagaaacatataaaaatacatatttcaactttacttgtaatcaaagaaatataaattaaaacattttctccaccaaattggcagaataatttaatatccaatattaatgaggaagagaatgaacaatcagcttttagtctgctggtgggaatgtaacccagcatctacctgaagggcaacttggcaatgtatatccaaatcttgaaaaatttatatcgttggatctagtcatttcacttctagaaatttatccaaaagaactaattagagatgtgtacaaagatttatatatatggatgttttttgttgaaatatttacattttcaaattggattaatctaagtaacccaaaatagaacattggctaaaataatttatggtacattaatatgatgaaatactatgcagaaattttttaaaaagtattttaagaaacatttagctatgtgagaaaatgttgattaatgtgaagtagaagtacataatgaaacattacataaaatgtaaccttaattttataagaagatactatttataacacttatatgtacatatatttacattatatatggaagactaaaaaaacccaaaatcttgtatatatgtatatatttatcaatcatatattatacatttaacaataaaatctaaaagaaatttaaaataaaatacacccaagtgttagacattattatagttgggaattaatttaatttttttcctgaaaaccaaaaactataaaacgttgctgagggcatttaatgaagactggaataaatggaaagatatatgatgttgatgggttggaagattcaatatggtaaaaatagcaattccccccaaattgatttttagattcaataaaatcccaatcaatttcccagcatgtttgtgtgtgcatgtttgtgtatgtggaaggagagaagacaattggtgtaaaatttatacagaagtgcaaacatccaagaatattcaagactgtgttagagaagaaatgaagttgaagattttacataagtagatgtcaagacctattataaagctataataattaagccaatgtaatgttgatgagaggagagacatattggccagtggaatagactagagtccagaaacagatccacacatatttagtcagctagggccactggtagggtatgtaggaccctgggaaaatatgttctgtagggctcctgactatataaatatttgattaaaatgtattacaaaatgtatgggcccaaatgagacttaagaatttttgatgaagagttagaataatgggttgagtgggtctacttccctgtttgtttatttttttttttttatttttttttttaatgtttttttttttattatactctaagttttagggaacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatggtgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagagtcaacttcttcctggtttagtcttaggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgactcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagctctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatggtggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagacctccagctgcgtgctgggagaaccactgctctcttcaaagctgtcagacagggacacttaagtctgcagaggttactgctgtctttttgtttgtctgtgccctgcccccagagatggagcctacagaggcaggcaggcctccttgagctgtggtgggctccacccagttcgagcttcccggctgctttgtttacgtaagcaagcctgggcaatggcaggcgcccctcccccagcctcgttgccgccttgcagtttgatctcagactgctgtgctagcaattagcgagattccgtgggcgtaggaccctctgagccaggtgtgggatatcgtctcgtggtgcgctgtttcttaagccggtctgaaaagcgcaatatttgggtgggagtgacccgattttccaggtgcgtccgtcacccctttctttgactcggaaagggaactccctgaccccttgcgcttcccaggtgaggcaatgcctcgccctgcttcggctcgagcacggtgcgcacacacactggcctgcacccactgtctggcactccctagtgaggtgaacccggtacctcagatggaaatgcagaaatcacccgtcttctgcgtcgctcacgctgggagctgtagaccggagctgttcctattcggccatcttggctcctcctcctatatccacttcttatccttctcactttttttttctttttagcacttgtcactctataacttacagtaaattttacctatttatgttattatctctcttccccagtagaatgtaagctccatgaggacagaaatttgtatctgtttggtttgttacagcccggtgatacagggcttggaacatggcagacattcaatagatatttgttggataaatgaatataaagatggtaactttagctgtgtgtaaaaaatggtcagaccttaagtggagaagtactacggggaactgtgaatgctagtatgagagatccagagacacatgcttgggacacattaacatagttggaacagtcgtagttgaaatcataagaatgagttccttgagaggatgaatgttgcaggatgggtttttcaagagcaaatcctgagtaagagtctgggtgtttattaaggatcgacaactttgaaaggaagcagactggttagagaaagaagtcaaattgcaatgcaggctggaaatacctcagccaaactggtagaaaactgtgaagtaaatgctgcctgtcagagttgtcctgaaatagacccaaatagttggacctttatagccccatctcattcagtcactgatgtgggctgtcttgagtagggctgaccttggatgaggctactctctgcagataaggcagatcctaaaggagatgacagccggaagctgtctattgacctcatttcttatagctggatggcaagtactttttttaagggaaatatgagcagtatatctccatatctaccacaaatggggaaaagaaggctaatggctagagttgccagatttagcaagtataaatataagacacccattcaaatttaaatttcagataaatagcaaagtgagttattaatataaatattcccacgtaatagttgaatcacaattatgctaacaaattatttgttgtttatttaaaattcaaatttaactgagtgtcctgtgtttatttgtcagctctactaaaggctgagtcaggatagagtctcagtggtcaggagagaagtaagtggaattgtcaataagagatgagagaaagtcagagaatgatccatgaaccaagataaagtaatagcattgagatacaaagaaggaggtggctttcaaaataatgaagtgactgacagaatttcctatttttagaagactgaataatattccattgtgtatatgtgccacattttatttattcattccttgatagacaaataagttgattccataccttggctattgtaaataatgctgcaaggaatacaggaatgcagatatctcttcaatatgccaatttcaattcctttggatataaactcagaaggtggaactggagggcattatgctaagtgaaataagccaggcacaaagagacaaatactgtatgatctcacttatatgtggaatctaaaaaagtcgatctcatagaaacaaattagaaaggaggttaccagaggctgggagggagaaggagggatgaggaaagggaatatgttgatcaaagggtacaaactctcagagcagaggattaagttttggtgatccattgtactgcatgctgaccacaattgataacaatgtgtatttcaaaatcgctaaaagaatagattaatgttctcaccacaaaaaaatcataagttgatgaggtgatggatatgttagctttactgaatatttctacaatgtgtacacagatcaaaatatcacattgtactggagtgtggtcagtatgtatgtatatttatcatacataattataatttgtcaattaaaataaaaagaaaaataatgtgatataaaattgaattttgaaaaatgaaaaagatgtgtaaaagatgatgactgagtattactgcagtgactaaaagattagagataagaaaaagcttcaaaaaacagtggccttcagtgtcaaatgacacagagacaggcaaaacagccaaaatatttgcaggggtgatgaggtatgtcaaagcagatgtgatagggcatgctttgccacaagatggcactcatagttccttctttttctgagtttctatcaataaatattctgcaaattttttattgttatagaacaaagagactatcttatgtttcacaacttatagcattgtgtttcatgttatatcattttcccacaacttatcattgtttttccttttagaacatgaagatataatgaatgctggaattgactgagggggagggagactggcattagaacttggaggagggagcaaatgcaatgctattgtagatacaaagtacaaagccttaacaaaaggctgttagatttaacaatcagatgatgactgatgagtttcaagaaaatgaagaatagtgatggaagtggtagccagactgcctaatgttgaggaatgggaatgcgctgagaaagtagaagcagtgagtacagactatatgtttagcacatctgctataaaagaaaaagaaggaaaaataggtggactttttccttataaggaactattttccaaataagggtttgtttaccttatatgtaagtttcaaatatttgaccaaaatacctcttaaacggcaattgcctcacataaaaatatctctataaaacaaacgcagttgtgttgcagagacacttctacttaactgaacaactcctttagtccctctatattatagcacttatttcttttcaaaataatttcatacctttttcttatattgtctactgagtgaatgtttgaataaaggtctatagagaacataagatttgcctgacattccacagctagagagaaacagagccatgagtcaaagttttctgatgtataattccatactcattttattgaattcctttttctgttacttgatttctagttcaagttttccacttattatcaacgttatttttcaacatgtataaagtgacaatggctatatgaaattaccccgttctcaatagtttccatgctgtctcagatatgtaacagttaaaagttacctgtctcccgaacagcatgggaaaatatgcgcattattatctctgctttgtgtaaaactgagtataatattgagctaaaccaaaaataatttataaatcaccacactgttgcacaggtaaaatcctgtgcttattgtttcaggtggataggtacttctactagaatacaaacagtctcaccacacaatcaaaaggttttttttttcagccaataaatctaatctgtacacactcatttttcttttatttttatcatcaaggtgaaaatcagtttctgtatttgtgtaaatctaagtaaaatctaatcctttggacataagaaagagtgaaaggaagacaactttagctttgttcttctcattcaatttcctcaccccaaatatagagaaaaaggtggaggggcttctataactagttcaccggtaactccacataagtcaaacaaaagaacacttcaaacctgctttgtggctagacctccatggggaacagccttcttactgaattggaaagaataaagggtatttttgaacttacagtgcctgaaaacatcatgtctgcaaagtgtggttggcatttttgtacatttaaaagagtctaatgaagcccagctccatacaaattcctacaaaaaaaaaaaaaaaacacgaagaatggaaaatggttcctgccacccaggggtcagagtggtggttgtttctccaaccaattgtacaaaggagacctgtcatttatatagttccaaagtcttgcattagcaagtacaccacgaagactggcccttacccaaataatttactcagagagacatttaatatggggtaaatacagcctcagagagaacagctttgaaggatgtctttgaaaaggtcagaagaagatgaaatgaggaacgttgttacttagggcctttattaaacaaatgcttgccttagctcatctccagcatgtcttaaataatgacatacccacttcacagacaaaaaacaaattggaatgtgaaatttttcattagtataggccctcaggccaatgggttgttctaaaagtatgtgaatggcctctttccaccagcctggagactgcttctatctcagggatgtatctattgctctgttaaacagtcaagtttgtatttcagatgttctcccttaactgtaatacaagttaaatttgaaaactctgttctccctaagccttatgcatgtcctatcccttcaggttcttggctttaggtagctataaccagttactgctactgttacaacagacagcactttaggtgttaacttttttggggtcataggcactttgctatcataaaatcaactggctattgaattaaataaattttttggttatccataacatcacttccaacaactgatttctttgctgctgctattcatctctagttctttgtacatataaatgtatccatccattcaacgaatattactgagcacctgctattgttctagacaaagggattatggaagtcatcagaacagacaaggtctggctatatggacctacattccagataggtaggaacagaagagtgtgggatgagggaagtaacaggcaatacttaaacaacatacattaagatagtgataagtcacatgaagataagaaaacaggttaatgtaattgataatgtatggagaactacttttgtctgaataataaaaaactgctgctgtgagatgaggtgttaaagtgtcacttttgagttagggcccaatgatgacaagaagccagcatgtacaggtctgggaggagaatgctgtaagcagagaaaacagcaagtacaaaggtttgaaagtagaacaagcttggaatctttgaggagcaaaaagaaagccaaggttgttgaatactaataaaaggaagtggcaggtaggatatgagttctgagaaatccaagaggcaagttggagctgctagatcatgaaggagttatacatgagggatctcaaaaactgtaaagttttttctaactcctaaatattttagtgtatttttcctgggatcaaggacagttatgaaagtacagttaccaaaatgaggaaattttcattgttataaccatagtacagttattgaaatcggaaaataatatgaatatattttatctaatttataaacctttcttaaacttcactaatggcccccaaaatgtcctttatagaaaagttattgagagcccagcattatacattgcattaatttttttttttttttgagacagagtctcactctgtcaccgaggctagaatgcagtggtgagatctgagctctccactgcaacctctgcctcccaggttcaagagattctcatgccgcagcctcctgagtagctgggattacaggtgcgaaccaccatgcccagctattattttgtatttttagtagagatggagtttcactatgttggctaggctggtcttgaattcctggcctcaagtgacccacctgccttggcctcccgaagtgttgggcttacaggcatgagccactgcacctggctgcattgcatttaatgttcatgcctctttagttcctaatattttcttgtctttcatgaacttgaaatttttttaaagaacttgccatttattttgcagtatgtccttcaatttaggtttgtttgatgtttctttgagattagattcaggtgacacacgttataaaaaagttatccttttcaatatagcatatcaggagaggtacagagtgtcaccttgttccattactaatatgctgggaaggtgagatttaaaaattgtatgctttgctaggaggagatcaatgtatgtttatgctttaaacgattgcaaaaatataatgttaattgtaaaactagaaatataattaggcaaatgcctgtgaattaaaagcaaatgcaagaaggctttctttccttgttcaaaactgtaaccatagccaagggaggggaggggaggggagggaaagggaggggagggaggaaggagagagagagagaaggaaggaaggaaggaaggaaggaaggaaggaaggaaggaaggaaagaaggaaggaaggaaagaaggaaagaaggaaagggcaagatggaagaatagaagcctatagcatgtgtctccctgtcccccatcccaagaatatcaaatattaacaactgtttgcacacagaaaatcactgtcacaagaaccaaaaatcaggtgaataatcacactacctggttttaacttcatataactgaaaagaggcattgaagagggtaggagagacagtcttgagtcaccaacaccaaccctcccacatcccctggcagcagccttacggcacggaaagtctgtgcacttgggggagagacagcacagcagatgggggactttacattgaactcagtgctgccttgtcacagagagcaaagctgtgctgcactcagccagtgcctgtgcatggagggagcatttggaccagactagccagagggaaatcacctatcctagcagtcagagcttgagtttcttagaaagtctcaccgccacaggtcaaagtgctctggggttccaggtaaacctgaaagcagtctaggccacagggactgcaattcctaggcaactcctagagctaggctgggctcagagccagtagactcaggtgacatgttacctaggaagataccagccagggtggctaagggagtgcttgtgccgccactcccccagcctaatcagtgcagctagtagcaatgaaagtgactccttccttctacttatacagaggagagctaagagtaaagaggactttgtctgtatcttggataccagctcagtcacagtaggagagagcactgcacagaatggtgcggccctcattctaggccctagctcactgacatttctagacacaccccaatccaaaatggaaccagctgccttgatgagaaggtcctagtcctggcaggattcattgctgctgactgaagagcccttgggtcctgaataaccaccaatgatacccaagtagtatgccattggctttgggctctgagatgtgctcactttagggtgtgacccaagacattctcagttgtggtggctacagtgaaagactccttgtgtttgagaaagagggaaaagtaaagaggactttgtcttgcaccttgccttaggtatcagctcagccacagtgaggtaaagcgacaagcagtttctgggggtccctgagtccaggcctaggctcttggacagcatttctggactttccctgggtcagagaggagctcacttccctgaagagttagtcccaggcctggcagcattcaccacaagcaaacaaagagcccttgggctttaagtgaacatcagcagtggcctggcagaacctcccatgggctgctgatggtggtggccacacagaaaggctcctctgcctgtgaaaagcggagagaagagtgggaaggactttgtattgtggtgtgagtgccagcttaaccacagtaaaatggaacatcaggtaaatttctaaagtttttgactccaatccccggctccaagatacatctctgaacctgcctggggtctggaggaacttgctgccttgagggaagaacacaaagctggttagcttcaccactggttgatcatagagacattgagctttgagtgaacacagatggcagcctggtaagtggttacaacaggccttgggcaagacccagtgctgggatagcatcagatctaagccagtgcagtcccagtggtagtgaccacaggggtgcttgcatcactacatcccagttccagcacctcagtacagacagagagagactacatttgtttgggagaaagtaaggaaaaagaacaagagtctctgcttggtaatccagataactcttcaaaatcttatccaagaccaccaaggtggtagctctacgagtctgcaaaaaccacagtgttaggcttggagcccaagtccctttgaatacctggaaagcattctcaagaaggacaggcgcaaataagcccagactgtgaagactataataaatacccaattatttaatgcccagacactgaagaacatctacgagcatcaacaccatccaggaaaatcttacttcaccaaatgaactaaatgaggcaccagagatcaatcctggagaaacagatatatgaccttccagacagagtattcaaaacagctgttttaagcaaactcgaaagaaattcaaggtaacacagagaaagaattcagaattttatcagataaatttaacaaagagctcgaaataatgaaaaagaagcagaaattctatagttgaaaaaggcaattgatatgctgaaaactgtatcagtctcttaatagcaaaattgatcaagaaagaattagtaaacttgaagacatgctatttgaaaacatacagtcagaggatacaaaagaaagaaaagaataaaacagaatgaagcatgcctacaggatctacgaaataacctcaaaagggtaatctaagagatattggccttaaagaggatgcagataaagagatgagggtaagccgggcgcagtggctcatgtttgtaatcccagcactttgggaggccgaggcgggcagatcacgagatcaggcgatcaagaccatcctggctaacacggtgaaaccccgtctctactaaaaaatacaaaaaattagccgagcgtggtggtgggcgtctgtagtcccagctactcgggaggctgaggcagaagaatggcatgaacctgggagacggaggttgcggtgagccgagatcacgccactgtactccagcctgggcgacaaagtgagactccgcctcaaaaaaacaaaaaacaaaaaaacaaaaaaacaaaaacaaaaagagatggggtagaaagtttattcaaagggatgatatcaagaatttctcaaacctggagaagataccaacattcaagtacaagaaggttattgaacaccaagcaggtttatctcaaagaagactaactcaaggtattcaataatcaagctcccaaaggtcaagaataaggaaaggaccctaaaagcagcaagagaaaaggatggaataacatacaatggagctgcaataggtctggcagcagatttttcagtggaaacctcacactccaggagaagaggagcatgacatattaaaaatgctaaataaaaaaaaaaacttttaccctaaagtgatatatctggtaaaatatccttcaagcatgcaggagaaataaagaccttctgagacaaactaggggtgaagaatttcatcaccaccacacctgtcttacaagaaatgctaatgggagttcttcattctgaaagaaaaagatgttaatgagcaagaagaaatcattgaaaggtacaaaactcaatggtaacagtaagcacacatgaaaacatagcatattgtaacactgtaattatagtgtgtaaactattcttaagtaggaagaagaaatgatgaatcaatcagaaacaataactacaacaaattttcaagacataggcagtacagtaagacataaagagaaacaacaaaagttaaaaattgaggggatgaagttaaagtatagagttttaattagttttctttttgtctgtttgtttatataatcagtgttaagttgtcatcagttttaaataacgagttgtaagataatatttgcaagcctcattgtaacctcaaatcaagaaacttagaacaaatacacaaaaatataaaatgagctattaaattgtatcaccagagaaaatcaccttcactaaaagaaatacaagaaggaaggaaagaaggaagagaagaccatgaaacaaccagaaaacaaatctaaaaatggcaagagtaagtctgtacttatcagtgataacattgaatggaaaatggactaaactccgcaatttctacttatcaatgataacattgaatggaaaatggactaaactccacaatcaaaagacataaagtgactgaatggatgtaaaaataagaccaaattatttgttgtctataagaaacacacttcacctataaagatacacatagactgaaaataaagggatggaaaaagatattccatgccaatgaaaaccaaaaaacagcaggagagtcatacttatatcagacaaaacagatttcaagataaaagctataaaaagagacaaagaaggtcattatataatgataaaggggtcaattctgcaagaggatataacaattgtaaatatatatgtacccaatactggagtgcccagatatgtaaagcaaatattattagagctaaagagagagatagggcccaatacataatagctggagacttcaacaccccactttcagcattggacagatctctcagatggaaaatcaagaaggaaacatcggacttcatctgcgctatagaacaaatggacctaatagttatttacagaacattccatccactggctgcagaatatacatagttctgctcagcacatggatcattctcaaggatagactatatgttaggtcacaaaacaagtcttaaaatactcaaaaaactgaaataatatacagcatttttgaccataatggaataaaactataaattaataacaagaggaattttggacactatacaaacacatggaaattaaacaatatgctcctgcctgacaagtaagtccatgaaggaattaagaaaattgcaaaatttcttgaaaaaaaagataatgaaaacacaacataccacaacctatgggatacagcagaagcaatactaagaggaaaatatacagctgtaagtgcctacatcaaaaaagaataaaaacttcaattaaaaaaacctaatgatgcatcttaaagaattagaaatgcaagagcaaactgaactcaaaattagtagaagaaaagaaataataaagatcagagcagaaataaatgaatttgaaatgaggaaaacaacacaaaagtcaatgaaacaaaaagttgtttttttgaaaagataaacaaaattgacaaacctctagttcaactaacaaagaaaaaaaaagggagaagaccctaataaataaaaccaggttgggagtgctggctcatgcctgtaatcccggcacttcaggaggctgtggtgggcaaattgcttgagcccaggagttcaagaccagcctgggcaaaatggcgagacttcatctctactaaaaatacaaaatactagctaggcatggtggcacatgcctgtagtcccagctactcaggagcctgagttgggaggctctcttgatcccagaaggtcaaggctgcagtgagctctgattgcaccactgcactctacctggatgacagagtgagaccctatctcaaaaaaaatatataaaatatatacataaatatatatttatatctatataaatataatatacataaaatatattataattttatataacatatatgattttatataaaatgtatatttatacaatatataaatataacatatataataaaataaaatcagggattaaaaaggagatattacaactgatattgcaaaaattcaaaggataattagtggctatcatgaggaactatatgccagtaaattggaaaatctagcagaaatagacaaattcctagacacatacaacctaccaagattgaaccatgaagaaatccaaaatctgaacagaaaaataacaagtaatgaaattgaagtcataataaaaagtctcacagtaaaggaaaggtcaggacctgatagcttcacagctgaattttaccatacatttaaagaacacctaataccaatcctactcaaactattctgaaaaatagaggaggacggaatacttccaaactcattctgtgaggctagtgataccctgatagctaaaccagacaaagacacatcaaaaacagaaaactacaggccaatatctctgatgattattcatgcaaaaatcctcaacaaaatactagcaacctaaattcaacaatacactgatgaccaagtgagatttatcccaggtatgcaaggataattcaacatatgcaaatcaatcaatgtgatacatcatatcaacaaaatgaaggacaaaaaccatatgatcatttcaattaatgctgaaaaagcatttgattacatttaacatcccttcatgataaaactgtcaaataactaggtactgaaggaacatgcctcaacacataaaagctagatacaacagacccacggctagtatcatactgtacagggacaaactgaaaatctttcctctaatatatggaacaaaacaaaaatacccacttttaccactgttatttaacatagtactggaagtcctagctagagaaatcagacaagaaaaaaaaataaagggcatccaaattggaaagaaagaagtcaaatttccttgtttgcagattatatgatcttacatttggaaaaacctaaagaccccatcaaaaaactatctaaatgaattcagtaagttgcaggatacaaaatcaacatgaaaaaaccagtagtatttctatatgtcaacagtgaacaatatgaaaaagaaatcaaacaagtaatcccatgtacattagccacaaataaaattgaatacctagaaatttcaaataagtgaaatatctctacaataaaaactataaaacactgatgaaaaaaatggaaaaggacacaaaaaaatgaaaagatattccatgttcatggattggaagaatcaatactgttaaagtgttcacactacccagaccaatctacagattcaatgcaatccctatcaaaataccaatgacattcttcctagaaatagaaaaaacaatcctaaaatttatatggaacacagaagatccagaatagccgaacctaccctgggcaaaaagaacaaaactgaaataatcacattacctgacttcaaattatactacagagcttgtagtagccaatatagcaccgtactggcttaaaaacatagaccaacagaacaaaatcaagaacaccagaaacaaatccacacatctatagtgaactcatttttgacagtttccaagaacatgttggagaaaagacagtcacttcaataaagaatgctagaaaaattggatatgcatatatagaggaataaaactagattcctatctctcacaaaaataaaatcaaaatggattaaagacttaaatgttagacctcaaactataaaactaccaagagaaaacattgggaaaactctccaggacagtggactaggcaaaatttcttttttttaaattttctctttttattttttttttgagttaattttttaaaattattattgtactttaagttttagggtacatgtgcacaatgtgcaggttagttacatatgtatacatgtgccatgctggtgtgctgcacccattaactcgtcatttagcattaggtataactcctaaagctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgcactcatcatattttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcatatatgtcttcttttgagaagtgtttgttcatgtcctttgcccactttttgatggcgttgtttgtttttttcttgcaaatttgtttgagttcattgtagattctggatattagccctttgtcagatgagtaggttgcaaaaattttctcccattttgtaggttgcctgttcactctgatggtagtttcttttgctgtgcagaagccctttagtttaattagatcccatttgtcaattttggcttttgtttccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctccatatggctagccagttttcccagcaccatttattaaatagggaaacctttccccattgcttgtttttctcaggtttgtcaaagatcagatagttgtagatatgcggcattatttctgagggctctgttctgttccattgatctatatctctgttttggtaccagtagcatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcagtgaatctataaattaccttgggcagtatggccattttcatgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggccctctgtttatctgttattagtgtataagaatgcttgtgatttttgtacattgattttgtatcctgagactttgctgaagttgcttatcagcttaaggagattttggcaaaatttcttaagcaataccccgcaagcacaggcaaccaaagcaaaaatggacaaatgggatcacaccaagttaaaacacttttgcacagcaaaggaatcagtcaacaaaatgaagagataacccacagaataagagaaaatgtttgcaaactccccatctgacaaggaattaataaccaaactatataaggaacccaaacaactctacaggaaaaaatctaaaaatttaattttaaaacaagcaaaagacttaaataggcatttctgaaaataagacatacaaatggcatacaggcacatgaaatggggctcaacatcattgatcatcagagaaatgcaaatgaaaactacaatgagataccatctcaccccatttaaaatgtctttcatccaaagacaggcaataacaaatgctggagaggatgtatacggtacggaaatgctcctatgctgttggtggaaatgtaaattagtacgactactatggaaaaaagtttggaggttcctcagaaaactaaaaatagagctactataggattcagcaatcccattgctgggtatatacccaaaagaaaggaaatcagtgtatcgaagagatacctgcatttccatgtttgttgcagcactgttcacaaaagccaagatttgcaagcaacccaagtgtccataacatataaataaataaataaaatgtgatacttatacacaatagagtaatattcagccagaaaaagaatcagatcctgtcatttgcaacaacaacatggatggatctggcagtcattatgctacatgaaataagccaggcaagggaagacaaacatcgcatgttcttacttacctgaagatctaaaaatcaaaacaattgaactcatggagataagagagtagaaggatggttgtcagaggctgggaaaggtagtgggaagctgggtgcagaggaggtggtatgattaacccatttatgcccagtgttctattactggaatgctaagctgtgggagttatttatatcctactactcaaggtcatcgccaaggtctgatttttcacaaaaaaaaattgtaacctttggcataaatgggttaatgggttcaaaaaatagaaagaatgaataagacctggtacatttaaaatagctaaaagagtataattggattgtttataacacaaaggataaaaatctgaggggatagataccccattttccataatgtgattagtatgtgttgcatgcctattgcaaagcaagtgtatatatttatggggtacatagggcatatcttgtgtacctcataaatatatacacatacacctactatgtatccacaaaaataaaaagattaaaaaaataaagagatggaaaatagaatttgcactgttaatgataagaaataagacatgtttacaaactttcaacaaataaaaataactgactttaaatataaatttatatagttaaataaaatagactagatatttaggtaaataaataagttgcttttacatcatagacaatgcggaaagaaattgttgatcatttatgaattgtaattaatttagacacccagtggcaaatgcaagatttccaaaatttttttcttccaagtatagtgtaatttattttgccatgaatattagctaaaagtaaacaaacaaaggaaaagtgtggttgtaaattttatcactggggataatggagaaggaaaagatcagaaaacccaaaatctatatagagaatgtaagaaattagaggagatagggaataagcaagaagctctgcaacatgaatttaaatagtcgactgaatcataaaggctttcagtgcatggactattgttctctggtatagttttctttatcagtctcccttaagatatagtatgcaaaaataaaagctaaagtctgtatgtgacctggcgcatacatcaggacaactgtttcccttttgatcaccagaactctattagcacctgttacattcaaatctaatatgcagaattttagaaatgaaaaaccaagactttcatcaggtccagttccctcagttttcaaatgaggaaaatgaagtgaattaaagttaactgacttgcccaaagtcacccacagggatactactgatgagcaaacagtttaggcttagagccccagaatgctaatagagacatcataaatatgtcactatcaaaataccactacccagggagctcgtggaatagagcactggacttagagtcagcaaacttgtatttgaatctcagctctgcctcttacttcctatgagaccatgggcaagtcacttcagctctctgaaaaatgggaatgcttaagacctacttcataaaaatgttacgtatattcaatgtgaaagtgctttgtgaaaaacaacagatagtaaaactattagaatatatgataatggtgatgatctcatagtcactacttagttaaatggatataatactttttaagtaactagactgttatgtgaatgttgtgtaacatatttcatgtctctaattctcatgattcagaaaagatgttgcatatgtttaaatttgcctttaaagattttttttaacttttaattacgaaaaatctcaaacgtttacaatgtggttagaatataatgaatcccagctgggtgcggtggctcacgcctgtaatcccagcactttgggaggccgaggcaggcgaatcacgaggtcaggagttcgagaccagcctggccaacatggtgaaaccccatctctactaaaaatacaaaaaattagctgggcgtggtggcaggcatctgtaatcccagctatttgggaggctgaggcaggagaattgcttgaacccaggaggtggatgttgcagtgagctgagaccatgccactgcactccagcctgggcaacagagcgagactccgtctcaaaaattaaaaaaataataataatattaatgaatctcaaatacgcatcactcagcttcaatattttcaaaattctgccattcttttttatatgtggcaaaacatacataaatataccattttaaccattttaagagcacagttcaatgacattaactacattcatattgctgtgtctgctagtcttaaacttccatccacttcccacctatccagtggataattatgaagatcttactctttaaatcagacatctagcactttaattttcatccaaattggtatgaaacttttttgctctaagcctcagtttcctcttcagcaaaatatcatagcatccatctctcaaagttgtgaattttaaaggatgttctgtaacatcatatagctagtactcaataaatgttagctcacttgctcccaccattcataggtatgactgttcccagagagttgtgctgataacacgatggattccatttcactgatgtgatggctctcaagttttatttggaggattttactgacatttcttcattgttcctttgtaccttatcaaggtaggacatttaaaccgaattaagtttcctaaatgatataaatgtaataaagagttccttatatcttcttggtgatagtatttacttttaaaataattataaaagaaatagaataagctccatagcctaagtgagaagttcctgaagtcactgcagccatttattaaagcgtactggtaggcaaacagaaaatacctttgactttcctttaatgatggagtcactgtgaaggacacaggaaaatgctgacttcttctaggtcactgctcaacctatgtctgtcctctctgataagttcttctcagcttcactttatccttctgcatactaaatggggacatattctaagacctactcctcttctttgagatttttcacaagctcctatgggtgacttacttatatttcttcagcctgcatctctatatgaagaattctaaaataaacatctccagccaacaattctttgtctgactctaagaaacttctgaaccccaaaagaagcatattcaaacctaaactcatcatcaccccctcaaaccctctcagaaaccctctgtttctgttgatgatgccatcactcctgtgtcagactgtcttagagactcatccttccatttttacatccaagacaaagagtgattattccttagaaacgtttcttttatttgttctgctcttatcccaactccactaatgggggcattacagcttcatccagcctatttaatgcaatagctcatggagtcaataaaatacactttctagcatataacatttaatcaagaaaccagaattctaaacacttttaggaattaagtgagagtcatgcctgagcagcccttcaactaacacttaggagagtttaaagacataaattctttttctgagccagaaaaaaaacaaagttctctttattggtaaagcatgttattttataactaggtctgaataatgcaaacatctgataatctttaaagaaatcacaccaacaaaatctgagcgcaatctgggctttctcaaatacagctcacatttccctaatttttacagtctctatataaagacttatattcccattattacatttagagtgcccttcaaaggtgccataaagttccagtcttgatagtctccaattagtgtcctagctacatagctctgaagttccagtttactagcttaacatacaagctagagcttatcttaactgagaacacttatctctaatgactggcttctattaaaaccaatcccccagcaatacaaaacagctaatttacagattttaactttctgcttagcttttctcttgcaatgtattacagtatcgtccagatatctaccttcccaggtgactcttttttcagagaataccccaattgacattgactcactccagtactctgaaactcatagttttgataataaatatacaaaggttcatttgcaaatatattcactatagttgcatttgtctagcagaatttaagacataacaatgtctattcataagtgggtagaataagggtaagtgtattgatgaaacaaaattgtcatgagttggtaattgttgaaattcagtgatgggttcattatataattctctctacttttttgcatatgtttaaaatttcttccataatacaaccttttaaaattagggtactattaatataatgtaactactagaaacaattaagattgatcaatctgtactcacagaaatagggctatgatatattattaagtgagatagcaacttgataaacaataatgctccattttgggttttacaaattctgtatgtatgtgtttatgtgtatatatatatatttgtatatccacagataaaaatctggttactttggacccaccaaactaacagctaaccctggtaattaagaattacagtggatgatcatagcttactctttttgctacaataatttttataaccaacatctgaaaattttaaaaataaaatcatattaacaactgaaatatttagtgcaaggtggatcttgaggattatattcttgggagcatagaataataaaagtatacatctatgcttcaaagcatgctacatattgaaggcaaaataagtttatttgatgtattctctcaagacattgactttaattaagtgctttttctaccaaccttatctgggactgccttctgttactttctgaaaaggttttacttaattctttgatctttcccattacgggcaaaacagatggcggaaaaccatagaagattttcttgcccctcgtttagtccaaattcataattttttgtaaaatcatgatcgaagtcaatttgtatatttctgctttgtccaaagatactcctaccactcccctaaggagaatctgcagttatccttgcttttgtactgctgatttttgtagtcttcatgtccaagtttccctgcctttcactatctctccacccaaatctggatcaggtgtcttcctctattataacacttgtcatactctaccgaaattgtttacttatctgcttcccctgtaagactgcaagtgggctgcaaccaggggtggatccaagttttatggggcttgaaactaatacaatttagggagcctacattaaaaaatatacaaaattacaaatatcaaattatgtataaatatgtatatttatttaaaatgagaaaaaaaaatcacaacacattcttgaaggtttagcgattaagatccttctcttctgagacttctttagacaatttaccagaaatgtttacatagaaatgcatttcagttacaacccggctttcccttcccattactggcatttacaagagcctaggaaagtggtatatactgaagtatgagcttcattaacttcacggtaaatccatgtgtgacttctttattgctgtattctcagcactcagcacagtgccttaaatgtattagaccaggggtatacggtcttttggcttccctgggccacactggaagaagaagaattgtcttgggccacacataaaatatgctaacaataatgacagttgatgaactaaaaaaaaaaaataaaaataaaaataaatcacacacaaaaatatctcttgtttaagaaactttacaaatttgtgttgtgtcacattcaaagctgtcctgggccacatgcagcccgtgggccatggtttggacaagtttttttagatcctcaaaaatatagctgtgagcaggaaggcagggatgggtggattcatactcttttttaccaaatatatgctacaaaccctttaatggcttcctaccgctcttaagataaaaaattactgtataacccagcctttgccttcctctccaactgcatcttgatctcttctttaccttctatactccaactacattaaccttctcttactgccttaggacctgtccataggtagtttcctttgcccagactcctcttcccatcccaactctaccatttacagctcagttcaaatgctactttgtcaagaaagacttgaagcctagtttaagtctcccagtaatctcattcacgatattccctacttcctcaaaaacactcctcacaattgtaattacagagttttgtaaaaagttgtttaatacctatttgctactggaatgaaaactctatgaaagtaggggtgacagtgtgtttgtttatttattgtttccccagtttaccacaatgctgtatacagagtaggtgctcaataaatatttgtagaattaatgaagaaataaatgaatgaagactaatgtccaagaggatagaactctcagtatgtattacagaaaagacagtacctaggatcaaaacattcactggtcaaagagaacaataaaatatttattaataatagctaatatttattgcttgctgaatgttagactttgtagtatgcaattatctttatatgcaattatctcattcgatcctcagaagaatctagcaagtagatattagaataaacttgttgattttgaccaaaaaaatccttctggattttgaacgagattgtgttcactctacagatcactctaaagatcagactgacatcttaacaatgtgtattgtaaaccataaacatagcaaatatctccatttattcaggtattcttttatcattgttttacagttttcagcatcagatcttacacaaattttgttagagttatacctagtcatttcatggtttagtgttctattgtgaataatactatattttaaagtctcaatttgtgattgttaattgttaggatatagaaatacaattctttttattgatcttgtatccttcaccttattaatctcagttagttccagcgacatttttgtagattttttgaagtttcctagacaatccagctttcatttgatttgtgtggttctttaacataaatctatttagcactagccagggaaaatgctatattaatgtcagacaggtttcaaccacagaacagtcttcttattggtaaccgttgctccatcctcaatccacaaagaatattgtttagggaggattatgaatgaatcaggagttacccataagagattatctggtggtgattctgacttcttaacctgaattgtcctgactcctataatttggaaagggaaagacaggaataaagggctactccaggaattctcaaaatttatatacacaggaatcccctgtgaacacctattaaaaatacagatttctgagacttcaaccattttagcaagccacctcagatgagtctgatgcagatggtccatgaaccatacttgaggaatactagtctatattctatgctctgtaaagcagcactgcccagaaaagcaaggcacatatgtaatttaaaattttttggtagtcctacttttaaaaaagataaatttaattttaacaatatatttttgttggcccaatatatccaaaatattatcattttgacatgtggcactggccacatttcaagcactcagtagccacatgtggctagtggctattcatctgaaacagcactttcatatgaatatttgattttaagcaatattgctcaacttctttgataataaaagtcacctcaaactttgtctcttcttttttttccataaaagcttttttacaataaattaataagcttctcccctgaaagttctaaatctgtaggtttggataggaaaccctaagaatatgtgccactgtaggtgattcacattttcagggaagtttgggaatcacagcagcagggcatgaaccaaagctcatgtaggctctcaggcaaatagtttctatgggctggataaggctgaactcttgacaaagagatcccagaacatcaaagaattattggtcttggctttctccagcctcccaattctatttacttcttcctcaaggatatttctattacccccaatgaccttgctttcttcctcccaggaaaactgctttctgatctagcattcttaccaagcgttaaacaactaatatgaattatcactcatagcaagatctgggccacttaacctcaaacttgaaccaaagacatgtgaccagaacttcacatttttcttcctatacatcaaaaattccagaaattctagtattctgtgtctctaaattaaatcccctaggtaagaaggaggatgtctccttcataggcagaatctcagtcattaacttgaacatactcaccttaataagaagcttcaattcatagtctccaaaacattgtgaagttgaggaagaattgctgatcttagaaaccccaaaatcactgccttctccatctatgcacaaaagtggccctgcccacaaaggtcagatagaaccagatcaattaaagggatgttactcaagagtagaatgtaaaatttaaggacagagattctggaatcaatcagattgggacccattttatcccatgggttccaaattactatttctccataactaatcttatttgttactgtcagcacttaaagcaatattttccagtatgacagttccctgaactttttattttggattaacaaatggttatgttcatcatatctttaaattgcactctttctttcaatatgtttttgctttagtgaaccaatcaatatcttgaaaatgttaagatagccaaatttgcaataaaacatattaaattcagaggtacaagatggtccttacattgttatacaaagaggaaagagacgactaatatgtattaaacatttgccatatatgtcaaatcatttcaaccccttgaggtaatttctactattctcactttaaaaaaggggaaactgaagtctagagagtctaagtaccttgttataggttaccctgcaagtaagtagtggagcaagagtttgaatttgttttacccaaaaggccttggcctttccactatacccttataaatgttaataaaatcattttatgtaaattttcacagatcaaatttatcaaatttgatactgagttttttaatgtttttaataaaattgaaaaaaaaatttaaaatattttattttccagttatttgtgactaatatattgaaatataatagatttttgtgtattgactttatagcctataatttagctaaactcacttattagtcctgccagtatttttgtagattatacagagccaatctctataacttgtctatttctctgttccatgtcaagtaaaaatgactacataaatttttatcaaatttggaaaatataatgtgattaggctaataatagtctatcaggagatgactttcaggaccgtttaaagaggcagacaatcatcatcacaagcagctgaaagtgaagcatgattgcagacccacatgactgcccaacgaaaggaaaaggcaacattgattaaaataccagagacagagaaaacaatcaattaagaaacacattaagggcagatacatcaaactgcaatttattgcatgcttgttatttgggcaacttcaagtattacaatgctccagggtaagaagcagcagagttttattaatttaactatggcagacaattctcttcagcagtagggagatcagccaataaaacagccattatttgttgtttcttagtgctatctttgtcccttactcttcattatccaatataatttgttattacgttatacattgtggccgattaatttaaaaacactcaagagatttccattcttggttaggaagagtcaggctgtatcagaccaatcttcctgctgagaataactagaaaaaaacaattttaaaaatcagtttggccaggcagttgcccgagcctgtccagcactttgggaggccaaggcaggaggactgcttgaggccaggaattctagaccagcccaggcaacaaagggagacacccatctccacaaaagtaaaacaataaataaaaataaaattagcctggtgtggtagcatgcacctgtggtcccagtactcaggaggctgaggcaggaggatcactggagcctgagaggttgaggctgcagcgagccatgatggcaccactgcactccagcctgggcaacagagcaagacactacctcgaaaaaaatcagtttgaaggcatcatatagttgtcaagacaggcagtatataacaggtagatctatgaaagaaaaatccctaattgaggttagctgtctttcatggctttcctttcaaagcagttgctgattcacatgcaaaacagagccaagaagctgaataaggagaaagcagcagctaagaggctaagactctgagcacagtttctggcagtctcacagtgctgggatacaagtacagcacttgtagtttgggaggatatgccctggtaaatttcctatgcttcctgttgggaacctgaaaggatgcaacctaagagtaagaatgaaccagaaataaaatggtccttacaaagacagaaacaagcttcaagtcagcggggttccaactaggattgagataactggcccctaatctgtctgccagtaaatatttactgaaagaaaatgatgtgatggtttgtgttgtgctaacttggttaagctggaaactacatttctccacgtcctcttctccctatcgttctatgttagagttggccaacaacgaatttacgtaagatttaaaatgcatgatgagttcatgtcctttgtagggacacggatgaagctggaaaccatcattctcagcaaactatcgcaaggacgaaaaaccaaacaccgcatgttctcactcataggtgggaattgaacaatgagaacacatgaacacaggaaggggaacatcacacaccagggactgttgtggggtgggggggaggggggagggatagcattaggagatatacctaatgctaaatgacgagttaatgggtgcagcacaccaacatggcacacgtatacatatgttacaaacctgcatgttgtgcacatgtaccctaaaacttaaagtataataataataaaataatttaaaaaaagatttaaaatgcaaaagataagaagcagccattacaatctacaggtttttgtttgttttttgtttttttgtttgttttttgtttttttacagtcaaaggtgtttctcaacagatgcctgggagctgagcttccagttctgggagtgtgggctgcaaaatatacagagtaataaggcaaatgacaacagcagcataaacgatggagagtggataaatagatttaaagtattttatggcccttgtgttgtcgagtacattataaaattactaatttacattgtgaaagaaaatgaggtaactaaggctaaggctttctaaagtagagtgggtagattgtgagaggtctgcactcacacctgctaaaggtggaatgtttcgatagacttggaaaaacaactgaggttagtatctgccagccttcaacatctctccagctggaagtaccccaattagctaaccaattagaagaggtttacaatttaggatttctgcccagccaatgaactgcctccataaacaactttttgtgaaaatccctgatttaaaaacactgtcctatacttgccttatgggacactattcagggctgtcctgaggtagtgtacctgaactgcaattctctgtttaccaagtaaatgctatttcctttgacctccgtgtcaatctttttttttatttttattttattttttagataacatagtttatgtcagaagcaggacctgaagtaatcttaccttctagtggactggcttctttggaatcggatgaggtacctacaacaaagagccccttgtgctctccttctctgcttccttggactgctggcaccctcaattgtaagtcttcttgagctcctccctccctccctttggttgaggtcaatgcttttatttgggaatttggggacgttgttccatttgtgcccacaaaggcttttagcctgtgtggaaatttttccaggtatgttagttttcctattatttggaaattttcctattggtcagtattattattcttattataagtttcggattctttaattctaaaccttgcagtgattgtcccctttctgagactacagctggttatttgttcaaaaattatgggacttccatctgtactaatctggaacagttgactttctaaacaaaagatacttcagaattacaataaccaaattggggttcttttttccccaaaactaggcttctccaaattatattggaagaccatggctctaaaacaaaacaacctgaatgaagtacatattttagttagcatctggaggcatccaaacacattcaggactctaaaattgcttctcgctagagcagtcttgaaactcacagaggctaataaaaaaaccaaaagagaaagaaaaagtccttgaagctctggtttcttctactaactctcactctcctatttctgctctccaacctctatgtcctacacttgctgacttcccttctactcttctgactctaaagcttcccttgattcccgtttctgttaaaactgttcaaattcaccctttcaagctccatcggaataatgaggtcactctactaaatgtttcctatacactttggacaaaagctgaacttagagatatagctaaagagttcaccaagattactgaggaccctcataaacttgctgaagaatttaaaattgttatccaaacacataaatctgatttctctaacttttatccattaatacagtcatctctcagtatacacaagggattggtttccggacccatgctatacccaaatctgttcatactccagtccctcagttggccccaccaatcagcatatatgaaaagttggccctccatatatgcagcttttgcatcctgtgaataccgtattttcaatccacttttggttgaaaaaatccacatataagtggacccatgtacttcaaatctgtgttattcaatgtttagctgtacatgtatgcccatcagagaacatcagcacaatgttagatggcaaggcaggttagaacaatcctctaatgcagcagtccccaatctttttgacaccagggaccggtttcttggaagacaattttttccacaggctgggggtgggggatgatgaaattgttccacctccaatcggtaggcattagattctcataaggaccacacaacctatatccctcgcttgtgcagttcacagtagggttcatgctcctgtgagaatctaatgccactgctgatctgatagaaggcagagctcaggtagtcagcactcaacttgcttgcctgctactcacctcctgccatgtggacctgttcctagcaggccatggaccagtacccctctgtggcccaggtgttgtggatccctgctctaacaggcctccaaagcaatattgccttccaatagggagaaagtccaacgaggagccaaaactttatatccacctatcctttaacattccctaaaccagtagattaaaacaagatccaggcctgcacccaaaagaaagctgaggcagtacataattattataatagacatgaaatcgttatcaaggaaaactctggactcccctcagtcaccaaatctatccaagtggcttttaattctatgttcataaatagtttagatgatgatcttacaattctaaataggttcaccttgaatgggaaacaatgcaatgtccacctctgattcagttaacctggccagccaattagcctaaacaatttgtaaggtggataaagtgagggcaaagaaaataatgaacctacagcttcaccatctttctatccctcataataaaacatggtactttaacactataaaactaaatgttaaaggagtctgccactactacaaaaagcctggacacggagtagggggagattgcatacaattaaaacaagataaatgaccccctttaataggccaccctctatgttccttatagactgagggtgctccaaaaaacctacaggcgatctttcaatcttgtctcttaatcatttgggtgcaacccctgtcatgatcagaaaggagattctcactgtccttatcaacactggggcaatcctctgtatttgacactcatcagcctcaaccagttccttccttgaagtactgaaaaaaaatgcaaatggtaggagtttctaatatacctttaacagtttacaaatctttccccttgctttttcaattaggttctacaatcattctttttttttttttttttaaccagttctcttggccccagttcacttacttggaagggacttcttaggaaaacatcatgtggccattaccttttcccataagggtaagataattcttaaagctgatttacatccccatcacctttaactgacaacagtgaaaattcttcaacactcttgcctacttttgtctttaacctaaataatgaaaatgttgacagtttaattctttttaaaagagctttttgaggaagttttggataaatctacaacagacattggacaaatccactgggctctcctgataaagactcaaattgacccaaacaagccccttcctaatatcagacaatactccttaaatcctgaaacttctgcagaaattaagccaattacagaagaatgtaaagctaggaatcttgtggcgcctagtactagcccctgtagtactcctaaccttcctataaagacatctcatggacatggatggagatttatacaagacctatgaaacattaataatattgtcactctttgacaccctgtcattccaaatctccatactctcatgacttccatcctcacagaatgtaaattttatagtgacatacttttatattacttttttaaaaaaagcattcatgtggacactgggagtcaaattttatttgtcttcacgtaggaaagtcaacaatatacctagatagtaatgtcttgagggtataccaaaagccctccctacttttcagatactgaagacatatttaacagacatgtctttcccccaaggattgactctcttgcagtatgttgatgacctccttctttgttccttgtgaacatgattatgttcatctccttaaacttctagcagacaaaatccacaaagtttccagggaaagactataatttacccaggaccatgtcaaacatttgggatacatgatataaaaccaaggacttctcttggatcctgacagacttaatggtatttaaactttcctcaatctcagactgagactattacaaaggagataggggctggcaggttctgtcaaaactgaatacctaattttcctttgatagcataacccttatatgctcttcagaaatttgacaacccagatcccctgggctaaaaagagaatgcctgtatggccttctatcaaaagaaggatttctaagtcttcctgccttaaggtaccccaatcatcagctctctttcttcatttttgtgcatgaaaaataaataaatgtgttgggggttctttaccccaaaacattgagttcaacacagacccattggctattatagccagcaattaggttcaatagctgactccctctctgcatgacagctatatcagccactacagctttaattaactctacagaagagataatcacgaactctactctcactgtctatgttcttcatgctgtagaagctttgtagaaaccgtagagaactctcatcatactcagtattattctgagcagactaacttcttatgagatcttgctgttgatttctcacattctttctcactgcaatactcttaatccagtaaccctccttcccctacctgttgatgagacacatcatgactgttcaaatctaagtggccagctaaaacctaaagtcaatttacatgaaattcctagaccaaatacagaactttcatggtttactgacacatcataaatgacagattaaaatataggagaatattgtgctagatatactataacttttcttgaagtacagacatgcatctcttaagtacgggaatacattctgagaagtgcattgttgggtaatttcatcattgtatgaacagaatattatagagtatacttaaacctaggcttctacatacctagttatatgatattgcctactgctcctaggctaaaaacctgtatagcatattactgtactaaatactgtaggtaattatagcatgatgctaagtatttgtatatttaaacatatctcaacatagaaaaggtacagtaaaaataaggtattacaattatgggacactgtcatatatgtggtcagttgacaaaaatgtgcagcacatgactacatgcagcacgtgactatagttgaagaagctgcactgctgatggctacttcagcccaacaagcagaactttatgccttaatcagggcttatattctggtgaaaataaaactgcaaacgtttacaccaacagccgttacgcctttggggttgttcgtgattttggtgtgctttggaaacaaaaaggatttttaacctccagagggaaccaaattaaaaatggaacttttgtcaataatttattaaattcaattcaacttccctctgccttggctataatcaaaatttctgggcactctaaattagaaaggctaagaaaaacgacttggctaatcatgcagcaaaagcaactacctagagttccactaagacttaaaaccttatagctgatatggattgttttccaaaaaaggatttaaatgatgttgtgaaaggtgctcagtcttgggcatcatataaaaaatcatattgagctgataacaattgcattttttgcccaacaacaaatttacggtatggtcccaataataaactgctattaccagaatctatatgtcttttaaaaaccttactcaaaatgacatatcagatgactaactgggcaactgataaattttataaagcagtattattagtggggaaacatttcaagggctgccaaatagttacaactgtcttgtactgtttgtccaaaattcaacccaggaaagacaattcagatagttccaggtcattttaacctacctaatggacactctgaggtttggcaaatggatttcattcagccacctccatatcaagattataaatatgttctagttaaaatttgtaagatatttcctttaacctccatgtcaaaggattttttaacttaataatatcatgctatataagaatgtattatataatttcaagaataatcactaaaaattataatgtttaataaactgcttatagagaaaatgaaatactaagcacgaattttaaaattaaatacaggaaatgaacatgaaaatgtaggatgattagaaaataaataaggtgtagatgtaaatccaaatatatcagtaacaacattcagtggaaatggattaagaattccaattaaaagacaaagactgtcagctaaacagaaaacaaaacccataatatgttactgaaaaagaggccaactttaactataaggatacaaaaatgataaaagtaacaagatgggagataacgctatgcaaacactaaccaaaaggaagttgtatgtacctatatatttctatcggacaatgaaaagttaaaagatgttgtggtaggcggaatgatggctgccctctcccaaccaaaatgtttacatcctaatccctagaacctacgaatgttactttatggggcaaaagagattttgaagatgtgatcaaatggagaatttttagatggggagattattctaaattatccaagtgagcctgatataattacaagtcttgtaaaagagatacaggtggggtcaaagttagataggaggcaatgtgacaaaagcagcagagggacagagagaaagagatttgaatatgttatgcttctggctttgaagatggaagaaaggagccagaagccaaagaatgtaggcagcctcctgaatctgaaaaggtcaaggaaacagattctctcttggaacgtctggaaggaacacagctgtggagaatgaattttagacttctgatctcccaaagtgtaggatgataaatttgcattgtttaaagccactaacttgtgatttgttacagcagcagtcaaaatgaatatagatggattactataaagataaataatgcaccaggcacagtggctcacatctgtaatcccagcgctttgagaggccaaggcaggaggactgcttgaggccaggagttcaagaccagcctgggcaatatagcgagatccaatctctacaaaaactagaaaacaaaaaaattagctgggcgtggtagcacatgcctgtagtcccagccactcaggaggctgaggtgagaggattgcttgatcccaggagttcaaggatgcagtgagctatgatcatgccactgcactgcagcctggtgacgaagcaagaccccatctctaaaaaataaataaatagatagatagagatagataatgatttaaagcataaatctaccaagaagatataattctaaattttcatgtccataaaaatatagcctcaaaaatgcattaaaaaagaaaacagcatacataaacaagtacacaagtcacagtgagacattttaacatacctctaacaataacctttagaagcagatagaaactgtcaataagataatataagatttaaaggacataatcaacaaacgtcacctaatatttatagaactccaaacagaaaaaatgcatgcttttcaatcaacatttaccataacagaatatatgctgggttacaaagcaggtcctaacaaattttaaaggattgatgagtatgttctctacagtcgaattaaatgaagaagattaaaagataactagaaattaagcaacattctttaaaataactcacaggtcaaacaatagttcaaaagggaaattggaaaatatcttgaattgaacaataaaaagagtgtatactgtatgattccacatatacaaagttcaaaaccaggcaaaactaatttcatggtttttaaagtcaataagaagataaacaatggttatcttcaaagaggagattaaggttagtgagcgggggtggtcatggaaggaccatcttagtgctggtaatgatctattttctgatctgagcggttgtgttcactgtgtgttcactatgaaaatgcatctagctattcactaatactgtgtgcacttttctgcatgtatgttttaattcactaaaatgttactaacataactcagaaaaatttttcttcatttttatttcctgtggtgcttgaagattttgtgtgtgtgctaatgtctcttactatcatacgaagctatctaggttaagaaagtgtcactcaatttatctttaaaatgatggagctaatttttaggtgccttcagaaatgcatctcatttctaatcttttatggttctataacctggagaaagatttagttacattctgcttatcctactaaaattattttattcccttgaaccatattcagcttgtccatctgaggacagaattaaataatgtgagttttctagaatatcaaaaccatttcatgagtctgcattgttttcaagaaaacccctcaagtcacaggtagctgctgttgcttctgctcttaaaacctcttcaaatgttccttgtggtatagcacttagcaggcttcattgcagttatttgcttatttccccatcttcctcagtagcctgtatgtttcataacggtaaacatgtccttccttcctccttctcttttattcactcaacagacatttatcaataatctactgtctgtcaggcactgtgatagtcattagggatacaaagaaaaaactggatatgatctttattcttgcaaacaacagtagagtaggagctgcacacactactcaagtataccttaaaaccctgctgtaatacttataacaaaagagaggtacacacttcttcagagtttatcaatccaagaaggtttaatgttctttttggatgtgtgtgaggtggggagagggaaaaaatgcattcctgaagaagtaatacttgagctgagctttcctaaaggaaaaagtaggtattactatgatgaaagaaaggaagaaagagtgtagagccaaaatgtgataaacaaaggctgggatggatatgtggataattatttgagaaaaggctggagaactaggtaagatgccaattatataagtccttaagtgtttgctcttcctcgagcaaggctagctctttcctgtcattcagatttcaccttaaacaacaactattcaagggaggccttccctaacatctgaacctagtcactgaagctgaagccaattccttttcctcctttgctaacaagaattaaattagccttctctgacacactggtgcttatagggatacaggctctagccccggggttgggggggcgggggtgggggaggtgtgggggggagtgaaacctaattggtgtaagttgattatagtggtctcactaccattgctaggattggctcaagcatgggcatgtgacacagttctacccaatgagacataaaagaaacctactatgagaaaatttatctcacttaagcaaaaggaaaagagaagacttatatacacacactccttttcccccttctttgtcattggacatggtcatgaatgcatgtggtgccaaacagctgcagccattttatgactatgagaggagaaagatggacagcacctggattcttgatgatgtctctgaccactaaattaaccagccagaaccaccctacttccagactcctcatcatttaaattacccttaattaaattcagctgttacttgcagctgacagcattcattttcagtcatttaacacatcattgtagtttaattctctgcattgtatctatcatcatttgatttttatgtttttatttccccactaaaatgtatgctccaaagaatgcaaagactttgtctatcttgttcaccactgtattccaagtatttagaatggtgccaagtacatagcagatgctcaataaatatttattgaatgaatacatgagaaaactctgaaaggattttatgtctgtattgtgtagggtcaacaaaaaagactctatttctaatgttttttacattcattttaccacactgtataaaattttaacttcaaatagcaacactgaaaagaaggcattgacaagactaaatattggggtttgtggaagtacctttggggcagatttaaaatatggtcccaaattctttgacactattttcatagaaaggttggggtatatatctcctgtccttgaattcagactctgtgactactcaagtaatagaatattccaggaatgacagtgtgccagtttctaggaccaggcttcttacaaaactggcagcttcctcttcttatctcttataatgcttactgttggtacctagccatcatgccatgaggaaaacaaatatcccaagaagagacccagtaaagaggaaatgaggcccctaggcttcagcttcagtagacattgtgctagccacaatttaccagccatgtgagtcagccatattgggagtaaatccactagctcaagctgcccagttggatgataccacatagaagagaggtgagcctgctttcacaagcactgcacaaattgaacacttatcaggcaaggcatggcggctcacacttacaatcccagcactttgggaggccagggcaggaggatcgcttgagaccaggagtttgggaccagcctgggcaacataggaagacctcatcactacaaaatttttttaaaaaattagctgggtgtcgtggtatatgcctgtattctcagctactctggaggctgaggtgggagaatagcttgagaccaggagttagaggctgcaatgagctaggattgtgtcactgcactcaggcccaggcaacagagcaagaccctgtctctaaaaaaaaatttttttttaaaaaaccaaagctaaataattattgtggttttttgtttgtttgtttgttttttgagacggagtcttgctctgtcgcccaggctggagtgcagtggcacaatctcggctcaccacaagctctgtgtcctgggttcaagccattcttctgcctcagcctcccgagtagctgggactacaggcatgcaccaccacgcccggctaatttttttgtatttttagtagagacagggtttcaccatgttagccaggatggtctggatctcctgacttcgtgatccgcccacctcggcctcccaaagtactgggattacaggtttgagccactgcgcccggccctacaccactaggttttcaacagtggtttgttacgcagcaacataaaactgaaacacccttcaacagaaaagggcagaaagatgtttagagaaggacagcttaaatttgattacaaaggggaaacagtaatggtagttattaagtaaggtagtcaaaagactggagaaatagaagtgtggatgaattacatattttgtcatgtggtaaaaattcatagttaaaaactgctttaaggttgctgaagccaggtggtgtcaccaaggcacatatccgaccactattattaccatgtgatagctaattttatgtagatcacaatacctagatattgggtcaaacattattctagatgtttctgtgaaggttttattttatttatttatttagataagattaacatttaaatcagtagaccttgagtaaagcagattactctccataatgtgagtaaacctcatccaatcagttgaaagcttcaatttgaaaagattggcctccccaggaaaagacaaaagtctgccagcagactgcctttgaactcaaacttcaactcttctctgggtgtcctgcctaccagcctaccctgcagatttagagcttccaatctttacaatcatataagccaattccttaaaataaatctctatctctctgtctctcagacatagtctattggttctgtttctctgtagaaccgtaactaatagacactgcttctttttgaataatgctttgtagttttcaaagaatgttcatgtatattgtcttattatatgcccacaaccttgaaaggtaagcagaatgaaaatttcaaggatggtgaagttgggaaagaataaagaatttttccaaagtcacaaggctaagtaagtggtagagcctggctagaactcataatcgtctgattcctggtaccaattatttgtactatatcatcttgccttctgtattaactttgatacattctcatgaataaaatctcatgtatccctaaaactcaacagcaaaaacaaaaccaattaaaaatgggcataggacttaaatagacatttctccaaaggtatacaaatggccaataagtacataaaaatatgttcaaccatcactaatcattcaggaaatgcaaatcaaaatcacaatgagatgtcacttcacatccattagaatgactattacaataaacaaacaaaaaccccagaaggtaagtgtcggctggtaagagtggagagaaatttgaatccttgtgtgctgctggtaggaatgtaaaatggtgtataaaactgtatagtagtccttcaaaaaattaaaattagaattaccatatgatccagcaattccatttctgactatataaccaaaagaactgaaagcaggaacatgaacaggtatttgtacactcatttatagtagcattattcataatagctaaaaggtagaagaaacccaagtgtcataggcagatgaatgaattaaaaaaaaatggaatattatttggccttaaaaaggaaggaaattctgacatgtgctacaacataggtgaaccttgaagacattaatgttaagtgaaataagctgctcagaaaagggcaaatactgatgattccattcatatgaggtacttagaatagtcaaattcatagagttagaagaatggtggttgccaggggataacaggaagagagaatggggccttattgtttaatgaataaagagtttcagttttacaagatgaagaaagttgggctgggcgcagtggctcacacctgtaatcccagcactttgggaggccgaggcaggtggatcacgaggtcaggagttcgagaccagcctggccaatatagcgaaaccccttctctactaaaaatacaaaaattagccaggtgtggtggcgtggtgaggttagcctcaggaggctaaggcagaagaactgcttgaacccaggaggtggaggttgcagtgagccaagatcatgccactccactccagcctgggcgacacagtgagactccatctcaaaaaaaacaaaaaaaaagatgaagaaagttctggagatagatgatggtaatggttgcgcaacaatgtgaatctctttaatggccctgaatagtacacttaaaatgattaaactggtaaattttatgtcatgtatattttaccacaattaaaaataaaatttaaacttccccccaaaacaaaaacaaacaaacaaaaaaccaaaaactttatctagcctttaatacatgggctggattgcattttcaaagtgatttttcaacactacttatatgaaatttttaacctctcacttttctctaataccactggggatttttatttttatttattttctttctttttaaaattttatttcttctaagaaaacaacaggatacatgtgcagaatgtgcagctgtgttacataggtatatgtgtgccatgatggtttgctgcacctattgacccatcccataagttccccgcccctcaactcccaccaaccaacaggccctggtgtgtgttgttcactaatggggatttttaaagttacttgtttcttttctggctattctcattcactcattcattcattcattcactcactcattcattcatttattcaatcagacagtcaggtgttagtccataaatactattgcctactatgttccaagcactacggaaactgcagtgaatgaggcatatgcagtccctgtgttaatagagattacattctattggggaagacagaaaacaataaactcaatagagagaaggaggaggaagataataaatgtgatgaagaagaggggtagggagaggaggaagaagaggaaaagatgaagaaaggaacaaagcaagataaggaacaggacttaactggaaggaggggactattttagatgccctatatatcatgccttcctctacctaatgggcaaaggacacctataattcacaaataaaaggcttcaatctgcaaacagtaaattcaataacagaacactgggcctcagagcttatactctactgggaagagggtgaagaatttacaaaaattatgcttgatagctactaagtctaattctatagaaaatgtgcctgtgtagacataagcaaggcttactaacaagactcccaacattatgaaaattttagctttgctttaaccaagaaatttaaagagtaaacagccatcttgttagtaggaaaaagactttatgacttaaaatattatttaacttagcatcctttggtcaaaaacaaaggcacccatttcagccctagagagtatgattctccccataatcaatgggaaaggaaggccatgcattttcaataatggagatgaaattcaatttgattcacaatagtccatgcagatttttcccccaagttatttttacatgaaggcatgcttgaaaaatttcagcccagatttaggtttaagttcccagacttagtaagtaattgctgcagtaatgagttctatgtcttaatttagtctgctccagatgttaacatctagattgtttgtttttcattctccacccctctgcatttccttatacaacagcacatttttctgaaattttaaatatgggagggtggtacaagagagcaggaagaaatagggtgagcaagaaatctagggtctcatctgctatgccaatcagaccaacttttttgctagagtaagctgagggaagaccagttttcaccttcatagaagccatattggccttcctgtatttgcaggagggtgtagtcctgaagaagaatatgcattcagggctgacagtgtgcttcctccaaggcaaggtactatgttggtggccctctttaagtgggaaataaaaactctgtggcagagttggctatgctgtactacgaatcaactaactcccttccccccaatatttattgaaacaagggaatgaaccccatcctataaactagcacaactgagtaacaggaaaaacttggcttatacatccaagctaataaagtaatacactgatagtgtatattaataagaacctgcattttagacccagctggtgagcagctgcatagcagctggaaatttgggattgttctccaacagataagagagaccttgctcaagggcagtggttctcaaattttagtgtgcatggaatcagctagagtacctgctaaaaatgcaaattccacagccacaggtctaataattgtgagccaggagatctgggtagaccctagaagtctactttttaataagcagcctcaggtgattctgatgcaggtgatagaaaaccacattttgagaagtactgctcctcagagctactaagatcatcattcaagatctttatagctaaataaataaataaatagactttcaaccgatctttctgcttagtttttgacaggcgagtccaatccacagctggtaaagaggttggataatgaccgctgataggtttgatcccttgggatagaatacttaaagtggtttggggacctctgtttctcccccatcaataaagtggttggaaggcagccacagtctgggctagaaatccagctggcacaatacttggaagacaatcctcagtgaggtctgggttcaatatctaactgctaaagaggttggctgtccgccttgtggtgttcagtcaatctccaattgatataatgctttgataacatatgagcagcatgggttaaatccagaaactgtaaaggacttagataaaagtcctaagacctaaagtttggtctccaaatgtcacgaagcttggaatatatttgggaatgagtttaatcctcaaatggtaagagttttggatgtcaggaatgaggtctgggttcaatctcttgtcattaaaatgcttggaagacgcttggggtctggtttcaatcgtcaaatagtaaagagttcaaatgacaacaatggtttctaggttcaagtgaaagctgacaaacagcttgaaataaactgcaagatctgggttcaatcttgaaatgttaagggtttagataattgtcatgagaaatgagttcagtttggaggattctaaaagtctaggtgaggtagctaagaatctgcaccagattagagacaacttgtggtcaggatccacgtgggaaaggatttagataacgaccactcttttcagattaggagacagagaaggtgaccagataccactgatccagtgcaatgtatttagataataaaaaaaggagcttgaattccagccatgggggtaagaaatgtgtatattaggtggtaagaaaatgtgtatactaggtcatgagctaattttgcaagagaatattatgtgacttctccatatccacaattatgaagagggatacaggcagcaagcctgggaatgtgattcctgaaataatggagctcttttgccaggagttttgctgacagaacggctgttttatatggctaagcgagcagatgtctgaaaagcactgaaatctatgatgtgtgttcctaagtgggatgacagctggcaccactgcataaaatcttgttcttacttttacagtttcactaatactcttctttctgattattctgatttatcaacaaacagcattttctggaaccttttaaaagcattctcaaatagttaagaattagacagttctccaaacacctaacaatccacaagaattttagagacacaaaaatggaattggattccttggggaagaagcaaaaacccagccatgactaccaactacttttcttcctgaatatcttattctttgacctgacaatccaaggtgaatccaaaaaagatggcctcactaaaggattggtttagagcatagatacatgtgccaaagtcttctgtgcttcttgaatctgagcatgttctgaggaataccttttaaggaataaccatgcttcagacttctggactatattagggatttgttttaaaacattactatcaaaatgatattgttattaataggtaacattcattgagcacttatgtcagatactgtaccaaacattttacatgtactacactagttcatttaatacttaacataatcctataaagtatgtcttgttattatctttattttaccaatggggaaactgagacacagatgttatgcaagttacttaatgttgtagagacactgctatgttcgtcacatcacctttttctaggcacagagactacatttcccaacatccattgcacaagttgtaatcatgtgattaaattcatccaaggggaagcatgtttagaagtgatagaaaccacttttgagcctagacctttaaaacatctggtacaatcctcaggttttttgtaaccctgccaaaaatgagcttagagaccagtgtttcagatgacataacaaaatgaaggaggtatgcctaacatgcctcaatcagactttaagcaagaaataaatctcagttgcgttaaggtattttaccaaatacccttaaaattttaaaggtaccaaatacctttaaaatgctactgattgcatatgcactgtcattttacatatcactaagaaagaaaaaaaagttgccaaataaacaataacacccaactgattgtaaaacacacctttatttcagagatgccaaattgtgaagaaatgacaagacttatagcttccttactataaggactcagaagacaatttcaggaagttctgacttgttaaagatgggacaaaataagcttcaaaatgataactgcaattgattgagacccatgaaatatactaattccattaatccattagtgatactttaaaaactaattggtgacatctgcaagatgatagagaaccaattcattatcttgaaaatatggtaaataaggaaaaagaatcaaagatttattctagttttcctgtactaactgcaccactgagtagccagtaaatgaggggaagcaggtttgcataaaagtattatgaccatttaaaagaactgatagaatatcaccattttgcaacatccaatgaattaatgcatttgtacactcagcatcaatagctgctaacaccataaaaaaaagaggagcaagtagaaataatgtccctcatggtgaaaaatctcaaaatcacatgtagagttacccagaggttctcaaagtgtagtctaagaatcctggatccctttaggagatctgtgaggtccttacatttccagctacatatctgtatgagggcaggttttcttcatatacttcaaataaaagaacacaatgcaacagattgaatgtaaaagcagatatgataatccagctgtcttctattaggccaggctttaaaaagatttgcaaaaatgtaaaacaatgtcattcttctcaccaggcttttttttttgttttgcaaaatatagttacttatgatttcaaaaatttatattagcatgtaattagtttatattgttattttaaaatgaattactacataaatatttttaaatttctctatcttaatttctaatatggcaaatattggtaagcatgacccacataaacaaatgcttttggcgggggaagggggtggtcttgaagaaataaaagaggattatttctcaaactaaaatgtttgagaattgttggtcttgccaaagagatggaacctgactgtgtccctgaagctggttgccaattttcaggaaatacagaggacagatgaacatgttgatctgcaacatattagtaagtacctaatcagcaaaattcagactgtaaaacactttacaggtcaaatgccctgaattcttccacaagcaaactgtaagaaacagaaaaggatagaaaaatagcttatatttgaagacacttcaaaaacatgaaatttatacacacacaaaaatgaacaagacaaaactacagtatctaggaatgcacccttggttaataaaaaatatttaaagatacaagaaagtgattgctgtcatggttactttggaggtagggagagggttaattggggcaatgcacagaggggactcaaggtgatttaaaaaattctcttgacctaagtgctggttataaaggtatttaccttataataacttatcaagccataaagagttcttagtactcaataaaatatggcaagttatggagtcacttaatcctgccaagtacaggaatgagtccaaagcctgtatgcttaaccattatacaatattattggatgtgttacagcttgaagagaccattcttcagtcacatattttaaaaagatgatactagctatatgcctctcaagttcttgtgtctgtaactctctaattgtgggtcatgggtcctcacaccttttctttggaattgtcaaataaaatttatgggaggccattgttttggactgagctcctgcactagacccccaacaaatcaaaccaaaccagaatggagtcactcatgctaggtgccatgtaatcaaactgaactcgaagacaggacagtatttctaaaaacaggagatttacagcaatcgatcaaaaggggcctagtcaacatgagccagcatgataagaaactcctctctgcttcaatccatacaaggaaagtaattttgaaatcagcaatatgctttttgtttctgatttctactttattcagcctttcctacaaataaagctcactccctctgcttagctctgcagaacatctttctatttcatagatgaggtgttgtctcattcgtgaattgctgataaaagccaattagacctttaaaactcaattcgttgaaattttgctcttagagtctaaaaccacctttgaaaataaagtgtttcacatggttatttagtaacctgagttataaagtaatttcctgcctccttcagacccttcaaataccccatgcaaatctctagcacagaacccagaatgctttattgtctttatccatttacatatctgcctccttgaaggagattgacaaaaagtaggttctcaggaaagcaattacatcatgaatctaacaagctttaaagtaacttctgataaaaaaaattgttacaaggtttatgcagttatggaatctgtcttagcaagtctgaaatgtgtagaacaggtcatgagtaaggacagactggaattcatgagcatgaactgaagctgctgaccataagaatttattctctggggaagcctcaaccttgctttaaagggcttttgactgattaaattaggcctacctaaattatgtaggataatctttcataaataaactatgggccagacacagtggctcacacctgtaatcccagcactttcggaggccaaggcaggtggatcatgaggtcaggagttcaagcccagcctggccaacatggagaaaccccgtctctactaaaaatacaaaaattagctgggcatggtggcgtatgcctgtaatcccagctactcgggaggctgaggagggagaattgcttgaactgggacccgggaggcagaggtagcagtgagctgagacggtgccactgcactctagcctgggcaacagagcgagactctgtctcaaaaacaaacaaacaaacaaataaataaataaactgattataatctttaatcacatgtaaaaaacatcttcatagcaatacctagattggattgtgattaaatagctgaggactttaacctattcaagttgacacatcagaaataccatcacagtataagagagaataatcattaatactcatagtttgaaacagcaacatcaagaaatgtatgcattatttttagttagtggtgacccaaaagattttgtgtggagagacttagaggcagtaaactaattagaatgggagcttaaacagcatttatagtgtactttatataaggtagaaaaatgacagttgtctatttcaaagaatggggcaggcatcagaaaaatatggaaggtgctaaagttgccatctaatttcaccccttggaactattactgttttctattttctatgtataggaaacaaagatcaaatttagaacaaataccaaaatcaggattgtggttacctcaggagagagaagaaatgggatctaagaggaatacaaagaaacctccggccgggcgtggtggctcacgcctgtaatcccagcactttgggaggccgaggcgggcggatcacgaggtcagcagatcgagaccattctgcctaacacggtgaaactccgtctctactaaaaataaaaaaaattagccgggcgtggtggcgggcgcctgcagtcccagctgctggggaggctgaggcagcagaatggcgtgaacccaagaggcggagcttacagtgagccgagatcgtgccactgcactccagcctgggcgacagagcgagactccatctcaaaaaaaaaaaaagaaacctccaagtatatctgtgcggttttgcttaaaaatttttgaaacaaacttgataaaatactaatgtaagagaaaccagagtaatagatacatgaatattcattatactattttctacattattctgcatgcttgaaatatttagaaaagtatatgacatatttcagacaaatttctatcaaatgcatttgaaactgcccctaacatagcaagctgggagtatttcctctctctaatctcctatagtggtttgtttctctcacctatggctcaaatcctcttgtgacttgtgaatcaggcagacctgtgtttaaatcccaactccacagcttactggttgtataaccatagacaaattaatttatctctttgaacctcagtcacctaatctgtaagatgtagataatagtatgtatctcacctgcttattgtaaagattgactatattaaatataataataatgtacagagagcctggcacatagctgaatgcattatattatttctatctgtgatataattatcttttcacattttaatctctttcagagaataatccaggcctgattcattttttttttttttagatggggtctcatcatattgcccaagctggtctcaaactactgggctcaattgatccccctgcatcagtcccccgagtagctgtgattacaggcatgcaccaccatgcctggctaattttttaacttttttttttttttagagatggggtctcactatgctgcccagggtggtcctgaactcctggcttcaagcaatcctcccactttggcctcccagtatgctgggattacaggcgtaagccactacacctggcctgattcatttttatattcctcacatcactagcacagtgctaggtgttcaaatgattacaaaggaatgtgggaagttgtccatttccccatcttatccatgctactggcctcctgtgctctcagctgacctctaggaggcagttctcctgacaatgcacatataggctcatctgtagatcctgtgaacagtcttcacagggttatgggaggttagaaagttatgatctagtacaaatttaaaattcataaaccatctagagaagttaatataaaactgtaatagatcagttctagaaataggccagcaaagagtatgtgattcacattttactacagtatgtctttactaatgtaggtaatgagccatataaagaaaatttacttcattcatctagacataattaaaatacggaaactttataaattaaagtccaaatctacagccatgcaacactaaggctgaaaatttaaatgcataagttaggagagatcattttttcatattattaatgaccggtaaccaaacctacatagcattgctgttgcatatgatattggctatgaggctctgaactcctatcagattcaaacccttaccgaagcctccccaatactctgtttttgaaatgtaagatggagattaggcaaagaaatatattgtagaaaggtgaataatacttttgtaatcatgaattaaattcatcattcattcactaagtacaagagaacatcaacaatgtttaagacaacatattaaattaaagaaaggggatacaaagataaccagtcctccaaatcctcacaatttagtaggagaaataggagatacacataaatagttagaataaaaggtacacaggtcaagtgaccaagcctgattcatttttatattcctcacaggaacacagtgctaggtgttcaaatgattataaaggaatgtgggaagatgttttttccctatgttatccgtgctattgacctcctgagttctcagatgacctctataaggcagagctctcctgacaatgcacatatgggcacatctgtggatcccataaatggtaaagcgtagggaaagtgctaccaggattcacaaaaagaaaggcttagattcaaatggaggagagagtgatgatgataaacaaaaatttccaagagtggcatttaagataatctttgagaagcataaatgggagaaacattacatgtaacaatattttacaaaacatttataaatatacattcttatttaaaccttatgacaatcatttaattggatttttcttttttgcaaatatggacattaggacttagagaaattcagtgacttgtccaaggccttatagttggtgattttgaactcaagttgtcttgttttatgtccattgttcatttcagtaaatgaactattttttaattaagaaatcctcatgagtatcagtatggggcagaaaattacaggatcttttgaggaaaagtgaattaatagttcagctgggcgggattatatggtagataaaggagaagagtatgaaaaattgttggaaataggcaggggtagatggcagaaggtctagaagagcaacctattaaatttggactccatccgtagatgttaaaaagttttgaacagaggaatgccttgaagtctgaaagtatgaagaaagaataaatctgacagcacagtggaaaactgataggagagatgataggctagaagcagagacagcagttgggagctatttcaatattgcagaagagagataataagggcttcgactagggtgatgacagtgggaacagagaagacagcagggaagcgggaaaagcagagatagactccgcagggcttgaaaactgattggattgggaagagacaaaaaatgaggagggattcagagatgattccaaattctcatgccttagtggctcagaggagtatagcgtcatcagctgaaacatgaaatggagaagaaaagaatgggaagaaaataagtcaagttttagtcataccaagatacatgaaaatgatataaagaaattagcatttttagcctggaactaaaaaaataaaagcaagtcatgttagccagattttactatttaaaggactgtcacttttagagagaaaaaagttttaatttaccatacacagcattggattattcacaattcttggttcatgacatactgtaattattgtttggttaactaattaacacttatgaacttaaaactcgacagaagaactataataggtacagctgggtttggtggctcacatgggaggccaaggggggcgaatcacttgaagccaggagttggagactggcctggccaacatggagaaaccccatctctactaaaaatacaaatattagctaagcctggtagtgcaggcctgtaatcatggctacttgggaggctgaggcatgagaatcgcttgaaccctggaggcggaggttacagtgaaccgagatcacaccactgcatccagcctgggcggcagagcaagagacgctgtctcaacaacaaaaacaactataatacttacaatagcacacatttacctatatggttcttccacattccttcactccacctctctgatagttgttattcagaggccactattatcccagtcctttaggattcctttggtgtttttaaaaaatacagtttgatcatacctatgttcctaaaataaacatttttaagctttatttgtatttagctttattaaaaaaaggtatcttgactttttaaccctcacactgtaagtaatcttccggaacttaactttttcactcaatagtattgctaaaattcatccttacttctatgtagctataatgcatctttggaatcctattagtcttgcccccagaaatgtggttgtgagtgaaaaggggcagcaatcacttcatctgagtatattctccgtgaagatgccttttcaataattttactgtatatgctaacatgagagttgttaaggatgtaacaaaaagtacattatcttcccccagtggaatgtaaatttcatgactttctgcagggattacaattccttgtaattttttttttttttttgagacgaagtcttgctctgtcacccaggctggagtgcagtggcacgatctcaactcgctgcaacttctgcctcccgggttcaagcaattctcctgcctcagcctccagagtagctgggactacaggcgtgtgccaccacgcccagctaagttttgtattttttagtagagacggggtttcaccatgttagccaggatggtctcgatctcctgacctcgtgatccgcctgcctcagcctcccaaagtgcagggattacaggcgtgccaccgcacccggcccagacactcaataaatttattgagtaaatacagtacattctataagtttggacaattgtataatgacatgcatccactattgtaatttcttgagtatctgttatgagccagataaggagatacagcagtatatgttgaagtatatgtagaacatcagtggtctaaagacagagtaggtcttcagaagatactatctttttatatgtgtgctttacctagtagtgacaacataatgcaggctccaagcttgtcatggctacatggtctctgccacaagttactattacaagggggcagcatccagttggttgaactggttttggtagagtttgccaatctgtcatgtcaatgatgtaaagttgaattcattgagctttaatatcacttcttttgatttttttttttactagttcttcttttttgtttttaagtgtctttaaaaaaaaaaaaaaagcagttttggacccacagcaaaatagagagcaagttccacagatttcctatatatgccctgtccctgcacatgcatagtctcctctgttaccagcatctcccaccagagtggtacatttcttctgatgaacctacattgattatcattgtcacccaaagtccatggtttaccttagggttcactcttcgtgtagtacattctgtaagtttggaaaactgtataatgacatgcatctactattataatctaatatagaatatttcctcttccctaaaagtcctctgttcaccacccacttgtcactccctcccaccctaacccttggcaaccactgtctttttactgtctccatacttttgccttttccagaatgccataaatcatatggtatgcagtcttttcacacaggcttctttcactcagtagtatacatttatgtttcctccattcttttcgtggcttgatagctcacttcttatttttttaatttaacttctaagttcaggggtacatattcacgtttgttatacaggtaaactgtgtcatgggggtttgtgatacagattatttcatcacccgggtattaagcctactacccattagttatttttcctgatactcttcctcctcctcctcccaccctccaccctccgataggccccagtgtctgttgtttccctctatgtgtccatgcgttctcatcatttagctcccacttataagtgaaaacatgcagtatttggttctctgttcctatgttagtttcctaaggttaatagtttaaataagttaaagtctcaaacttaaaattctagattggggtatacaggaaatggttggtattaggataatccaatatagaacacaatatattattgcaaaattggagggaaacaatgatatacttaattcaaaagacatttgtatttggctttagaatttgggcacttatgtttgaaaacagagatgtttggaaactatataaaatttcaataattaagctacaacataaagactatggaaaaataaatgaaaagttcttcaaattccctaacctacttcctgctaaaatctattcccactcctacactcactgttgaaagtagacataacatcacctctcatgaaaaaaccagcattttacaacaaatctacaaacaataaatcttcctttctctctaaatggctctatttgtgcactgctccttccccaggttggggaaaggttattgaaatattttggttccaaagcttccaaatgatgggcttactgcctggtgaacaaaagcaataaaattctgactcttctgacttaattttagatacatatatatcttccatttaaaaaaacttttaagaaactgttgatatattgcttcaattctaattctgattaaagactgattctctttcattcctaggatggtagtttcattgtaaaacaggaattccctgatgcttctggagagttacccagtggcagggggcttatttatatgaagcaatattgaacgtgattctacttctaagctatgtggccttgggcaagtcacttaccctctctgggcctaagtttcctcaccagcaaactgaggaagtggagtacatgatctctgaggtctcttccagctttggtattttctgaattgattagtataaaatatgggaagaggagcttcctcagaagggatgtgctttgtcggaaggcatccgtaagattaaagcttccagaaagaacaactggctatgcgaggagtggtcagtctttagactccaagaatcttcatttagaggttcttacattttggggtgttaggtcatgcttaagtttatattattcatattcttatgtgattttgataattatttaaatgatactagtatgtccaaccataatttcttggaactagacagtacattgaagaatttggacctttgtcaatatttgatctgtgcacaggaaagtttcagagacaaagatagagaaatattattgaaattaaaagttagtgccatggattagtagtaatcataaatttgacatacttgaacccatgtccacaccaggttatcaatcagccatatggccttaggaaagtcgcttagcctctctgaacttcagcatgtaattttaatgatagctctcacatattaaatataaactatgttctaggcattatgttggtttatattacatacacgtttctaatatttaaactttataacacatcctgagaaacaggtagcagtattcccattttacagataagaaatctgaagctcaaagtagtgacattcattgagaacaccaaaattctaaccttggtattctgattgaaaatcccaacctccttcaagtgcgctcttccattagcaaattatatcaaatcaagaatatttatttctattatgtgcagagtaaggcagctgttaaatgccattaagatgttaatttcctggctgaagacattgccaaatgtgacacaaataaaatgaaggcaactcctaaagttgtaacttggaggagaaaggaagttaagcattggctaggaacaagaaagggaagataattctaggcaaattgcctctgcctgggagctagacaggaatgagagagttggtgaaagaaataaaagctatttgtgaaactaagttaggaacatggggtaagagcaggaaagcctattccttgactcctctcaccccactcaaatcaaggctgtagtgctggaggataggtgagcagccaaaaagatgtcttccaatattagtttctcaactagtttatactgtttgttacaggtggttggtagcagtgatgacatccttgatggtgtctgtctctcctatatagacctttcttttgagcattggatctatatagcaaatcacaaagtttttggttaaaagaccaacatgtgagtataaagtaatgggcaaattttcatgagagaatcataacctctacaggccatttgaaggagccattctaaaaatgttatgagcaatggcagcattttatattttccatggtgaccactttgtggaacaatcctcaattggatgcataaatcctgttcttagttcacttgtcttgttttgtttgtaagtgagccttattactttccagtcacacctggtgtgtgtctctgatgtggctgggagcaggctggacaggggacttcccgtctactctccagtgtgtcctgaccagtgcacaggtgtgtcatggactaaaataaggttgggaactgggtaatttgcaggctgaaggcagctggagtctttagagcacaagctcctactgactgtcttgggactgctcagtaaaggaatgagagcttttaattaccagtagtggtgtctcccaaccaataggaattcttttccattccaagtattttccccttgaacagatgcagaataaggggccttgggcctggcatgtggtgtgggatttctgtttcctatcaagcaagataactttacagattctctttacagctagagtttattcaccatcagatgagtttttgtcatgactgattcttcaggggaatatgatattattataaacttactgattttgtctttatacaacttaacaagaaaataagctggatcaaaagcctataccagcttttgagagtttttttaaaagatagaagtcaaaattgaaatttttgataactatgtcatgccctgcctgcctacttcctgagattattattcagatctatttatatgaaagtgctttgaaaagcaaaatactctatttggatccaacatacaattacttgactgtgaagaaaattaaacctgggttttgaagtttgtgatcagatgaaaaagaacttaaaaaatacagcacaaggctgtagtgagtatgctgagcatggaaacatgctttgctacatatctcctctgcacccatttttctccttgttgttgaggcaacccaggagtacggtagcatctgctggagctctctctggaataaatgatgcacagttcaaacaacttcatcattaatgaaaaagctttcaataaaacctaaaaattcaaaaagttactgagactcaagccaacaaacaaagaagcatatttaaacaaacaaataaacaaatgcttcttttaaatgagctttactaagacagctgccaaaatgctatgacacattgttttctcttcttttttagatacagggtcttaatatgttgcccaagttagtttcaaactcctgggctcaaggaatattcttgcctcagccttccaagtagctgggactacaggtacacatcactgtgcccggctctgacacattgtttccaatgacagagttcacacttaaagtccaggagacaaattccacaaaattattctgtgcaaatcagagggtgtgtatatgcagaggtaaaatgacgtcatgatctcagagaagtttcaagcaaacatcaactacagaggaagagtactgatgggtgaagttaacccaagctatcctggcattgtctggcacagtcatctcttcagttcaccatttaccttcagattcaataacaacatttgacagaagatacaaactcagaattagtaagaggtttgccagagctatatgaatgctgcataaagagtagagtctatgtccccttgcctttccatcagagatggctcatactgcctctcaaaaatatatctggtaactcatttaattctaatcgtaatagtagctaccatttattgaacacctgttatgcatcaggaatttgccgagtgcttcatatggtcgcatttaatgtctgtaacaaccctaaaagtattattatcctcatttgatagagaagggaattaacgctagagaggttacacaggtaataagtggttgagctggaattgaactcaaatttgcctaacactgaagcctatggttttgaccactaccccaggcatggctattgtattttactttatgtgccaatttgcgtggattagaaatacatttctctattcttaggcaaagtgtaaattcagtgggaaaaagaatcatgatagcttattgatgtctgctatggcaagggatggaaaaatggtagtggtgatacatgcagcagttatttgccacctctgccttaggtaatgcttgcttgctctatgtatgatatgtgatctactctgcagaccagtttatgacatgtctgtgtgaccatattttatcagactagtatcagaacaaatggtctgtcaatgaaatttccctaaatggtactttattagaatacccagactgtgtggtccctttactatttgtggaaaacagggaccagacttaagtttcccacaagaaatgtgtggctcaactgggatgggagaatgagaagaaccagcatatcaattaaaaagtgttaacgaaactttatgcactagctagatgttctctgtgcatataattcataaaataattcaggtgaaaaatagtcgttaaaagattaaaactcagagtaaacagacttattcacagccaagggagttaattcagggtatgagagtagctgaacacaaggattcaaaattaaggaagagccaggtgtggtggctcacgcctgtaatcccagtactttgggagaccaaggcaggtggatcacctgaggtcaggagttccagaccagcctggctaacatggcgaaagcccgtctctactaaaaataccaaaattatccaggcatggtggtatgagcatgtaatcccagctactcaggaagctgaggcaggagaatcgcttgaacctgggaggcagaggttacagtgagcctagatcgcaccactgcattccagcctgggtgacagattgagactctgtctaaaaaaaaaaaaattaaaaaaataaggtcaaagagcagcaaggttagagaaaaagaggaaatcagatcaaaggaaactcataaacaccatctcttactcttaagaaacaattgtttgcttactgtttatattctggtaatttttattgctacaccaaaacagatgagtcagagttagtcttgtggccacaagaaacatgtactattccttactgctctattccttatttctgaggccatggaaatgagtgaaatgagtgagagcgcccaggacctgagacaatggcaggaaagtaaggctaactttcatttagctgcaatgcattcctttagcttcaacagtctcacctgctaaactcaaccacgatgaaaaagtaccacatgcagggaagaattttcctacaccttctctttttcctttaacttctgtgctcccttctgtccttacccttgctgctttcccctctttctttactcttcccactttttcatctcataagacattgttgagggccagctatattgaaagtactttaggtttacacaagtgaattagattttcactttgcaattccaacgcccacagtcgagtgggaaagacaaaaaaaaaaaaattataatttcatagcactttacaaagcaattgttcacatagggcagtgagttactatgtccttttttaaaatgaagaaactgaagtccaaagaggttaagcaattgtccaaaatcaaccatctaatgtagaatatgggtaataaagaggagatgaaaaagaattagtaacatgaaagttaatgataccttccttccctcccagttaaataactttcaccatagtctgtgtaattgacagagaggtacttcatcatgtgtatgcacacatccatatacacacatatataagcacatgtgtgaaggataacactaggtatatatgaaagtactctgcaccttgcaaaaggttaagcaaatataatttaacaccatcattaaacagaatcagagtaaataagccaaagagtaagctaagattggaaatatctgacaaccatccttctgcttacaaaagacaatacatttcagggttcaggataaattatgcaagaaatctatctgaattcatcaccaagaaattaagaaatggcttcaccaaaggctttggaagtaaaagtcaaggatttactacggccataacctctcctaaagggaaaggaaagatgagaactggagaattaggaagaccccattcttatttcttaataaatgaataaatagaaataatttgtaattggctataaaataaagtattttaagttggccctatttaagctcctcgatttttttttttgagacggagtctcgctctgtcgccaggctggagtgcagtggtgcaatctcggctcactgcaacctccgcctcccaggttcaagcgattctcctgcctcagcctcccgagtagctgggattacaggcatgggtcaccatgcccggctaattttgtatttttagtagagacggggtttctccacgtttgtcaggctggccttgaactcctgacctcaggtgatccagctgcctcagcctcccaaagtgctgggattacagctgtgaggcaccacgcccagccaatcttattttttaaagtaaaaataagaaaatcaaattcaaaaatatttattcttacttggcttatgaaaaaggtaaattcaatacagcaatggcatcactttgctaaaaagcgctagtcttatacatgctaatggtagagaagttttctgattaaaaaaaggcctctctgtagcacacaaatcatcccatatagagtgagctatacattccatatttctatctgacattgttcaacagatattcaaagttcttacataattgagaagtatagcctagaagtgataaagaaagaattaataggaacagttctagtaactttagaaaaaaatagcttttctggtgccaactggtaaactccagtgctcaaactgagatccaggtattatagtgagttaaaaatattattttgggccgggcacggtggctcacacctgtaatcccagcactttgggaggccgaagcgggcagatcacgaggttaggagatggagaccatcctggctaacacggtgaaaccccgtctctactaaaaatacaaaaaaattagccaggcgtggtggcaggtgcctgtagtcccagctactcgggaggctgaggcaggagaatggcgtgaacccaggaggtggagcttgcagtgagcggagatcgcgccactgcactccagcctgggtgacagagtgagactccatctcaaaaaaaaaaaaaaaaaaaaaaggaactattagtttaaccttcctaatacccctgcaaagtggatattgctacagtttgatgcaatagctgcaaactgcaattttataaatgagaaatatcagagacattgaataacttgcctaggcaacatcaagtagacactgtttctcccttactttgtcttctaagataattggaagaaatagatgtgtaattagcagatgaacaagaacaggggattaaaaatgactctaaaacttaggatttactgtgaattaatgtcaaaccgagttggcaatgcgagtgaaactaaacatctgaaaactaacagtttgtatttttgagattattccacatagtgatagcatggcttaaactgctaaccatacatgttgggaagagataaatttaaaaggaaaaagtacctcaggagagatagccatgtgttctggaccttatagaatatttgaagtgaatctccaaaaggtcttgaagacataggcaggaagttacctaagacacaaggaggctagctgagcagagagggggcctctgaattttagtgatgctgtggatgctgctatttctctctggaatacctcaacagtctcccttctcacttatccttaacctcttgcttcacaggttttcatgaagtgaaaagatttcacatttttgttcagcacaaaccagaaaggcattcctcaagaaaatatgttccataaccaacacctgcttctcctgtagccacttcctggattcttctgcttttcttctttctacaaagagcaaatgtctgtcacatagaacaatcccttctctatagtccctccctggcttttcaccactgtgtcttctttctttcccagattcctctgcattttgagggaatcttccttaaaaaattccctaatccaacacatatttctcttaaaatctagctagaatgttgacttcttgagtcattaagacaaacagtaaaccagtattttctttaactgtgatacaaataagctcacttccacctccaagaaagtttcaatatgggatcataccaattatatctggaattctttacactacaactaagtatcctaagtaataaaaatcacttattacctagacaaaaccaggttggtaatgcttcttccttactttgtcttctaagagagctgggagaaacagatactgtaattaggaggaaaaccaggaagggaaattaaaaatgactttcaaatttaagatttatcatgaattcatgtcagactgtttgcagacagcactaccggtgtccagctacagcagttcgcacattcatttactttaaaaaactaatcctctttacaggaaggttttgcaaaccttgtatattatgatgtgtgtgtgtgtgtgtgtgtgtgtgtgtgtgtgtgtgtgtgtgtgtgtgtgtatatatgtttggttttcatccatccttcccagctgataactcccatagcccttattacaatgttggggcactttaggtctcagaaaacagaatctctctcactctgaccttatccagtcctcctttcacctgctaccttttctgcccaaggcagaaatcttccccaagctttttgtgttggagctggccataaagaattctctgacctaccttgtctgattataggtcataagacaggatctcactatgttgcctatgcttctctttaactcctgggctcaagtggtcctctggcctcagcctcccaggtagccaggggtgcatcactgtacctggcttaagactcccaattcaaaatgaaccctgccccatactcaagagaaaagaatgctatacagaggccaagaagaatttgaacagacaggccttgctgggtttccccactcagtctattagtattagatcatactctttttgtccaattacatttctacatggctgtccctgcttcaatcacgcctattcaatgaagtctcccatatgtaacagaagtcttcttgtattgactgttgtggtgtgagaatagaaggaaactagtttgtttttttctacacaccttgtagccctatattttttctaaaaacaacgtataaactaaaggaagaaactgaaaaaataaattgggaaaagtaagatgagctcttatatacacctgccactaggggcttgctgaccttcttgaacaagagctaagaagtcacctatatgcatataacctacactggatcatttatttatttgtttacacagctttaaggccctctttggggccttatgttgtctgactgagctacaaaacaaaagttttaaaatgtaaattaaacacaaatggcaaaagccacatatctgaatagttgcaaatgtcacagagacattttcataaatatctttgtcattaatcttctttgaaaacttcttatgcaataggcaatttatggaaggctgagccattctattttcacagctaaatgaggaggaatagtacaacttccactaaaaatttccagcatttgtgaggggctttaaaagaaaacacaaagaggagatgttttccctcttttttgccataaagtcaaagaaggcattgagataatttgtttcattcctttccagagaaggaaagtgcttcagcaaacaaaactccctgagatttcagttataatcccagttctcccagtcaacattattgcctttgatattgacagtggacagcaagaaaaagagttccctatctttatttttttctcattttcttttttctctccttttttatcttgtctccttatcacctcccctttcttttcatctcgtcccttttccgcacatatcattaggaaaaatgttttgccatagtgaggtggcatgatttagaataaaatggccaagaaaatgtaaaagttgtatcactcccatgaatcccaactgcccactgtactattgcatatatttgaaacatacatatatgaatcctaactataaaaaggcagttataaagaggaaatgtatgatgctaagccacaagcgataacccaaaccctacttcttactaactgtgtggccttttgagccagtcatgactttgctctgagcttcagttacttatctgttaaatggaactaagggtcccaactatctcacatatgagatacgtgaaattgttttgtaaactgtaaagtgtaagacaagtgaaagggaacattattatcttcttcatcgtccttctggtctttttctaagtaggctgatcagaagtaccaagaaaataagtaatacttgtatgtctcaataattttaaaaatattaagaaaagtgatctagaataatacaacaaaaaagttgcctcttttccattactctgggaaaagaagatctacagttaagaatgagagtttaacagtgaagatttcttaaatggcctctgctctttttcttaatttcctctaggctactttacttatattgcatgtttcacacgcactttgcatcgtaatgactattttatgagttgatgattcttttatgagaaatggtttactgtgtaatcaagcagagagaattatctcaagggtcaagagattcaattatgaattgctaaaagtgctggtcacacagagaagactgaaatctgttttgtttttgttttgtttttctttttaatgtatcattagctgtaacgtcattagctgtaacaggtcagcatttctttgcttgtcaaggccaactcataacttttcaacttctcatttaggaaatcaaatgacacactaaagacctagtagtgcagtgatttataattgaggataaatttctttaattggcattcaccaaacatggatgtacctactgctacacataaacagctagggggacacggggaaggacaaatatgaataatagataaaactgctgccctcaaggagttgaaattctggtagagagaaaagaaaaggacatataacatgtaagtaacatattgagaaacatgaaaatcaggatccatgggcactaagagagagggcactcactactagctgatgggcaagaaaaaccaagtctctgtacttgtagatttagttttataggaaggtattttaaaccactgaggattcttatacatcatatttacctataataaccaataaagcttaaaaagggaaaaaaattaatcattcaacatctttaaaagttcaaatgttaactcactggagttttgacctttacttaggatacgggaagctataaagaacttcactgtcaccttaatgacaagaaaatttagaagataatttacaggatctagatcccgtcagagaaagttaaaaaatctcagggcaaccaactagcatgaattctacagacaggcacctccaaaaagagaagaaatacctgcacttgcagaaaatgggaccaggtgatgccaagcaccatacaagctggtaagaactcagctaagaggtccaacatattgcaaaaggtggagtatggactagtatgagtgtatagaacacctgggagtctcacacacaaaagagttttgcatttactcacaggttcttatccctaaatctcactgggcacgctttaaaatgattgggtgtgtggggattgtggatagagaggagggagacaaggcagaagaccaaggagagctgcccttggtggttcaggcctggaaatgggggtgggaagggtggtaataaccactctgggaaaggcacaaagcccagctcagatccttttgtcctctcttaactttaaggtacaaaagctccatgctcctaggggacaggaaatataccctatgactctcagggcacagttgaaaacccattgcaaccgtgaaaaggaaacagaaaatacctacttctctgtgggtggggcaggaagcagtcctgggctcagaccattaaggattcccagtcaaccagaatgaaacaaaaatgactgacgagaaagccccacctctaagacccagagacacaatgccaatctaagactaaggctgaacctgaacaacataggctgaacccctgtcccttgcctttcccaactaagctagcaagcaatgagtaacaaatagtggcaatctaccactgaggagtcaagagtgtgaaggaagaccctcttttcaggtgtagactcacaaggaatgcctgaagctgaggatgttacaggaacattgagaaaaatcctctggcaatgcagcccttacctaagcacaaggtaatgatacaggaatttgacactgacattgcaatgaggtaaccatagcaacaataaaatccaaacccagctaccaataaaatccaaaccataaaatgcaaactcctgaggttgactcaaacatcatctatacatactaaaggcctagcagaaagagaggtacacccatcggcagacataaataccacttaacacagtctctactgtcctacacataattgttgggctttcaaccaaaaaatttaagacaaacaaagaagcaagaaaaacaatcccctaacaagaatcaaaacaatcaataaaataagtctcagatataatctagatgtgagaaccatcagatagggatttaaaaacaattataattaacatgttaagagttccagaggcaaaaagtaggtgactgaataagcggattcagaaagcttatagaacattaaaccagattaaaacaaacaagcaaacaaaaatacatagacatatattcaaacttacattctgaaaaccaaggaaataaaaattcctaaaggcagctagaggaaaaaaatgcattacatagaaagaaacaaaggtaagaattatagtagatttattagggaccatgcaaaccagaagataaatgctggaagaaagaattgttaacctagaatttcataagcaaaaaaaaatctttcagaatatgaataagatggatggctgtgatggctgtacaacaatctgaatgtacttaatgccactggactgtaaaatgtttaaaatggtaaatgtgatgtacgttttatcactacaaagattattttcaaaaatatgaaagagaaatagagatttttttcaactgtttcctagtcaccccacatgtagtcattcattatgttaagtaaaaaatcagaaacattgtgttaggaactatttttgtattattcccacatgagaatccctgttgttcaagacagccaataattagctgcaatctggccaacactcagtgacccgatgggcaatctagtttttccacaatatggataatatcttctttctcctctatcacttcctcacatttaacttctcctcagctgattcttctctccaggtccatgtccatcaagtcttaatcacaaaatgttagaattagtagggtcactcagaggcatcatctttcaggagatagcagactaaatctgtaaagtcagatccattttggggtctttgggctaattcatcatcttactcttggatcttctgtctaccttaagaagatgagcccttcctatttattctagggtcattaactttactccacagtcctctgtgggtaccttacttgcacagatagacaggagttcttatctgtactttgcagccagacctatacgtaataaaagaaataaaacacctttatatgtctgtataagctagatgatggctcactataatgtgaaggcaatccagtcctccaattgtgagttcgaatagaaacagtatgatcttctagagctggaaatatctctttattggttgagaacattaaacaccacaaacttgaatcattccccagtgtagattaatatgagtgcaatatttacaacataaaaatgaggttttaaaatacagaatggtaaacacgtacacaccaaaaatcaaggcataaaatgacttttaaaaaaactgtgtcatggatctcaatggagttgtgtcttctaatagaaaaataattatactaataattagaagcaaagatgagaattaaatgtatgtgacttttaataatgaagtactaataatggagggacccaaggacttgattgaagacagtttaatttggcatatttatccattatctgaaacagggaatacagagtagaatatttacatttgtaaggcatagagtcttttctagattataaaatgtccaagtgataagcataaaacataatgcaatctcacaaaatattttgagtaggaaaaaatgtgagggctgtatttttatttgagaaaaatataattttataaaggaaaaccactggtcttagaggcaaataataatggcgatcaaataatattcatggctatcaatagctatcaagtatcatacattatctcattcaatctttaacaatctttcaaactagctattcttcctatcttatagagaagctaactgaggctcagaaagtttaagtagcttgcccaatgctacaacaatgcttgttgaatgtctatgtgaatgaatttgtcttaattattcacatcccaatctttgaaagatgaaatttggttttccaactatcaagacaaaggatgacccagaaactgtaaattctgccactcttgaccttgatagtttgaaatagaatacgtgttggcaattagcagcctgttaaacaaaaacaaaacccctgtgaagcatgattattaagctttgattccttggcaactttacagatctgtaatatgtttagggaaactaatagaaaaccaaattgggcaataggaaattcattcctatatttggtaggttgacttccatggttttaatgccacaattttcattaataattcaccaggacattagagtaaagcagatttggagaaggaacagtgggcctgtatatgaggctaaaagctagagattaaaagttgctgaaaaagcctctgtggaattgtgtgaagggtcccaaactcagtgttactaataaatggcagttggtattacaaatcatttgtaaggggaatgatttccaagaaatctaagttcacgacgatgtggttgtggataagaccaaccagcagatggggctgctagaagaaatagaggctacataacccctacctaccttaccaacaggttgtattttaattctatttcaaagttaattatttagaatgcagaatacattgcaccatggaaacaatgttacaaatcagaaatcagcactatagtccacatgctaactccagcctatcatctgtgttttttttgtttgtttttcgttttcatagtcgagacctcactttattgcccgggctggagtgcagtggcacagtcatagctcactgcagcctccaactcctgggctcaagcaatcctcccacctcagcctcctgagtagctaggaccataggtgcgtttcactgtgccaagttaatacttttaaattttgtttttcatagagaaaattcaattttctacatccattgataaggttttattgaaatgccgccatgcttatttgtttatgtattgcctacagctactttcacacatcacagcaaagttgagtagttttgaccatatgactcacaaagccttaaatatacacacacatatacactatctggccctttacattaaaagtttcctggttgtgatggttaatattatgtgtcaacttgtctgggctaagggatgttcaaatagctgataaaacattatttcttggtgtatctgtgagggtgtttctggaagagattagcatttaaattagaaaagtgagtgcagaaagtccactttcacatatgtgggcaggcatcatctaatcctttgagagcccaaatagtataaaaagtggagaagtagaaatgctctcccctccttgaggtgagacattcatcttctcctgcccttggacaatggagttcctggttctcaggcctttggacttcaggacttagaccaaccctcttctccctttccaggttctcaggccttcagcattagactggaagttaatcatagccacctctggttttcaggccttcagacttggactgaagtataccaccagcttacataaagcatattgtgggacttctcagtctccataatcacatgagtcaattcccatgataaatttcctatatataaacagtagtcttgccttatctgaggtttcactttctgaggtttcagttgccctcagtcaattacagtccaaaattactatatacagtaagatattttgagagagagagatcacattcatatgcctatgattataatatattgttataattgttctattttattaattgttgataatctcttactgtacctaatttataaattaaactttatcataggtatataagtataagagaaaaacatagtgtcttagggtttggtactatccacagtttcaggcatcctttgggggtcttggaatgtatccctcatggataaggggggactactatatatctatatattccctatttattctgtttccctggagaactctgactaatacattgatccttcttataaaatattattacattcccaggttggctggcaaaagccaatatcatttaaaatgtggttgtgctgtggtgttaatagaattccaaagtctatgccttgaattcttttgagaattctggtggcatttccagctgtggaagctttgaatatcagaacatacttttcaaagtcatactttctacctttgctcatgctgttcagtcagtttggaatacctctccccgacaagaaaaaccataaaaatggctaatatttatgagttaagaaaattgagcattttctacatgttttaagcattttacatgtattactttacttaatccacacaacagaatgagataattactattaatatgcccatttacagatggggaaactgaaacgcagacttgctccaagtcacacttctagtaagtgctagagctaggacataaaccctagaaatctaacacaatctcagatattatgctattaactactaaccacaaggctataacctcttttgcaacttttgaaagccctttcaacttttaaggcctaattaaaatgccaattttttcataaagcctttttccaagattccccatgcccacaagttcaaaataattgtatttatggttttatgagccctctatttgtctataaaagtactcagttcattttactctgtgttctaatttacatgttgcactcccaaccttaggcacatacataaacaaaatgtgaattttaagctcattcagggcaagaaacatacaatccattacatcatacagagcaggtgcttcacaaatgcatctactgcaaataactgagtgaatgaatgcaaaggcagttggctcctgatattaaacaaaacattctaatggagataattcctcaggtggtaaagatattaacatgtttgatagggagcttggttttatttgctattcaaagtgagtcataaccaagacattcttttcaaatctacataactacctgaagcaagccttaagtatagccaaacaggataattgaagaaattatcttgtttatacaagatcaagccagagaaacagaagcccccaacattcatctctctttggggttaaggcagtgatcttccagtctttcttatttgctgatattttatttaacaaaatcctatatggaagtccaaattataatataaaatcaatgaaatgaaatatcttgtaattgaagcagtagagggtagagaggcaaggaaagatgaagctctagaatccttccacctccaagggacccctagggcaccaccatagaacttctagaacacagcacaatttggcttgaaaactataccgaatgcatgttaattcagtaacacatttttgttcattattacttattattttctacatcatcaattatccctagaacaagaaagggccttggcagcattcaatacttgccttttgacataatgtgtaataaattttgatagatatgaggtcaagaaagaatctacagggatgcaggagaggacagatatgagagggcagccataccacagggtcactggacaatcaaaagataatgatgctgggtgctttcaaaaggggatgcaggaaaaaggactctgagggccacatctcaacattgcaccaggcttgtatcaccaatggtaaagaacgtggcaactgttagttattactccaagatgtctcatgatttaaaaatcagctggtgggagtggatctttgaaatataggccctctagcgtttgcaggaatagtgagttgtccagtaaaatatcaaggtgaaaaatccatgtttggactgacaaaaagtatgtgctgttagttaaatattggttaacagacacaacaagaaatcattctgttttaatccataacagtggtactggctgcgctgaaaccaaagctcagatagatatctcattgtgcggagataggttgagcccatctctggctctaatgcaatcttgagcctcaggggcactggaatcaggcacacagcatgagagcctaagaaaaaaggcagcttttccagagagagaaatagagaattaaagagttttatccatgatcttcaaattggtaagaacttgggggtctcatatattccaagtatcagtccttagaaacagaaaaatccctagttttggattcagaaaatttcatttgaagtcctgacacttccacttattagattttaacttgatatttaatctctctgatatgtacagtggcacttgtaatacttgtcctatctcatggtgttgttaatctcatactgaaatgtggatgatgaactcaaaatagtcacccttttaaggctattatcagattactaatttagaatctgcagttctgttctctcatgcttttgggagagtgatcatggaaggatatactaggcttagcagagaagaatccctatagaagcttttgggataaaacatcggaattgtacatgaagccccaaaagagtagagtaggcaagagacaactattaaggaggggcgattaggactcttgggaccagaggtgaaaacaatgctgttgttgctgtttctttttgtaaagatagggtcttgctctgtcacccaggctgggggacatggtgtgatcatagctcaccgtaaccttgaacttccggctcaagcaatcctcctgcctcagcctcccaagtagctgggactgtgggcatgtaccactgtgccaggctactttttaaaaagattttattagagatgaggttttgttattttccccaggcttgtctcaaactcattggctcatgtgatcctctcggcttggcctctcaaagtgctggcattatagacgtgagccactgtgcaaggccaacaatgtagtttttaagtggaaaggaaaatccttgattcccccaggaatgaaacatgtcagtagttgaaaagagaagaaaaggggtaaatttttgttgaccattggttcccagaaaaaatcacaggcaatgagacccaagccttggaaaaaattggaaaagaaaattacaaagcatttaatagaatctagggaattccaatgtgccaaataactgacattatttctgagaggtcttgtcagtaattccagtgcctagaaaacaggagtagacctggcaaaaaaaaataaagtgtctgtatgtatctgtgtgtctgtgtctgtgtgtgagagagagagtggaattgggaagcagttatagatatcttgatagatagataaaaagatagaaaacttgtcctgtgaactacccacatgtacatgcactgtgatttcttggctcctcctacccaccctgtccaatgccactgaaggttagtcagtagaagaaacctacaggcagcctctacttcttctgtagcctcctgtttcaagtttagaaagggatcgtctcagagatgctcaagcctacctgcaattagtaagacagattagctaccctatgggttaaatattccttcaatgactggcctaaaacccctaactgtcatttataagtgtgtttacaaaccttatatgaagtataatgagcctttgctaatagaaaaatattttatattcaagctctcaaatgatggtagttggattttttagaatctattaattgagaaaacacaaaatgaagagagctgctgtgaacccaaaaacttttaagtgaatttcattattattcaccatcatcataaatatactcaagaagttgtacatattataaaatatgtactatatacgtatatgaatatatatatacacgtactatgcaaaacaaaatttattcagcctatagctgatgatttgtgtgtaaatgaattaaaaaacgtcttctaattctgagattcccagaaacctctagtccacatgtttggaatcattaatttacatcactaatcttacatagaaaatgcattctgggttctaagtgaccaacccagaactaggaaacttaagatgactaataaactaataagctaataataagcaatggctaaacattagactaaggcagagcttctcaacgtttttaaattatcatctccccaaggaccccttatagatatttatttttcttaattgtcctccatgaaattttaatactacacatatactatatatctattttatactgttcatactgtgacctttggaggagaacgaaccattgtaatacctaagttttctcacacacacactccaccaagtaccaatttttcaccaacttgaaggctatattgcttctattgagaatatatgggccaaggaactttatattcattatcttatataatccttaaagtgagtattattcccattttattagatgacactgagactgagagaggctaaataaagttatccagttcattagtctcattaagtccacacaaggactgagtggaaacactatacatggtacatttcctagagcagctaataggacactcacaaacacaagctgcccttaaagaatgacagtgtcaaagccatgcattatgcattgaaagttgctatgtgtatgaccaggttttttttctttgacattcattgtctgattaagcctgcaaagttttgctggcttggtatagaataatctttcagtattattgatcaaacatatattatttaacatttttaaatgttttgacattttcattttctaaagtccaagtaatttaaagaaatatggcttgcagaccatttccttcttcaacaccttagaggttatgtgaaagcaagttttactcttgggtaattctagcaggcagcaatgatatgtaattatgtcaagccatgctttttgttcagtgtttttatcaatgttgtcacaagagacagatgcataaaatgttggcattaaaaagattcttaagagatgatctcaattgaaacccaataatcatactcctagttaggagaggaactaagacttaaattaaattatagctgagaacctttcttcccaaccagaggaatttaatctaggtgccatagaaaaaaataaaatcacagatttttaagttagaaggtatgttaactgattcctaagatacttccaaattggtaagtcactaaatgtagtttaaagaaaaaagatatgagagacttatacttctggccaagataaagtaacaaggaccagattcaatatatgaaataatggtttccaaaacactgaacatcagacaacaaaggacagtgaactctgagagatgacaaccaagcaactgagcactgtaattttttcagttttctgcattgagagagtttacaagtcatgacacagaaaagatgaaaaggagcttagtaagctccttgacttgaggagatagaggtaagagtctgggaagaccaaagcacttcattcagactaacagcaaataaagggatgcatggagacataactctagacatctccagaaagttctcaaatatgtagcagaatacaaataagcacatgagtatgaagaaactaccagaggtagagaatcatctgaaagttataaggaataatgtgttctacaagactgaaaatagtacttattcctgccagtaagcctgaaaaaaatcataattcatagggcattagacggagtactcagagaggtcttgcctcagttatggagaatattagctctagactgaacattgctccagcccttcctaacaaatcatataagcaagacaggaaaggatcaaactgtttccaaataacttaactctccataaacatagctcagaacaatacaaaaatatgtacttcttaacaaggcaaaatgtacaattatctctcattcaatgaaggattacttagtatgcaaagagtcaagaaaacatgactcatgatatgaaaaataatcaattaatccaaaacaactcagaactgacagatatgttagaattatcaaagaatgacatactgtacttccatatgttctaagagagacaagaaaaatattttaaaatatccaaattgaatttctagagatgaaatctacaatgtgtgagacaaaaaatacacaaaggtttaacagtagattagacaatgcaagagaaaacattagtgaacttgaaggagtgatattagaaacaatccaaaatgaaatccactgagaaagaagaatccaaaaaaatgaaaagagcatcagtcagctctgggacaacttcaagtggcctaacatagagataattggtgtcttagaacagagagaagaaaggtcagaaaaatatatttgaagaaattatggcagacaactttccaaatttcatgaaaaccataaaacacaaattcaaagagctcaaagcatcctaagcataagaaacataaagaaaactataccaaggaactaaattgctcaaaaccaataataaacagaaaatattaaatgtagacagagaagaaaaacacattacctacagaggagcaaagataagtaagacttcagattcctcactggaaacaatgcaagtgagacaacaggagcaacatatttaaagtacttaaagaataaaacaaacaacaacaagaaaaaacctgtcaacctagaatgctatagccagtaaaaatatctttcaaaaaatgaagatgaaataaaaacattttcaaaatgacagaaggacaaataattcatcaccagaatacctgaactataagaaatgttaaagattgtccttaaggcagaatgaaaataataacaaatagaaatctgtatcaacatgaaataatatagagtactggaaatggtaactacagatagtccccgacttacaatggtttgagcaaccagacaataaaggacagtgaacacagagaaatgacaaccaaataaggtgagcactgtaatttttcagctttctgcattaacagagtttataggtcatgacacacagacgatgaagtgaaaggaccttagtaatctccttgatttgaggagatagagataacagtctggggagaccaaagcacttcattcagactaaaagggaataaagaaattttggggagaaaatacttgcaaactacccatctgacaagggattataccagaatatataaggaactcaaacaactctataggaaaaaaaaaaaaatctaataatccaattaaaaatgggcaaaagatttgaatagacatttctgaaaagaagtcatacaaatggcaaaaagcatatgaaaaagtgctcaacaacattgatcatcagagaaatggaaatcaaaaccacaatgagatatcatctcattccagtcaaaatggcttttatacaaaaatcaggcaataacaaatgctgacgagcatgtagagaaaagggaacttgtacactattggtggaaatgtaagttagtacaaccactgcagagaacagtttggagtttctcaaaaaactaaaaataggctaccatatgatctagcaatcccactgctggatatacaccccaaagaaagaaaattagtatatcaaagagttatctgcactcccatttttgttgcagcactattgacaataaccaagatttggaagcaacctaagtgttcaacagacgaatggataaagaaactgtgggctgggtgcagtggctcatgcctgtaatcccagcactttgggaggccaaggcaggccaactacctgaggtcaggagttcaaaaccagcctggccaacatggcgaaaccctgtctctactaaaaatacaaaaaaattagccaggggtggtggcagatgcctgtaatcccaggtactctggagggtgaggcgggagaatcacttgaacccaggaggtggaggttgcagtgagccgagatcgtgccactgcactccagcctgtgtgacagagactccatctccacaaaaaaaagaaagaaagaaaataaataaataaataaataaataaataaataaataaataaataaattgtggtacttatacacaatgaagtactattcagctataaaaagaatgagattctgtcatttgcaacaacatggatgaaactggaggttattatgttaaatgaaataagccagacacagaaagacaaacatcgcatattctcacttatttgtgtgatctaaaaatcaaaacaattaaattcatggagatagagaatagaaggataattgccagagactgagaagagtagggaggtggtgtgggcagcggggaggtggggatggttaatgggtccaaataaaaaaaatagaatgaacaaaccctagtatttgatagcacaacagggttctgtagtcaatagtaattaaatcatacatttaaaaataactaagaatataattggaatgcttgtaacacaaacggtaaatgcttgaggggatcgatacccaattttccaagatgtgattattacggattgcatgcctgtaccaaaatatctcatgtaccccataaatatgtacacctactatgtatctacaaaagttaaaaaattttaaaaaatttaatatgaatgctcagcacattaacttccagtcttcttgattttctaatatatacatttagcatgataattctctctctaaagtactaccttagcagtatcatagaaattttgattgttgtatttttattacaaagttcaaaaatgtcctaattttcatgattaatacttctctctttgactaatgtttactagaggagtttttgaatttccaaatgtggatttttctagttaaaatcttttaaaattattttgtggtcagaaactacattctaaattatttcagtcctctagaatgtatttagacttgctttttgtggtgcccaattgcatgtgtgcatgtctctgtgtgtgtgtggtgcgtatgtgtgcatgtgagtatgtgtatgtgtgcgcacgcgtgtgtgttttcgagtcatctatttatttcaaaaacaatgtgtttgccattttgagattcaactttctatatccttagtgatttttttttgtctgcttgtttggtcagtttttaagaaagtatcttaaagtataccactatgattatatgtttgcttgtttctccttgtagtttgtcatgattttctttatatattttgaagctatgtttttagttaaataaaaattataatactttttctggtgacttgaaactcttttcattattaagacatctttttaaaacaagcatatcagagccctaatgtccaaatgagttttaatccctttaaagtagttcttatgaagtcagacacttactacaacaatgttgttatcactctaaacatttttgtcctttggtttttgggaattagcttccagacctttatgttatggcctcatatgaacaaagtctatttcattctattgtaattaagaattggtttttactccaaatgtgattatacagttccgtcacagactttcttctctaatttggctccagattgccttctgacttaccaccagtgagagtatttacaataatatgccacagactcagaaagtagtgcccagggagaaccaatggtggcaaatttggaataaacataccatttcctaaagaaataagaattttgatcctgacttggacactaaataaattgtgtgatcatgggcaagtaatttctcttttcctctcagccatagtttccttccgaagtgtattgagaggcatactgtcaaagtctattattcaattattacaataggaaatcaatagcatataaaagcaacaacctgagacagcctgacttggagcttcaagaaaaaaaagaaagaagataaatgtttatcaggagtattatttcattacatactctgttttttaatgttgtagtgtaagttttaactcttcggatttagaaaaatatagtgcttgcaaactgtcattttattaggggaggcaggtctaaaatatatacctaataataggtcacatataatgtagaaagatgtcagaaaataacaaactatccagtgaatatacggttaattgtgaactctaacaaaattgaacccaggaatccagtgttttcctcttttattacattgcctttcaatgatcagaacccaaagttgaatgtataatttaattggcaaccaaagcagctgagatgtccttagagtcagaagggtgtatggctacagagatctgagctggctctcaaactacccattaagcagcagccaaggctaaagccacagtgtcttcgggaaacctttaagaagcagggtaaagtaatgggacaagtacagggaaagcaggtaaaaatgttgcctatctttggtagagctgacaactctgtgaacaaaaggccactgggacttattaatcaacttggagactgtatctactgtgaaaacagcctcagcaatagaagttgaaccttgaaaactggataggaaagcattgaaaatacaaaatactaaatgcaaaaaataaagcctgtacaagtacagatctaagtttataccctggctcggacaattacagttaagtgaccttaggaaagtgatctcacttccatttccatatgatgagaataattctacctactttgaaaaattgttgtcatgagatactgatactgagtttggatgtgtgccccctccaaatcacaattcccaatgttggagctaggacttggtaggacaagtggttgaatcatggaggcagatccctcatgaaggcagatccctcatgaatggcttgatgctatccttgcagtaatgagtgagtgctcactctgagttcacagtgatatctttaaattattaaaaaaaaaaaaagaggctggaatttcctcctctctctcttgccctctctcaccacgggacgcactggctccctttcccttctgccatgattgtaagcttcctgaagccctcaccagaagcagatgctggtactatgcttcttgtacagcctgcagaaccaagagccaataaaactctttcctttgtaaattacccagtctcgagtattcctttatggcaatgcagatagtggatgaaaaacacctaatatagatgctcaataaatggattttgattatatgcccagtttatattttggggctctaatccatacaacccatacttaaggatagatcctcttgactacatccatcataattgatacgaaaagtacagctaggaggtgcacccaaatgggtccttaccctctcatagggagcaagacagaaccagatgcttttctttcatatatccatagaagtgttggtattactggatactggcttaaaaaaaactgtatacttttagctaaaatttcttggcttattaggcatgttaggaataatttaatagtatttaatattatttataatttaatgacatttaatggcaaatatacaaaattaagcaattatgttacagaattatattttatttaaaattatttattccttgattaaatgaatatttactaaattcatgctgaaaacaccatgatgcagcatttaattagagcacagaaggaaggatttggacaggcagatttagtagggcaggttattccaagcagaaaaacagcctaaggaagggattctggaaaactgactactagaggaaagcaggtaaaaatgttgcctatctttggtagagctgacaactccatgaacaaaaggccactgggacttattaatcaaactggagactgtatctactgtgaaaacagcctcagcaatagaagttgaaccttgaaaactggataggaaagcattgaaaatacaaaatactaaatgcaaaaaataaattgattttggcccaaaaatgaaaatctaccaatttacttctttgtccttgtttatatcccacctctatccagaagagaaactttgaaaatctaggataaatcctttttttcttctatataccactgtatccaccatttaggcatttttgtgaggtccgttactatatggactagtactaaatactggtcaagaaagagatgtgcagcctggatgaaaaggaaggaccgttttctgcagaggctttttcccctcactaagaaatggaatataatcaaattcctctaaaaggaacggaacacaaggacatcctgctctactctgtctccagccctaatgatagaatgaatgtctcccttccttcctgtgttgtagagattattaggtcaaattctggtgttcaacatgagatatataatacccagcattagcgtgaggcagaggttctcaaactttagaaatttagtcaattttctgttatcttcatatttgccatatccacttaggatcttttctattgtcaacttaaatttttctttggagtaacttaaagtgttacaaaaaagcaccttactttttaatgtaaatacttatatttacttcacctagggtaaaaacatctgtaaaatctcaggtctgatatgctagttatactttttaatccataggaaattaaatttgccccctatcactcagagcaaccagtggtacatagacaatattttgagcaatgataatttcaattcacctctgtctcttgccatagctgactagaatatctaagaaaatatccggaaaatgctaagaaaactacagcaagttctagatattatttcttatcaattcggagtacgaagctgtcatgttcatcactgactctcagtaactagaacagtttctggcaagtggtaacttctcagtaaacttgtatgaataaacttatgaataattgaagacccaaagatttatttacttcctatctttttactcagcaaatttcagaatgtggcttccgttgaagggacactaagcagcatctgcttgctctgtttagaaggtgaagaagagaaggctaaacttgaccacacttggtcatcttagagccatcacggttacaagggcccctatttaactttacttaatgctggagttttgtttcccaaagcataggacgtataattttatgtggtatatgaattgatttcacatggttcatgaatatggtattaaataacacttgaatcccatagaggaagttactctagtttctttttttaatttgtatttgtttatttttattttacactaatttcctggatacatatgcagaacatgcaggtttgttacataggtatacacgtgccatggtggtttgctgcacctattgacccatcctctaagttgccttccctcaccctccaccctgcaacaggccctggtgtgtgttgtttacctccctgtgtccatgtgttctcattgctcaactcccacttatgagtgggaacatgtggtgtttggttttctgttactgtgttagtttgctgagtatgatggctttcagcttcatccatgcccctgaaaaggacatgatctcattcctttttatgcatcgaatactgcatagtattcgatggtatttatgtaccactttttctttatccagtctgtcattgatgggcatttgggttggttccatgtctttgctattgtaaatagtgttgcaataaacatacaggtgcatgtgtctttatagtagaatgatttctattcttttgggtatataccagtaatgggattgctgggtcaaatggtatttctcgttctagatctttgaggaatcaccatactgtcttcctcaatggttgagctaatttacattcccaccaacagtttgtaaaagcattcctacttcttcacagccttgacagcatctattcttgactttttaataatctccattctgactggcatgaaatggtatctcattgcagttttgatttgtatttctctaatgatcagtgattttgagctttttttcatatgttttttggccacataaatgtcttcttttgaaaagtgtctgttcatatcctttgcctactttttgatggagttgtttcttatcaatttttttaagttccttgtaaattcctcatattagacctttgtcagatgtgtagattgcaaaaattttctcccattctgtatgttgtgtgttcactctgatgttttttttttttctgctgtgcagaagttctttagtttaattagatcctatttgtcaattatggcttttgttgcaattgcttttggtgttttcatcatgaagtctttgcccatgcctatgtcctgaatggtattgcctcagttttcttatagggtttttatggttttgggttttacatttaagtctttcatccatcttgagttaattgtgaatgggagttcattcatgatttggctctctgcttgtctagggtgtaaaggaatgtttgtgatttttgcacattgattttgtatcctgagactttgctgaagttgcttatcagcttaaggaatgtttgggctgagatgacggggttttctaaatatagaatcatgttgtctgcaaacagagacaatttgacttcctctcttcctttctgaatactctttatttctttcttttgcctgattgccctggccagaacttccaatactatgtcgaataggaatgatgagagagggcgtctttgtcttgtgccggttttcaaaggcaatgcttccaacttttgcccattcagtgtgatactggctgtgggtttgtcataaatagctcttattattttgaggtatgttccatcaatatcagtttattgagagtttttaacatgaagggatgttgaattttatcataggccttttccggatctattaagataatcatgtcgtttttgtctttggttctgtttatgtgatagattacatttactgatttgcatatgttgaactagccttgcatcccaaggatgaagctgacttgatcgtggtggataagttttttgatgcgctgctggattcggtttgccagtattttattgaggattttcacactgatgttcattagggatattggcccacattagaaagctagaaagatctcaaattgacaccctaacatcacaataaaagagctagagaagcaagagcaaagtgatccaaaagctgtcagaagacaagaaataattaagatcagagcagaactgaaggagatagagatccaaaaaccctccaaaaacttaatgaatcctgaacctgtctttttgaaaagattaacaaaatacatggaccactaactagactaataaagaagaaaagagagaagaatcaaatagtcacaataaaaaatgataaaggagatatcaccactgactccacagaaatacaaactaccatcagagaatactgtaaatacctctacgcaaataaactagaaaatctagaagaaattgataaattcctggacatatacatcctcccaagactaaaccaggaagaagtcgaatccctgaatagaccgataacaagttctgaaattgaggcagtaattaatagcctaccaaccaaaaaaaaaaccatgaccagatggattcacagctgaattctaccagaggtacaaagaataactggtacccttctttctgaaactcttccaaacaattgaaaaggagggactcctccctaactcattttatgaagccaacatcatcctgatgccaaaacctggcagagacacaacaaaaaatgaaaacttcaggaagttattctagtttcaatcctccgtgaattctatttgcatcaaataaacacttggtttggcactaggtgattatctctcaaaaacttcaccaagcaggcaacaatatgtaattatatttaaatagtattgttttgtttgtcatttgtatctatgtttacagagtaatatactacagtagttaggcattacaggctttgaagtcactcagcttgaattaaaaaaatacaggtttgctaactattgactgatttcttgggtaggtttcttctgtgtctctttgctgtcatttgtatatgggtctaataatggtacctacttaatggggttcatgtgaggatcaaagacctaattcatgaaaaataatatagtatgaagcactagaaaatattcaataaatgtcagctattgtacttacttttaggaggtgataatggtttcccattataggaaggagttaactttatgtttaaacaaaatttgagaagtaaaaaaaaagtggtcaatgtggagaaaaatattatagtatagctagtagaaggctatagctaaaattcttatggtggtgactaaattttggaaagtgctatgctaggctgttagttataaatgagttaaccagttctggtagggccaccaagaggcagcgccttccaaatcaaatgttccatggaaatactctaaaatttcttagtgaccagtgaacttagcacataacttggcacatggcatgcactccataaatatttgttgaatgatgaattaatgcatttaactgacatgcagaccaatagaatcttcttggctaaaacccaccttttctattttactttttaaggaaaatattgagcctattttcagccatcccatagcctaactctatgcagactgagggtggatttttttagtcataataaatggcaactttgccaactgtacattaatattcaaagcatatgaattttcttgcaagcagcagcatcaacagaatatcttcatggctgactcactagagagctctgtctcaaaatattacttgcagaattgttgctacaatcttagctgagattattaacagttgaagaaattgaagacatactacctctctctacttttctatgaattccaagttctattctcagaccagataaaaccaatagatgactatttacctgaatctcattacttaatatcctgtacatatgtcttcactgagcttttctgttacacctctgaagtttattaatagtattaggcatgacctttatatagggcatgctattgaatattttgtaaaaaaaaatccatgttcaaaaacattttttgttgtgaaatatctcttatataagaacctgctgtacaaattctttttagaaaatgaatgagcgtccttcgttctattataaaacgaaatttatttgactgactgaatttcctttttactcctgagtgatggaaagcttgaaacttaagttaatgtccttttacagtagcacatattagcttgggttcttaagggaatatatgcttcctatcaccatgacttttattttaaatttctattttaataatatgttttctagattttttttgtaagccatctataatcttacttggaagcaagaagtactagaaagcagtttaggtagtttagaaaaaatgcacactcaaactctctgtgttcaaatcctagctccattgcttctcagctgctatcttgacattttgtttaatctttcaatgcctctttttcttatcgataaagtgggaacaaaaataggccccatctcataagtttattggcaggattatatcagttaatgtttagtatagtgcttggcaaatcataactgaaaagaaatattaggtatatttcaaaactaaggaatgtgacaaataataagtaggatataatcattatgaagaataaactgataaagaatcgatatagctaaaaattaaatgtgcagttttctcacttccaaaactaacataccaattttttgtaggattgtgatttgcccaggcctgtgttctagtagcagatatgcaatgagggagggtacgttcagggcaggtttcatgcaacctttaatttattcagtgtctattatgttcttcacatgatgctgtgggctgtggggatacagaaataaacaaaacaaagtcttagccaaatggataactttctaggtttaaggcggtctaagagaaaaaggttaacttcagggagaaataaaatccaaacctcagagaatgctaatatagagtaattccaagagaaattatgtgacctggaacttccacttccagctgagatagaattacaagaaacagaattaccctcttgacttaaacaactgaaaacctggacaaaatatacaagacgtttcaaatctttgacaacagccagcacagtgctgtgatcactgagaaaagaaaaacaaacttctccaacgtattgcctggaagtcgttcctaagttatagccaatgtacagaatgctataggaggatataataaagagatctattttttttcctgggagtcatgaaaggcctccttgaggaaatgatgtttatgctgagacttgaaagatttagttattcactcagcaagtactgttgagcatctgtgcattgattgttctaagtgctaggtggcacagttaaacaagaaagacaaggtaggtacttgctctcacggagcttattttctggtggatgaataagagataagcaggacaagttggctaagggtaaaagaatgttccagactgaagaaagagaaggttcaatgacccacaagttgaagagatcctagtgtatcctagtgattagacatttagtttgattagaatgaaaataggagtttgtggttgaggagttatgactaaactggagaatgatgcagggatcagagcatgcaacaggttataggccatgttaagaatgtgatgctttatcataatgataatgggaagccactgatgttttttaaacaaacaagagatcgaatcaattttgtataattaaaacattactctggctccaagtcaagaatgagttggaatgggctagaagcaaggagatcatttaggaagctaatgcaaatgccccaataaacgattatagagactggattacagtataaagatgagtgagagagactggaggatagattaaatatctggcaagagaggaaagggaaagagggaagtcaagaatgacttcactgtttctatgtctagcaactgggagaagaacgatgtcctttatcaaagagataattctaaagaaggagcatattgggaggaagacaaaataaatccaactttgataacattacacttgacatgcctgtgaaatatcctagtggagctgtcaatgtggtgaatacacacgtctagagctcaggaggagagtgccagcaagatatgggagtttttaccatgtaaatggtatagaagtcatggatgcagataaaagaagccctgtcacaccatggtacatgtaagtatactatttatttcttacttgtctgtatgctcagtagtttgttttaaggtgtttcacacatatctgcatgctgtaagagatgctcctagtctgtgatttcctatatactacttctgtttctttgtagcttctagaataagcctctatacacaatacatacactataaacattttcaacagagaaaccagaaaacactactcttgttccagctggtgtctggtgaggacgcactttttcctcccttacaggtatagcattccacatttgaggcaatggatttcttaggaattacaggaattttgaaggatttttttttcctaccatgatgtgtatcctggcaaaataaatatgcattctcttattggagcaggcagccaggaatgtagagctctgggaaatccctgaagtaatgagctctgcagtgtaaagacccatgtgaatcattttcaggcacaagttgattgagcttgtccctaaattagaaatggttttatggagcaaacatttgtggcgttggtggacctcaagaaaacagacttacagttgacagttttttagttaatactgggaaacaacagttggtgtgcatgtgcgtgtgtgtgtgtgtgtgtgtgtgtgtgtgtgtgtgatgtgtttctgcagaatcctactccaccagggaacatgagttttacattacagttgtttgcctttctgtacatgactttgccttcagtctttcacttgctgaagctgcagtgctgctctattctgatgttacttcagtgcagctggaggcatgtcttttggcaaggttctgtgtttattataatctctgtgatgtaaatttcttctttaactttctcttaaaatacttagaattatgaatgtgattttaattagggatttcaaatagaaacatttcctttttcttaagacagttttcagttagaatattttagggttttgagaaataccagatccccaactcaaaaagtacacaaaataatcatcagttactcctttaggttgccacggtgtggctgaggttgcagggcatggatttgagttatagtcacaactaagtatcctgcaactcttttttgcccccttcaaatacctacaacctattcacagatttggaaaacctttactacatcacatcatgggtatttttcctttatgtaaactcatgcctgttagggttaggtcttgctccaggcctggcatttcagttcagatactgtttttgcctcttttagacttgtgactttgtcacttagcctctatgaatctcaggagcttcatatgtgtaactcagatgtcctgctctcaccaggtgcaaaatgaatattcaaaattaaatgactccatatgccctgcttccttttgattatcaagtatatataaattaatatgcttatttttacatggaaatgactctgcagagccattacagaacccaagtaacaagtgttgccccagaggtgaactgaagatgagaaggagacttattttgcactgcatatccttttgtaccattggaggttttttccatgtttaaatatgactttgttaaaaacaaagaagcaaaatcaatatgaataaaagcccccatcttgtgaactgtgagaaattttattttcttagtttgttttgtcaggtattcctaagattgctttcccagtcctaattggttaatcctctctactatcaatgggaagtctgccatgccagcaaaggatgtaaaccctgctgctgttgctgctctctctatcccatagcgttgttcctctatttgaggacagctctcaggacccaataatccctgcccagaagtatagctttgtttgcttccagatctgggccttcaccctcctttctctatagtctctggcctcagcacaggctgcaagcagctgtgcaggaagaacatagaatgatgaattcatagaattagcagggcttttgggaggtttattcttgctggaagcagttggctctgttcttatgggtagggattccacggcttcccttggtagatcaagtccagtcaagtcattccttcctacactggcaatatacatttcagtcaatgacatggatgaaggtaggggttgcacatatgacaggaagttgggagggatgtgctaagtaataaagtcaggatccaaaactatctgaacaggctgcaaccaaattaaatatagcaagatgggcctaaatacacatatagctaaatgattggttacttgatgggaagagatgtttgcatatcagtgtggatgaaagataaactaggattttaggtgacagtgaaggtactaacaaaacattaatgcttaggatgttttcgaataataatatagaatgagaactgtgataattccatccaattagaccatatataactattgctttctatatcaacatattacttttgagagagacaataataaactgcacttataggagaacaatcaaaatggagaagaacccgaaatcactgtgatgatgtttagttatgacagctagcctttgtttaccagtttctatgtaccaaacattctcttgagtgcttatactagtttttgttgcataactgtgtagattacattattttttagtaaatattcactcctccctcccctgcatccattggaagtgtatacttttccaccccatttgatgttgaatgtggctatgtgacttgttttgggctcatggttggcagagtttacttcccctcctctggactttggacttagcacaggactttctgtgaccaatggtaagctagcagaggtgacaggcaaaagcccagctttttgtgtgtcttcttagttggcttttccctcctacactcctgcctttctccattagataagcatgccttgggtagctgctagtctgagtaagaaggggcatatttggagcagacccagaaccgatcagcagcctttggagtgaattccagccaagatcattctagatcagttgaacctcagccaacctgtagacaagggagctaggaataaatgtttattgttgaagactattgagtttgggggagtttgctatgcagcactattgtggcaataattgattaatatactaacagacaacctcaaagtctcgatgacttacaacaatattttttttttctcaaaagtcatgagtcagttgcggctctgctggatatggctgaaataggctaggcttggcttcagattgtaaactgggttcgaatcagctttgtgtgctttcttattttccttgtactagtgactctctggggcatgttcttatagaagatcattagagtgtaagagactagaaaaccatgcaagtatgtttaaagtttttcattatatcacttctgctaacattccattgggtagagcaagtcatttggctaaacccaacatcaatgagacaggaaagtatgttctactcacagtggcaggcccagcatagtggcaaagaggataaatgtaaaatattttaacacagagagtttatgggaagttcagaacaatgactgtctaatctagcccagtgctctacacgaattatttatctatttctttacaacaatactatggaataaacacaatttccctattacagtttggggaactgagatacagaggagataataactatgcaaatatcacagtattagcaggttgttgttataagatttgaaccttcagagtatgatgccgaagattgtatactttatcagtctgattcacctccgcccaaacatgtcctgtgatcaatgtttaaagcaataagagcagttttgcatggagaggaaaagccatatgttgaccatcttcctagctctgaagggctatcatatggaagagagagacaagatttgttttatttgttgtaaaaatgtggtacccttggtagaggtagtgggttgagagatcaaaggaatatacattttggcacaatttaaaaaaaaacttttttaacagtaaaaacttctcaatgatggcttgtatccaagtaaatacctaggtgaccacaaggcatgggtgttataaagaagattccaaaatcatatggaaaatatggttagcttgaaagatagttaaaacctaaaattctttcagccaagaaactttataattctatgaaaattattctaaaaacatagacattcactgtaagttaataacagcttttattacagtagtaataaagcagagtttttcaatgtccaaaatggctagaaacttttagagctagctaataattaagaatcttggctgggtgtggtggctcacacctgtaatctcagcaatttgggaggctgaggcaggaggatcacttgaggccaggagttcaaacccagcctgggcaacatagcatgacccatctttacaaaatacaaataaattagccaggcataatgacatgtgcttgtagtgccagctagtcgggaggctgaggctggaggattgcttgagcctaggagttcaagcctgtagtgaactatgattgcaccactgcactctagcctgggagacacagcaagacaccaactctaaaaagtaaaataaataaaataataatcctacaatggcctctaagtgtttaagtgaaagagtcacatgtttctcattttaaatcaaaagctcaaaacaattaagcttagtgagaaaggcatgtctaaagctaaagctcaaagctaggcctcttataccaaacagttagccaacttgttaatgtaaagaaaaaagttattgaagaaaatagaaatttctactccagtgaacacagaagttataagaaagctcaacaaccttattactgatatggagaaagatttagtggtctagataggtcaaaccagccacagaattcccttaggcaaaagcctaatccagagcaaggccttacctctctttaattctctgaaggctgagagaggtgaggaagctgctgaagaaaaagttggttcatgaggtttaaggaaagaagctatctccagaacataaaagtaccagattaagcaacaagtcctgatgtagaagctgtaccaagttctccagaagatctagccaaggtaattgttgaaggtggctacactgaacaacagattttcgacgtagttgaaacagccttctattggaagaaaatgccctctaggactttcataactagagagaaaaagtcaatgcctggcttcaaagcttcaaaggataggctgattctctcgttaggggctaatgcagctggactttaagttgaaaccagtgctcatttaccatttcaaaaatcttaggttctctaagatttatgcaaaatctactccatctgtgctctataagtggaatgacaaaacctggatgacagcacatctgtttacagcatggtttactctagcagtcctcaacctttttggcaccagggactggttttgtggaagacaattttttcatggatggtggaggtagtggggtgttggcgaggaggacggtttcagggtgaaactgttccacctcagatcatcaggcattacttagattctcgtaaggagcacacaacctagatcccttgcagagatccctctgacagagatgtacaaagagacttgtgttgtttttatgcctgctaacccagcatccattctgaagcccatggatcaaggagtaatttggactttcaagtattattatttaagaaatacattttgtaaggccagaactgccataggcagtgattcctctgatggatctaagcaaagcaaattgaaaacctatggaaatgtttcaccactctagatgccattaagaatatttgtgattcatgggaggaggtcaaaatagcaacattaacaggagtttagaagaaattgattccaacccttattggtgacttttaggggttcaagacttcagtgggggaagtaacttcagatgtggtagaaataacaaaagaactggaattagaagtggagcctgaatatgtgactgaattgcaacaacctcatgatgaaactttaatggatgaagaattgattctcatgaatgagcagagggagtggtctcttgagatggaaactattcctggtgaagatgctctgaacattgttgaagtgacagcaaagtatttaaaatattacataagcttaataaagcaactgcagagtttgactttaattttgaaagaaattctactgtgggtaaaatgctatcaagcagcatcatgtgctacagagaaaactttcatgaaaagaagagttgaccaatatggcaaacttcactgctgtcttatcttaagaaattgccacagccacttcaacctacaaccaccaccaccttgattagtcagcatttgtcaacatagagacaaggccctccactagtacagacattacaactcactgaagtttcaggtgattgtcagcattttttgccactaaagtttttttttaattaatgtatgtactttttaaagacataatgccatttcatacttaatacactatagtacagtataaacagaatgtttatatgcactgtgaaaccaaaaacctcatatgacttgctttattgagatattcactttattttggtggtctaggaccaaacctgtgtatctctgaggcaggtctccatccaaattactttcatctctgttactatggtgaaatctggagacagtataaaatctgaaaggtgttgaaagtttagatgaagggccagctattgaaaaacaaacaccctcttagtatccatattatctgccaaaaaattcatagtcaatttatgagcatctttttaaaactttaggatgaaacaaaactaaaaatttcttttgaggtatcaatattaagatacacaaaaataagaattttataaagatgtttatatatgaggtcttagttcacctcccctaagactatttttgccataaattctcatatatttcagttacaaatctcctgccacatggtttttcaaaaacaagtgtgcagaggaaatactgtaaatattcatatattgtagctatattccagatacatccaagacacataaggtaaaaacacctttgctgggattaaataaaaggcatgcaaatctaatctaatagaacatatttaaaaatgtaattgcactactttcacatatgccaaagttcacaaaaatttacagtgcatctattatgtataatgccttaacactacagcaacacaaaatgtctagccaggaattaaagtgttattaagagacagaggagatacatgctaatgactcaaatcaagagtgtagtaaggaaagagtgccatagagaaggctcatggcaaacgttaggaagattcaaaggagagagagaaaagaactcactaggaggagctttgagattcactgattcaacaaagaatcatgaagttcctaccgtgttaaaggcttagtgcaaaatactggaatggactgattggtaagctaatcagtagtggagataaaaattgagagaatcggaaaagcataagacaagaacagagtaaatgtctttaaagtagagtagggctggtagagctctaggagagcttcctcaattcaacagggaactggaagtcagaatatttattaaacaggaagtgataggatgaatcatgggtctggcatttcaatggtattatttgcaatgagttatatgcatatgaagattaaatgatgtggtcagatctttctcaatcttttgatttctgaagaaggcaaagcagacttaatggttttggatcctctgtaaatttatagagatagtacaaaggaatgcctcagaagctgtcacaaaaagtcacaaagttgaaatgattaatataccaaacaatgagttttcctatatcacaaaacatcatcacctctgatcaatggtcttatagaacacaaacatacagtattagttcattttttcaggtcaaggctaagaaccataatatcaactttaatactgactaaattccaagactggatctcagtttatctcaatttcctcaggtcattaaccttctttatttctgcagtggggaaaaagataatatggcctactagctccactattgtgtgaaagaactaaataacactgatgaagaggtctaagacatgggaagtgctaaatttaattatttactattagcatctcctctccatgcagatgtttctggttttaaaaacgtgaaccatgtggacaacgcaggatcagtgagtctagtaaatgaggaagcaagaagggtatacagagaagcattatgaaagccatagggccagaaaagacagaacatccgaggtgtaggggagttcaaaagtaaagtaggattaacccaagaaatactctcagggatgtgatttgaagaaaaacaatctggcagaccagacactaacataaaaggcaaaaagggaggagggacagacataatgcaatattaaagacaaagggacagcctaccaaaggaaaaataagagaagttgcatgggtgagagatgaaaaatgcatctccaagaattagttcaaatgtttcctttggaaaacaggaaatgtaagccttggtgaaaacaatatgacacaggaagatagaattaaagtaatttaaaatgaagatgtgaacgcacaccctcaataaggtacagttgtatacagtaccctaaaacttaatgtataataataataataaaataaaaaattaaaaattaaagaaaagaaagaataagacctactattaatatttgatagcacaataatgtgactatagtcaataataattgtatacctttaaataacataaagaatgtaactggatcgtttgtaactcaaaggataaatgcttgaggggatgaataccacacctgcaaaagggataggttttaaaacaaacacacacacacacacacacacacacacacacacacacatgcatgataaggtctaaagaaatcagccctgaagaaaacggagcaaatagatcctttgttatcttgacatatagtttccatagaaatctgacagtgaatttgatcacttacattctcaaacttaagaaaattgcttcagaattagtcttagggtcactataaagaaatcatctttactgaaggtgaaaaggatacatatttttacctgcttattgtttaaaaacataataattataattgactatcctaatttttgtactaggaaattaagaaaaagatatcagtgagcttctatgagaaaacaaaccataatggaatcagatatcatctcacctcctaattacctgttttgaccttgaacaagtcaattaacttctctgggcttcagttttctcatctgtaaacctctgtttagggattgtataagtgaaggtatgttacgcacaaagctggtacatgttaagtgctcaattaccgtctcctttctccccaaactggctggcataaagacactgaaaaacacataattcatttatatatcaaaaggtgtttctcaacagcccacaaggccttagtaagtaaatatcttgttaactttgaacatgccatttcttcaacaaaaaacaaggaatcatgggaaaccaattaaatttgagaatctttcaatttggaattgcttaaaagctatgtgaaaactagtaatttagtcctacattctcataattagtaatcttggttgggcatggtgcctcatccctataattctggcattttgggaggctgaggcaggaggatcacttgaggctaggagttcaagacccacctgggcaaaatagcaagaccccaatctattaaaaaattagaagtctcaccagtgataccagtgtcagatcaatcactttctcttttaaaacaacatagatttttttttcagattttttctcttgccccattcccaataaaaaatgaaccagtagtgaagttgattgaatcttatagactagattttgctttgttttttaaactttatttatttatttattttggaaacaggatctcattctgtcacccaggttgggctgactgcaacctctgcacccatggctcaagcgatcctcctacctcagcctcccgagtagctgggaccacaggtatgtaccaccacgcctggcttttctctctctcttttcttttttttttttttgtattttcagtagtgacagagtcttgccattgttgcccaggctggtcacaaactcctgggctcaagctgtctgcctgccttggcttcccaaagtgctgggattacaggcgtgagccactgcacccagccggtttttaaacttttattcttgggctagctctgcaaaatttgtggttggtatctattggcaaagaccaaatgagagcaagaaaaagcatatagaaggaaaatacaaatatctggatgataacaaagtgtattgcaaaagtcactggtcaagggagtcaagtgggccctgggttgatattggaaaaattacttcactcctctgaacttgaattaattaatcaataagatgatattccaggagttcccttccagtggcaaaattctatcattaactatggggtaccttttgcttctatcaaattaacaaaacttacagagtttggaacggaggatgggggggatgcataaccctttctaaggttcataaaattcatactctcatttacagcctgggtgggcagaacagaatggagaactgctataaattagtataactctttacaaggaaaatttggtaaaatacatccagaacatgagactcaaacagtggttcaaagttggcaatctctaattttcagaatggcaaagttccaatgcccatttagttaagttgtttaacatagttatcttatatgtagttgtctgaaagggtgttacgagaattaaattaaattcaggtaaaggcctgccccactaacaacctggcccttggtaagtactgaaaacatgtaagttatcatttttattttgtttttacccaataaccccactcctgggatttatctctaagaaatcattataagaaaaaacaaaggtacttgataatttgtggtatcattgattgtaatcagaaaaaaataactgaaaaaaacctaaatgttcaacaactgaaaagtggtagtaaacctgatagagaattaagaagccattaaagtaattactataaagagtcgacaatattgtgggaaaatatgaatgatatagtactaactgaggaaagcatgatccaaattgcctgtacattatgattttaactatataaaatgtacatacttgtatataaaggcaagaaaagatggaaaactgtagtcaatatttgaataaactgaataatgtttctcctttaatttttttcaagattagcatggtattgttaaataatgcattgtaaaacaaataagtaaataaaaacgaacgaacaaatgaaacaaaacaaaagacaaaacccttccaggtaaaggataacattaataactgctagttttaactcccttggggttgtaaaaggggcaccaagcccagggcatcctactagctaggtggagccttacacataccgatactgtgcacacaggatgattagaggatatgcttttgacatggctattttagtgacaggactagattgtaaacatttctgatcactccatcaaagtatttactccaaatatcaattgaactcttaactaataaaaatatagtaactttcttattgcaatttgaccatataaatgcacttgtatacatggagcacatatcttattttaattttattgtcactatattttctgataggtactttaaaatttatgaatatcagaacaatctcctgttttataaaacctgctcccttcaaaattttcagacatagcttctattgatctaggttctagggtacattcaaagagtttctatttctcagaattttccccaaaatgtcctttacatttccccaaaatgtaaagaaccatatccaaatagtaccaatatccagtaaaaaccatttgaatagcaagtcatcaaaacttcaaaatgatccaattagcataaaagggttaagaataaactgattaaataattcaaaccatatattaaataattcaaaccataggttgacctgaaagcccatagatgtggaacatttatttctaatttactcatggaatgtaatgaaattacattaccacttgttaaatcttagcaatttaacagttatattattattattatttttaagtagagacagtatctctctgtgtgacccaggctggaatacagcagcatgatcatggctccctgtaacatggaactcgtggagtcaagcaatcttcccacctcagcctctggagtagctaggactattaggcatgtaccaccatgcaccactaatttttattttctattttttcacagagacagggtctcactgtgttgcccaagctgatcttgaactcctggcctcaagtgatcctcccagctcggcccctcaaagcattgagattacaggcatgagccaccacacctggataacagttaaattctgtattttattttattttactgacaggctcttgctctgttgcccaggctggagtgcagtggcatgatcttggctcactgcaacctccacctccctggctcaggtgatcttcccacctcaagcctcctgagtagctgggaatacacacgtgtgccaccacaactggctaacttttgtatttttagtagtgatggggtttcatcatgttgcccaggctggactcgaactcctgggctcaagtgatctgcccacctcagcctcctaaagtgctgggatcacaggtgtgagccactgtgcctggccagttacattcttaaactgagagtatggggacattatgtatactttgagtatctggttagaggtctttcagacacaaaactggggatggaaaacatttaaaaagattagcaaaaagtgaaaaatctcaaaattaagtgaaagggggaaaaaagaaaaatttacactatatgttataagagatacctcaggattaggtggaccatatctctgttgcattatccgaatcttcagttatcaaagctcaagacttagtatgactaccaaagccctatcatgatcccagagatttctaaatgagctttagaataaatttgaataaatattctttaatttatcctgacaccaccaagtccaccttctacttaactcagcaaatatttgttgagtgcttatcatgttcaagacatgggagtaagcaaaagaaataaatccagaaatgaacaaatgtaaacctttcccaatctacgaactctcagatgtttcctaagcagaactctctattatcctttatagatctctttaggaacaaaaaagatgctcacaactgggccagtggcttttctactgagttgaatttcattctcaacttccaaaaaccacaagctaattcatcaacaagttaactgtctgacaagtaaaataaattgccttatgacaagtctctcacttcccctgaatgattttaattatccctgcagccaagaattgtgactaacttctgtgacagaagtgaggagtacattgtttaaaaagctattaacattgtggtttttttcttgtttttgttttcttttcccccagcattaaacctttgtagagctgtcctctgtcctggagcagggaacaggagggcagctaactggggtacctacaaatgccatacactggtctgagtgctttaggtacattatctcatttaattcttgtaaacagtactatgaggtaggtatcattatcaatttcatttatttttcatttttatttttaattttatttatttatttatttatttttgagatggagtttcgctcttgttgcccaggctggagtgcaatggtgtgatttcagctcactgcaacctccacctcccaggttcaagcggttctcctgcctcatcttcccgagcagctgggattacaggcatgcactaccacacctggctaattttgtatttttagtagagacagggtttctccatgttggtcaggctggtctcgaactcccgatctcagatgatatggccgcctcagcctcccaaagtgttgggattacaggcgttgagccaccatgcctagccatcactttcatttttagaataaggctaaaaaggctaactaactggtacacagtaacaaagccagtaaacatatccctttttcctaaagataaaagagtatgcattctgtgttaacatctgcatttatagattcaaattataagaaagtcatgggctaggagatcaaatattaaaagaaaatgcctgaactccatttctagatagatagcaaattagataccctgaacactacttgacctgcattaaaaaaattctgaataaaacataaaaatatcttgtaaaatgcattagtgagctggtaagaaagtaaggaaagccaaagagggtacaaactagggaatccagcaagaaaagtaagcactaaagccaaaagtcctgggaacatctctaactgcctggagaccctgagtggtatttgacattgctgtaaggactgaagacaaagtctagagcttcacaaggcaagaagtcagacagaggatccctatataaagccaggacctcaaagggctataccataatgaagtggtaaactagaaaaaaaaaaaataggcagtaaagaaaaaaaaattccataaaaagtggcaacagtgaaaactgcctctcttgactttggcaagaaatggacagatggaaagaaaataactattttctgaaaacatatgccacagattggccttcacataaatatagaacctaaattcacactagtggtataactggaaaaatcataatcttattatttattcttaagtggtcatagattgctggtgcccaaaagcacctggcaaaacaacactcaaataatctttgaagaaaacaatccttcagttcaggactgaaaaaatcatctccaaataagtaacaacagaaaacaaggcaccatgagcaagaaatagcaagtacaacagcagatattagaattggaccccagaatatttcagatattgaaattatcaggtacagaatatgacaaacatgttttctatgtttaatgatataataagggatactttaaacactgaaataatgaggcaaaatttaaaatgaatcaaacagaacttccagaagtgaaaaatgttaccatttaaagttcaataaaagattaaacagaatgggaaagcaaaagttcagtaaaaggttaaacagaatgggaaagcaaaatttcagacaattaatgacatggaagatagagctaaagaaattacctaaaaacatgcatagaaagtcaaagatatagaaaatatgaaagagaaactgaaagacaatgaggttagactgaaaaggttcaacatatgtccaaacaaaatttcagagaaaataatgaacaatcagggtaggagacaatatttaaaagatataactaagaattttccagaattgatgaaaacgtgaattttcagattgaggaataacaatgttgccaagaaagataaagaaaaagacatctccaccaagacatagtgaaaatacaaaacatcaaagacatgatcttaaaagcagccagagagaaaagaaaaatggtatacacaggaagagttacattaacatctgacctctcagaagcaacaatggatgccaaaagatagtgaaataatacctgaaagtgatgagaaaacaaataaccatcaacctggaattgtatacaagttgtatacaaaccaaaacgatttttcaaaaatgagagtgaaacaaagacatctgaagtttaaaaaaaatttaggagtgtttaccataccatactctcagaccatcacagtttctgagagtaaacactgaaattaggattacaaaaaaaatcaattagaaaaacccatacgtatagaaattaaaaacacacttctatacagctgatcatacatatgattttttcaggtaagaaaaaaatagcatatagaaaatacagagagttgaacaataacaaaaaatactgcttctcaaaataggcccaatcttttaaattcattgcctaagatatagttagccagagtttctatgatcacagtagaataaattttcttacagccacagagtccatgtagctgaaaattgaatgcagaatccaattctgtgtgtattttaattatttcacctcatcaggtctctgtgtaaaggtaatcacattcattgagaaagtttaggaagattcagataattctaagtactctgatcttcaaaacagtactcttgtctactctgtcaaccaaaggaacttcaccccaatgtttgagaagcctatttctgccttacttaaaaactcatgcacatgtatgtttattgcggcactattcacaatagcaaagacttggaaccaacccaaatgtctaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacactgcatgttctcactcatagatgggaattgaacaatgagaacacatggacacaggaaggggaacatcacactctggggactgttgtggggtggggggaggggggagggatagccttaggagatatgcctaatgctaaatgacgagttaatgggtacagcacaccagcatggcacatgtatacatatgtaactaacctgcacattgtgcacatgtaccctaaaacttaaagtataataataattaaaaaaaagaaaaaaaaaacctcatctatagtatctcctctaaagtagttcccttgcaacgagataccatttttctcatgtttcatctaaatatctcattgcctacagttgatcctagtatatttccaggtggcgaattgcaaagtcaaacccaggaggaaaatgcttgcatggtaaaagattggctaattatacattggtggaaactatttagggggaaatttggagggagctagaccagtgagagagaaaaatacttttagaaccagctaatttgtggctacaggtgaatttaccagagattctatattcaacacagtagacagtgcaacagggagtagttctaatcatatggttggttggttgtctgaaacctggacaaaatggtgatgaagaaaaaacatggtttaagagaaatttttagcattaaaatgcatgtattagaaaacagaaaaacacctaaaatcaataacatggtttcacattaggaaactagagaaagaaaagcaatttaagcctaaagtaagcagaagaaaaagaattaataaaaattagagcaggaatgaatgaaattgaaattaagaaagcaacagggaaaaacaatggaactaaaaccatcagtaactgataaacttctagccaggctaaccaagaaataaagagagccaacacaaattaccagtctgatccaattgatattaaaaggataataatggaatgctagataaaactctgtgaccacaaatttggtaacttatatgaaatggatcaattcctcagaagacacaaattaacaactcacacaaggagaaataggtaatctgaataggccaatatctattaaagaagttgaattaataatgacattctaaaaaaagaaagcaccagattcacatggtgtcactgggacattctgccaaacatttaaggaagaaatgctacaaccttggatggagctggaggccgttactctaagtgaagtaactcaggtatggaaaaccaaatgttgtatgttctcacttataagtgggagctaagctatgaggatgcaaaggcataagaattatataatggactttggggacttgaagggaagggtgggattagggtgagggataaaaaactatttattgagtacagtgtacaccgcttgggtgataggtgcaccaaaatctcagaaatctccactaaagaagttattcgtgtaaccaaaaaccaactgttgcccaaaaactattgaaataaaatagaaaaataaagtttatatggaaaagcaaaagatctagaatagccaacacaatactgaagaacagcattggaagactcacactatccatttcaaagactacaataaaacagcataaggctacattaatcaagaccaataaaatgacagtaatcaagacaccatgacatacacattaatagaacagagtagagagtccagaaaatgacatacaaataaagtcaactgatctttaataaaccggcaaaggcaattcaagggagaaaggatatctttcaaaaaaatggtatggaaacaatgggacatccatatgcaataaaaaacaaagctagattcagatctcatacccttcacaaaaattaactcaacatgtattatatatttgaatgtaaaatgcaaaacttctagataaaaacaggagaaaatggttgagaccttgggtttggtaatgagttttagataaaacaccaaaagcatgacccatgaaagaaaaaaaattgattagttagcctttattaaaattgaaaacttctgctcagcaaaagatatcattaatggaacgaaaagccacagactgggcaaaaaagattttcaaaatatatacctgataaaagacttatgccaaaaatataccaaagaactcttagaactcaacaatgaggaaaaaaacctcaacccaattaaaacgtaagcaaaagatatgaacagacaccgtatcaaagaagacatacagatggcaaataagcatatgaaaagatgctcagcctcatctgtcattaaggtattgcaaatcaaataaaaatagtactgccactaaaagacagtttggcagctatgttacaaagctaaacatagtcttaccttacaatccaacaatcacactcatagatattcacccaactgatttgaatgtttcagtccacaaagaaaccctacatgtgaatgttacagcatctttatttataattgccccaaattggaagtaaccaagataaccttcaataggtgaatgtataaacaaatatggtacatcataaagtggaatctcatttagtgataaaaggaaagaaattatcaagccacaaagacatggattaatcttaaacgcatactaagtaaaagaaactagtacatgaaaagggtatggtacggtatgattccaaatatatgacattctggaaaaggcaaaatatcaagatagtaaaaagatcagtgtttctaggggctcagaggaaggaagggatggttgaatagacagtagagattttttttagggtgatgaaactattctgtatattatagcagtaggtacatgacacaatccatttgacaaaaaaataaaacagcacacaaaagtgaaccttaacgtatgcaaattatagaaaactatttaggagatcagaggattccaagatggactgcagaatgtaacaatacaatccaactggtgtaaagatcaacagatagacacatggaaaacaatagagtccagaaataaacaaaacttatttggaaaactgattttgacaaaagtgcaaaggcaattcagtggagaaagaatagtttgctcaacaaattgtgctggaacatatgtccatgtataaaacagcaaactttgatccataactctaaacataagaaaaagataaaaatggataatacacctaaatgcaaaacataaaactccaaaagtatacaaaaactacaggaaaaactttgtgccttggcttagataaattttttctgcaaagggcaaaaaagtaaatatttcagattttgtgtgccatgtggtcttcgttccagcaattctgtgtgcttttgtagcttgaaagcaattgcaaacgacatgtaaacaagaatacatggctgtgatccaaaataactttattgcccaaaacaggcagcaggccagatttgacccatgggctctagatagaacaacaaaagcatagtctattttaaaaatcgataaatttgacttcattaaaattgaagcatttgcttgttgaaagacacaatcaagagaatgaaataacaagtaacacaaagggagaaaaatatttacaaaccatatatctgataaaggacttgtatccagatgatataaacaacccttaaaactcaataatatgaaaacaaacagccaaattttaaaatgggcaaaagatttgaacctatacttcaccaaaggaatatagatggcaaataagcccatgaaaaaaatgttcaacattataaattattaggaaaatgtaaattaaaaccagaatgaaggactactgcacacctattaaaatggctaaaaataaaagactgacaatagcaagttttggtgaggaggtagaggaatgaaaattcttagacattgctgatggaaatgtaaaatggtaccatcacttgaaaaatattttggcagtgtcttttttttttttttttttttttgagtttcgtttgtttgtttgctgttgagacaaacatgctgttgcccaggccggagtgcagtggcgcgatcttggctcactgcaacttctgcctcctgggttcaagcaattctcatgcctcagcttcccgagtagctgggattacaggtgtgcatcaccacgcccagctaattttgtatttttagtagagacagggtttcttcatgttggccaggctggtctcaaactcctggtattctggcagtttcttacaaagttaaacatacacttgccaattgtgattcagccattctactcctaggtatttgaccaaaaggaataaaagcatatgtctacataaagacttgtacaagcatattcatagtagctttatctttaacaatcaaaagctagaaacaactcaaatgtccatcaataaatgaatttataagcaagctgtggtatagccatacaatggaacaccacttgtcaataaaaaggaacactacaacatggatgaatattaatataattgtacggagtaaaagaagccaaaacccagtacaaactgtaatattccatttatgtacagttcaagaaaatacaaactaatatatagtgattaaaagcaaatcagtgttacctgggacaaagtggaggaagggagggaaaagttggtaagaggcgtgagaaaactttgggggatgatggatatacagtacatgttcatacaaatgtatgaacattatgtatgatatggatatacagtacatgttagttatgcacgaacattatatatgatatgccaaaacttatcaaattgaacacttttaagtgcagcttattgtaatgtcaattatactccaacaaaactgttataaaaaatacataaagccagatacctgtacatgttcgtcaaagtagataaaatgtaaaatactaaatattgataatattaaatgttggtgaagatgtggaaaaatcaaatctctcatacattacttgaaggaatgtaaaatagtaccatcactttgcaaacacaatttggcaatttcttgaatttaccatacaacccatgaattccactcctagttatttactgaagagaaacaaacacatatgtacatataaaaatgtatacataaatactcatagcagttttattaatagtagctaaaaactggaaacaacccaaatgtccatcaacaggtatatgaataaagaaattgtggtatattcatacagtagaatactactcagcagtaaaaaggaatgagtgcttgatatgtgcaacaacatgaatgaatctcagagttactgtgctgagcaaagacctccagacacaaagatgacatacagaatgatttcatttatacgaaactctagaaaaaaacaatttaacctaaggtgacagaaagcagattagtgattgtttggggctggggatggaggaggtgttagccaaggaggagcacaacaacacttttggagcttgctgaaataccttatatcttgattttgatggcagttacatggttgtataaatttgttaaacatttacaatttgggtacattttattgtgtgttaattttatttcaatacagttgatttggaaaacaaagtgtcctccaagtgattctggtattagggaaatctctgagcaaatccaatctccaactgaatgcaaatacattttctacaacagtcacctagccctacctgaatatttcttatgtctgaagcttgctgctaaacagggctgccttgcccacttcttgacagctcggtcagaaaatctttccatgctgagtctaaataaacttccctctgatggccatatttggccaagttctgccctctggaactactctcatataatctttattgacagccttcaaatattaaaagctgcctatcttgcagacagtataacagagagagtttatataacatgtgctctgagaactgacaggcttagaatttaattctgaccacatcacttttgaatgattttaagcaagctacttaacctttgtaggcctatgtttcctcagctgttaaatattcataataatagcactatgaggattataaggattaaagaggtaatgcatgtaaagcagttaacataacgcctggcatatggcacatgctcaattataattaccagctctccttatctttctcacacaggctaatcaacaccaggtaccttagtctctaagactttaattccagagtgctcaacatctaggtttcctaaaaatgctataatttgttcatgtaatcacaactcatactgtcatccattatttttttcggcattaaagatgccttaggatctgaatccgtagtcacaaaatgctgacttaagaagtgttaattatttgaggcaaacaataaaggaaaaaggattagaagagatttagaataaagtatcagatgaagtagtacttgaatacagttttgcaaactaggaggtatatgaataaaggtgcatttgactgaagaaagaagtgagaatttaacttgtaatcttggctagactttccaaggtccaaactcatttgctacaggagtactttactacttgacatataaagtcctacttcatttaaatctatgtacaataagcatgagtttaaagcccaagatctcaggtaactttatcaccatgttaaggtgctgcctatagattatagcaacctcaatacctaaagtatgaatgacaatatgagtcaaagcatctaggctgatgctctgcttctcctttgattttggacaagttactcaccctctcaggatatcagttttcctctgtaaaatgggagggtgttgtctaatacctccacagtactttctaacttaaaaccctataagctgggttacacatgtgattgcatttagtgaacatatactgatttttggtgcatttaattgtatgcaaactttatgtgaaaattttaaaaccctacatacaaataataaattttagttaatgatatgcatgctaaaatgtttagggcttaagtgtaatgatttctgcaacttatgttaaaaggcaccaaaaataagacagattaatgggtggatagatggatagataggtgacaaatttcctcaaatgggtaaaccaggtgagatgacaattctactcctagatatacacacccaggagaattaaaaacatatgcccacacaaaaacttgaacacaatgcttatagcagtattattcataatagctaaaagagagaaataatctaaatgtccatcagcagcagaattgataaataagatgtgatatagtcatacaatggaatattattcagccataaaaagcaagtacttttacaagcaacaacatgaatgaaacttaacttcattatgctaaatgaatgaagacagtcaccaaagattacatattatattatttcatttatatgaaatgctcagaataagaaaaactatagagatagaaagtgggttagtggctgcctaggcctaggggagtggggatttggggagtgatggctagtgagtacaggtttcatttttggagtagtgaaaatgtaaaattgattgcaatataaatgcacaactttatgaatatattaaaagacattgaattgtacactttaaatggatgaattgtatggtatgtgaattatatctcaagaaagctatgttaaagataaaaaaataaaggcaaaaaatgtattcggtctctctgcagtttcttctctaccctatacctctttagtgctaagatcaagaagcggtctcactctctctctctcgtttcttgcttcagtggcactcgcaattttcttaaatattcctagaaaactgcatctcagattttcttttgaaattatattttacttttgttcttggactaaaataatttgtgatgctttcctgatttcattcattcactttatcaaatttatactgagtggttacattgtgtcagaaactctgttaaacgcctaaagtacaaagtcaaataagaccaggtgcctgccatcaaaaagtttacaatctagtaagggagacagatgtataaacacacagtaatatatcaattaagatgtactataattcaagcatgtaaaagtgctaagaacagattctgccactagatgtagagttagaaaatttggttaaatgaaataggcttagtagttttataatcttaagtcagtcatttaactactcaaagttccagtttttcaactgtgtaatggagaaaatgtcacccaactcactgggttattgtgataattaaatgtaaacatgtctacaaaagtattgtataaactacatagtatcactgtgtattatagtacactgtgatatatcgatattttagaaataatcattgatttgttaactttctttgtaaattagtgagaatagagttagtaatgtgctttaaaatctgagaaaaataattaatacaatatttttcctgtaactgagaataacagatggaattttaatagtttttgggggaaaaaaaggaaacagcttgaaatgtaatgaagaagatgaagaataacatggaagaagggctataatggttggaagagacaaaggccaaccagatagtaagcttgacaagaacacaggcatggtagaaaacatggtgcagaaggcagggctttgaagatgaagagaaatcttatttagtaagtacaaccttgccatatatccttattaatcacataaattttcttttaaaaaggtgaaagtgagggtaattcagtgagcacaatatcttctcccagaataatttaaatacaaagttctactatggttccagtttctcacaaattaggacctaagcatctacatacatagggataaaaacagtctgttttctgattgatttaatgtttgcttgtctgtagaatggtggcttctggtaaaaactgtgaattatctccatatttcctatgcctctccaatcctttaaaaaacaatggaagaaattataagctaaagaacaagtaatcacagatccatataaagtcaagaaaaaaataatggtaaaagtaaaatcaccctacaatacaaattgtctggacaaacaatttaaaatataatctgaaatgacatactcagtgtaatataccagagtgaatagtactacttgacatttaatatttcagtgttctgactcttctgtgtaaacatttctatcttaatgacataaaaatgtaaagtattttcaaaaagtctttaacatttaataccttatcgccagctcttacatacatgggcataataagagacaggaggaaaatagagaacacagaaaacattcatcacatatatgggctaaatgcttgtatttatccctatatacttttatacgattactaacaagtacttcttctttttttttttattatactttaagttttagggtacatgtgcacattgtgcagtttagttacatatgtatacatgtgccatgctggtgtgctgcaccccctaactcatcatctagcattaggtatatctcccaatgctatccctcccccctcccccgaccccaccacagtccccagagtgtgatattccccttcctgtgtccatgtgatctcattgttcaattcccacccatgagtgagaatatactaacaagtacttctaattggagcacagaaactgacagatgagagttggggtgagaggtggggggaacaaactaaacttaggaaaagggagacattttatttagtaacctagaaaaatacttacatgttcaggatccagtgacttctattcattcagcctataggtatggatatacccatggcatttcagtgacccctgctcccagaccagcattaaacacaactggttataaaatttttctcaataaattgctataaatagctccaatattatattatttaataaaggcaggaaagtactaggttgagagttaactggccctggattgaaaattccttcattatgttcagatgcaccctttatcattttagagactaaaccacaaggacacaaactgaagaaagaattggaaactaaaagaatgatattcactagagacaatggaacacaatgcccttcagggtcagggacaacatctgcacaaaacaagctgtagtggatgtatgttgcacccaccagatctcccttcaggattgaagaacttagtctcctggctgctgggagtgttgccagctgacaaccctctctaggaattgtccttagctgaaaagagtcatcttttccaaggtcttgctgcctgcatccaatgattggtcaatgtgagagtctgaaggtctgatcctctcatctccaatctgaaaggccatcccagctccagagcttcaggctcactgagtccttgtttaggaggcatcacagaccaatgtcttcctctgcccaattctgctttcttccctttccccaaaagtgttgattctgaagaacaatttccccccaaaattcccttcatgccaatctccatctcagaatctgctttcttggaaacccaaccagcaagccaagaagatgttgaactactgccatggagtttcattgtgaagaaaccatgatattaggaacatcacacatctctaggtaatccaggacactaagtaatagatcaggttcttgcttggtatggtgatcaactaaataagccacagaaaatctggagaggagacagaggtgccaaaggaacattagaggaaaggttaaaggaatttgaaatatttattttagagacaaatgatagggtgaaaatcaacagtacaaaaacagacagtaaaatttaggttagatttaagaaatgttttccaataattaaaaatgctagaataggctgggtgcagtggctcacgcctgtaatcccagcattttgggaggctgaggagggcagatcatgaggtcaagagatcgagaccattctggtcaacttggttaaaccccgtctctgctaaaagtgcaaaacttagccgggcgtggtggcacgcaccagtagtcccagctacttgggaggctgaggcaggagaatcacgtgaacctgggagacagaggttgcagtgagccgagattgtgccactgcactccagcctggtgacagactgaaactctgtctcaaaaaaaaaaaaaaatgctagaatagtagaccaacttagtaatgaagggcatttattcatttactattatgccaataacaatgatttgagtttactctatgttgggaactaggcacgcacgtaatcttatttaaattcctcacaacaattctgtgaggaagtccaattattatgcccattttatagacaaagaaattaaggcttacaaagttaaagtaacttgtctgagctactgcctcttcatgtatactgttagaatccgagaagatgaaaaggcctgcttacttttcctaaatccagagagaaactgactagttgatatggacaaattatagagtctttttggggcctctgttgctatccgtgtcaaatatagttttaaatggccagcaaggtaagtaatcaatatatgaaatcttaaggaggaagtatgcctccatgtacgttcataggctgggtgcagcagcatgtgcctatagacttagctactgaagaggctgaagcaggaggattgcttgagcctaggagtttgatgccagcctaggcaacatagtgagacctgctctctaattaaaaaaacaaaacaaaacaatacacacagttttctttcttcagcttaacaatagtcactgtaattcttctgacaaggcatggtctaaaatcaggaccttattccacatgaacataccacaagggcaataggaaaacaggataaataggaggcatgatggtatagtagactttgatgggagacagatctggatttaaatcctgatcttgctacttaactagcatttgtggtcttggattaattatctgaacctcactttccttattgagtcaatctggataaaaacactactcctgctttccagggttgctaggataattacatgagatatggtataaaagtataaaaagcagggtctggcatatggtagatattcaacaaactataatttcctttcacttcctgtatcccccaaaaccatttagtatatattgaaaatctctttcaccattgtagttaagcttatttgataaaaatcagtctattttgtgaataaaaagttaccctaaaagtgctcagaacactcattatcaagttccaagagatgcaaaacatacccaagataccaaagtgaaagcataagactgatgagtgacttgggaagtccaagtatctccatacaactgtaatcaataatagttactgtgctaggcactattctaagctctttacctgcagtaagttgttaattagtcacaataatcatataaggtaggtagataaggaaaccaagacccaaagaagttaagcaaaatgtgaaataacaaagaaccactcaagtcactctcacacagagctggtgccacattttgaaaaacaacttgtcatgattacatcaagagcttcaaaaatagttagaatatttactaatataaaaatattcctaaaatattagatgatccatagtagatataagatggtatatggaggctgggcgcagtggctcacgcctgttatcccagcactttgtgaggctgaggcgggtggatcacctgaggtcaggagttcaagaccagcctgaccaacatggagaaaccccatctttactaaaaatacaaaattagccgggcatggtggtgcatgcctgtaatcccagctacttgggaggctgatgcaggagaatcacttgaatccgggaggtggaggttgtggtgagccgagatcgtgccgttgcactccagcccaggcaacaagagcgtagctccatctcaaaaaaaaaaaaaaaaaaaaaaaaaagatggtatatggaaagtaattgtgatttgcttaatattccatatatttatataaaggggctaaagggaaatatatcagcatactaacaagggttatttctgggagacagaattgtgggtaatatgcttaaaaaacaatgctatttattcctccaagccatttcattttcctcctgtcacagaaagacacattcctgccttaaacaccctctcccctatagctttgtcactcccctggccatgtaactgaattcaggtgatagaatgtgggtgggaatggtatagggcaactccaggcccgaatctatgtgtggtcttccacgttttcctttcctcctgtcagtcagttatgccatcaaggtaactttgaggcaacaaaatggtggagccacaaacagaaatatcctgggttcctgacgcttgaaagacagtcacacaggaaaggccttatctgcatttctctgagagagaaataaactactaatgtattatgctactgacatttcagggtttgttacctcagtaactgataaggtaatttctgtaattttccttattcttttcctgtattttccaaaatgccaataaggaacatgtaatagttccacaactggtattcaaaaaagttttttttttttttggccggatacagtggctcatgcctctaatcccagcactttgggaggtcgaagcgggtgaatccagaggtcaggagttcaagactagtctggccaacatggtgaaaccctgtctctactaaagatagaaaaaattagctgggcgtggtggtgggcgcctgtaatcccagctactcgggaggctgaggcagaagaatcgcttgaactcaggaggtggaggttgcagtgagccgagatcgcgccactgcacccagcctgggcgacagagtgaggctccgtctcaaaatttaaaaaaaaaaaaaatgaaaaaaaaagtttggttttttttaatgcatgacttttaactcagtaatttcagtttgggaaatttagcctaagccaataaactgaaatgcaggtaaaaacttacacatcaaagtgtttattataaggttacttataaaactttaaaaaaataaacaacttaaatgccattcacacacataaaagtttagtaaactatactcgtgatggaatattaggcaaccattaaaattattttaatgaaaactctgatgacacaaaaaccaagattaaaagttgttcaaatatggaaaaaactgttaacagagatgtaagctttctctgcatgattacttaatactcatctatactttatagtattttccaagttttctgaaaggagaccataatgctattataagaagaaaaaaagtgttcataaaaataatagctaactgtgctgtgataaaggcaccagcagtatcattgatgcaatggtgctactgggaagggcacttacagaccatctgcttaccttccccaagcacagaggaaagagactgacagttgtgagggaggggctagtacttctggtgcccagggtggagataaggcactaagacagagctgctttgttagataaagctctctctggtcagacacccttgctgccctcagtatagcatcagactcaagaaggtttatgagtcaccagtaaagagaaatttcaactgaagggaataaagaagccagtgctagaagtttgacaaatcagcaaaagggcacatagggaacttaaagggctgccagcaatgttccatttcttgatggttacatggtttcatttgttgaactgtgcatatgttttatgtatttttcagtttgtatgctatattaaataacaaaatatgtatttttaaattcagcagcagcatcttcctaaatgagacagaagaaggctttagaggcagaacaagaaggaacaatgctcagtgcaggcctgagaacgggcccagaggaacagtaatctctcagtgtcaacgtattgctttgtagcttacaaagtgtttctacatcacatactgcatttaaggctcagcattactcagaatagagatcttgaactcatgtcggctgatcatatccagttgttttccactataccaaattcaacacaaaatacatttgtggattgaaaaaaaatttttaaggtattaaggcatgagtgctcacagacttcctctaagatcttgcttaactaaaaggaattgaggttttgcctacccagcttcactggccaccctctatctgaggaaatttctatctccaccagaaaatgttgagactttctgatgaagaacataaaaaatcagaatagaaaaacagaattgagccagaagaaaagcaagaagagaggttagtcaagaaagaggaaagggaagaaggagaaactatcagacatcaatgagaaacaagtctgttgggcatagaagtagtttagagggtaaaagacctcaacaaatgtggctgtagtcttgggattgtatttctttgagcaagacatgatgtgattccaaattttctaggggcagcacattaattggagtcaacttccagattgtttgttaggagctgcaggagataagtacaaagaataatactggactcctgcctgtaaggggttcacaggcttctgagggggaatagatacataaatgattaaggctccttgcatgtgtaatggaagtgcagagattagagttactaattctgcttgggaaagctgtgggaaagcctcacaaagaaaggaacactggagctgggtgtaggaaaatgaataggagctcacagaccaaagagggcaggtatggagtgtgttctaggtaactgaaatagcacagagacattaagcattcacataataccaccacatttggtgcagctgaaacataaggagctgaggtagagggataggaaatgggcaggagagtaatcagagatgaggtaggggtccagctataacccggttgaaacaagccaagaaggctagacttcattgtttaggcattgagtagggggacatactgatgtttgtatatttcagtattaacacagtagtactgcaaaaaaggatcactggaaagaaatagcaatgagataacggtggggatgggggcaagaaaattaggaggctgttgcaaatagaacaggcagcaaatgaaggagttttagaatcgatggatatgggtttaaaacctggcttttgtcacaagttatttgaccttgagaaactaaacaatctcctcatacctgtttcctcttccataaaataaaaataatattatccttgcagaattgttacgataattaaatatgataatgtgtcttgtagtatctggctacatattaagtgataaatattagtaacatatgcattggtagtagagtggcattgaggataaggagacagattcaagaggtatttatgagataattaccatcaacaggatttggggactaattggatgtttattttgggaaaaatgcagagagtggaaaaaatcctatatttagcaactactttgttctctgcaacaaagacatttaataccaacacactgaattgctaacatctatcgctgctagacaccatgcctagtagaacagaatcttccagcaatgtcatttggtgtgaatgtaggtctctcttctttcttatatttcttctacttcattggctaaagattctccattcaggttcctcaagaaagtaaaaattgaactgtcatatgatccagcaatcccactgctgggcatatacccaaaagaaaggaaatcagtatatcaaagagctatctgcactcccatgcctgttgcagcactgttcacaatagctaagatttggaagcaatctaattgtccatcagcagaagaatggataaagaaaatgtggtacatatacacaatggagtactattcagacataaaaagaatgagagggtcatttgcaaaaaccggaagtcattatgctaaatgaaataagccagacacagaaagacaaacatcacatgtcctcacttatttgtgggatccaaaagttaaaacaattgaactctcagagatagagaagaaggatgattaccagaggctaggaagaatagtagccggggcagtgaggaggtggggatggttaatgggtacaaaaaaaaaatagttagaaagaattaataagacctactatttgatagcacaacaggaggactatagtcaataataatttaattgtacacttaaaattaagtaaaattagattgtttgaatcacaacggataaatgcttgagggaatggataccctattttccattatgtgattattacgcattgcatgcctatacctaagtatctcatgtaccccataaatatatatacctgctatgtaggcacaaaaataaaaaataaaataaataaaatacataactttaaaaaattctccattcaaatatttcaaattttcaaaataaatatattcaaaaattgtatcaggtaatttagatccaaggtagagttgttatctaattagcaacaacatcaattgcaaatgttaaaagaactccatatacttgtagtgaaacctccagtagccaataaagaagtcccgcaaccaaactggagatgattaaagtcactgttcctgcaacttgggtattgtacatattgaaagtcaatcaacactttatttatctgctttaatagaactgttgagatcgattacaggacacaaatcacttataaactattttcttatagtgaagtaagttgtgtgtaaatctctattatctcttacggcatattcagttactgcacaatggaggtgaagcagggcccaataatagttgaaaaaagaattgatcttagagaagattcacatattcctaacttttgggctccttccgaaagcccagataacaccactcaaaagacacttcatttttgaggaaaaaatggcctaaaagctaccaaaatgagcagcccaaatgccactgaaaatccccaaggatgcagaccactgactgcctgcccatcatggcttggagatgcctgaattagagcaataaaatgaaattaaagctctcactgagatcatctgctgtagagcttcaaaaaatttaaaagcagatttcttgaaagggaaacatttaagaacttaaaaggaaggggaagattccttaataaaagcaaaatatcctactaaatgactggtggagcttaaatccacaaataattgtggtaacaaagtaaagcactcatacgctttttctctttcccatataatcactgaggaaaatgaaattttagaaggtgaaaatggaggatttagtactattccttcaacaaaaataagaggttgatatggtttggctgtgcccccacccaaatctcatcttgaattgtaactcccacaattcccacatatcgtgggagggacccagtgggaggtgaatgaattatggggacaggtctttcctgtgctgttcttgtgatagtgaatgggtctcatgagatctgatggttctataagggggagtttccctgcacaagctctcattttttttgcctgccaccatccacgtaaaaatgtgacttgctcctccttgctttccaccatgattgtgaggcttccccagccaggtggaactgtacgttcaatgaaacctctttcttttgtaaattagtcagcctcgggtatgtctttattagcagtgtgaaaatggactaatacagaggtaaaataaaaaacactatgaatttctcaaatcctcacaatttagtatccgttggggcattttcttgctggaaggaactataaaataaaaattaagattgctccaatatgctgcataaaggccaaatagcaaacacttcttaatccagggcaactgtacttggtaacttgatgtaacatcagctgcatgtctgatctagtatgttcttacatatagaataaatgtttaataagaaaggttacccagatcccaataaatatgtacaattcttatatgtcaatttaaaaaataaaattataaaagaaaagttacccaggtcctatgaaaaaccaccctagtataagctgataaatctgaaccatggcagcattaagatacctgtcctctaatactaaagggcaaagggaaaatagaagatggatatccatctgttaccaaactgaagccaatttggtgagcttcaccccaacacccgactcctatgacaaagatcaatttaagaaaaatccattataaaactttccgaagataaagcaatatacaaaagtatacacacaggataatctcaaccatttagaaagtcatatgcactgaaaaaaaaaaccactggaaggaaatatgccaaatcattgactgcttttgtctttgatgatataattatttttcttctatatacttatataacctcgataaactttgatgtaattttatattgttctacagttttctaaattttccttttttttttttttgagatggagtctcacactgttgcccaaactggagtgcagtggtgtgatctctgctcactgcaagctccacatcccaggttcatgccattctcctgcctcagcgtcccgagtagctaagactacaggcacccaccaccatgcccggctaattttttgtatttttaatagagacggggtttcactgtgttagccaggatggtcttgatctcctgacctcctgatctgcctgcctctgcctcccaaagtgctgggattataggtgtgagccaccgcgcccagcccaattttccatttttttacaataagcaagcaagaaaataaatgttaaaagaaaaatgagagggagggaaaaatttacttataaataaatgcttctagaatctttagaacaccatcatctattctgaaagatagaatcatcaaaactctgtactcacgctttaacaacataaccaaaagcctaacacttcacatgccccagtctctggtcttttctgtgcttgcttttcctctgtgaaaacttgataaaatgctctcaataatcttgttccatgaaaagtgtgaatgagaagaaaaataaagagagcaattttcaagtgggaaaagaaagagcatgcggaaaggaatgactgaaactttcagagaaatgggtagaaatgcatataaaactccaaatgagatacaatagaagctgggcttaccaatggggaggagagtatggaaagagtgcaatggacaggagagggtagtgtacaaagaaaggatagaaggaaacacaaactttgtatgacttttttttccacataggattcacaacattcctcagaaaattcaatttagttgccctgttctagcttgctaaccagaaccaatttaattttaaatctacactcagagccaacggggatgagatattttgcaattctttttagctccctgttggaagacagaatcagatttaaccatttctgctctggctgtgataaccatccaggtttgtcagaggaccaaatggtgttctttgaagattaaagaatataaaactgtaccaaaattacttgctatgtttaacaacttaatgggaatgcatttttgaggatgtgacaaattgctcttgatttatctgcacagggcatgaaatactggtacaagagagcaatttgttacacagacaatgtctaccccttgctgtaaatttgcccactgtcacatactatttgacatccagttaggtgattttaaaaaactagtttattactgcatctaatgaagagcagaaaactgatatatgactctcttaattcttctcagctaccaggaacacatttctcacatatcagtttatgaaactgtttcttggttttatgttctgttgtgacagataggtaaacaagctgataaaatcaagtgctttcaaaagggaaaagttaccatattcatgtaggcctctggcttgtcacaaaacttcaaacagtttctggttctgcttaccatctgcacagatttattccaaagaacataacaaactttgtttcttgatttctttcaacataaatagaaatattaagtttgggtgtttatattctggaagatagtcagataatctattctgattaaccttaacacataggtctggcccctgcctgtatacatagctcagtcccagtcccttcctctgaatttccttttaatcagcctcagccttttccacatccatattgctatgaatatctctagagcatctatcttcagaaccatttgtttaccatgcctcctactgggaggaaatgaggctgctattggtctgactgaagttccccttaggctatatgtggtctgtctttattaaaagcaaaataaaggcctcacatggggacttggcaactattacaagggttgtgctgggtttttcgattcttgcttttttgttgggggtgtatgaaaggaatcaacagatccatccaagactattttatcattgtcaacttacatgcagaccaccctgacacccccactcactattagtctgttgaaaatgggaagaatttgagagggaaacactaacatttttaatagaaacaattcttatagccaaataagaactaagctacaaaggttctaattatacattaggtattcaataaacataatggtgattccagaattgtattttgtatgccatcatctaatttataagttggcatcatcagattcaaacactgagtggaaaaaaactcagcaatataaattatataagcaatcatcacgtgagtgggtggaaatgattctgaaacagataattctgaaatcaatcctgaaataggactatttgaaaggattaacttctgccttaaaatcctagctctacaacttaacttctctgagcatccaattcttcacctttaaaaggaaaatagtattttctctctcagagagctgttctgacatttaagtcacccagtttggtgcctgaatgaggactcaataaatggtacctacccttattattattatttttctcatggattgttttcacttaccactgtaagctgaacgatgaatgaataaataggtgagtgaaagtgaatgaatgaaggaacaaataaacgtttagtaacacttgtacaggagaaactggtaggcatccagcaaggaagtttcatttcttttctgttagtctttctgatggcaatgcctgtagggaattttaatgaagagccagcatacatcattacagttttctacagatacaacacagtataattgttcaggtacaggttatacagaaattaaagtgataccagttcagggccatacttgcaagataactcaggccgtcaactcttgcctcttgcgtcatcacatttctgtacacatatgttatacacataaaatgtgttgacccagtagtgaggcaagtaaggcaactgctctcaagtaatgaaaatggagaagattaagataaaagcatcaacaataacaaatctatttactgaatatttaaactgagttttcttacagttccttaaatacattttcattttattcatttacatcccattacacaaacatttgttcattcaaccattgtggaagtcagtgtggcgattcctcagggatctagaactagaaataccatttgacccagccatcccattactgggtatatatccaaaggattataaatcatgctgctataaagacacatgcacacgtatgtttattgcggcactattcacaatagcaaagacttggaaccaacccaaatgtccaacaatgatagactggattaagaaaatgtggcacatatacaccacggaatactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacaatgagaacacatggacacaggatggggaacatcacactctggggactcttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaataaaaaacaaaaggacaattaataaaaaaaagactctgtagtacatattgtggagcaatacaaagaatgtaactcaattttggcatagttcaaccaatatttattgagtacctctcatgggccaagcattgtgctaggtgcaagggttgtaaagaaaaataagatacagcctggggccttaagaaaaaggcacaaataattaaaatataaaacatagagcctgcaattacagactgctaagagatttaatagtaatataaaagataaagtgatcaatgctgactagaaatcaagaaaaacttcaaactaaatacctgaccagatatttagtagcagtgtgtaaagtgaacaagtagagcacattctacacaaagaaacgagtatacacataagcagataatatgcagatgtgtaattggttccatagcactggactagaaagcatgaaggggagaatagaaggagatgaagttagcaaagtggacatagataaattcatgaaatgcctcatatgccatgctacggagcttggattattttttccttctaaatgctagtaagccattgaaggcctccaaaaatgtcagatttgggttggaaattatacagaaggcaaactaaaccgcgacaagattagaggtagggagaaaagataggaagctactaaaataacccaaggaagtgaggatgagggaactaagctaatctaacagtacaggaatagagagaatgaatacattttaaatatattcaagagataaaattaacaatcattttagattaatcaatattaatggaaaaataaaagtgaaaagtatgtacaagtgtgttctttctgctcatatcagaacagaaatctgaagcatttagaaaaaatattagataccaagtggcaaagttttaacaaattccagaaaaaataaaaataaaagtacagatagttggatatggtgtctggaaaagaaggaacgaagaggtttttatggaggatgctttgatactacagtatttacttttaggaaaaaaatatcactgaaatggaaagtcacttcttgtttcacttgacattagcagtaaattggaagaaagtactccagtgtggcaagacaatatgtaacggtggcagacatggaggtgcactgctcagatctcctgtcaagagaacctgctgctagaagcatagctgtctgatagtctccagctgctgtatgtttagatccattgcagtgttcactctgaggtcatgctccccacttccacaccttctgacccctatgctgctcccaggcaatgactaagcacagaaggcacagtcaagctaagccatcctttccctgtaatgtgggatttctataatggggaacttttgcttaaagacttctgttcccagcctggccaagactttctcagaactgcattacggactggggctcttcctgcccaattttctttctttcctctgctcctttcatagatatcagacctgcatcactggctgaaggctctccctgcctactcctgctctcttcccctttactcagcatggatatttctccaaataaaacttatgtgtctaactgcatcttggtgtctgctcctcaaaggaccttaactgacacaatactttaagtaaatgtattaagaatgaaaatcacagggaaatgtgaattcctcctcagagcatcttgcatgtaaaccaccctgacctcagggttttcttaagagtacacaacccagcccagtgtttaacagccctcactgtcagatattttactcctaaagacttacccacctcccttgggccatatgttccattctaacttccagaacatcttttactaacatttcatataattgaattaaattaaacttcccataaaaactggattgaactaaaaagagtgaaaactctattccataagaattttattttcaactaagtgaattctcagcttaaataatcatagtctgctctttgagctccaggggcacaagcaattcaggcagacaacatagtctcctctggagtacaacgttcatccaccttctcaggagaatttgcctttcctgctgcaaacagcttcgtccagctgccagtagaatatttggatgacattgccttagagtcaacacacaagaattctagtcaagggaggcagtctgacatcatagttaagtgtgcaggctctgtactcctacacacttgcatctaaatcctggttctactaggtgctcaaactaggtgacttcaggcatgtttccctctgcccctctctgatcctccattctctcatatgtaaactgaatataatactagtacctatctcatatgcttgttgttaggactaaatgggccaaggcagatgaagcatttagcacagtttctggcacatactgagcactcagtaattggaaattatgtatgtcattgttgttagtggaagcatctgctctgagaataaatggagttgtttatctacactgaagaaaccagtggccatataaaatgatctggcatttttcttttaactagaaagctgagaagctatgtacgtggccacacattaaggctcagccttcactcacagcagcaaagggaaagctggcctctttctgaattaggggtagacagctggagagggccaaaagagggattaccagaagattacgatggtcaggggaaagctgaaataactattttaacagacaatttgtgctccaattaccatctaaatgttcatggtaaataagaatccataaaaacacatctgtaaacccccaattttagtgactggagctttgcatggttcattagcacatactcctttgcccaactgtgacatcacttatcagcagaccttctcctttcatattccccagcagctgaggccagtgctccatgaggacattttctgaaatcaatgcagtcacagatttcttcccacaggtgcaggagaagcttattaggtgaatatctttcatggagttctgtcacctacactcttgtttctcttttaaagtaagggttagtaactataaataagtaggtgccaattcatggggagagactggtgtgctgcatgcaagtgattagctgtaaggaaagggctaagtctcagatctgcactctagacctgtgatgtccaacagaattacaatgtaagtcacaaatgcaagttacatttaaaattttaaattttctactaaccacaagaagaaaaaattaacagataaaatcagttttagttaatagaaatgatttaattaccaatatatctaaaacattcttttaacatgtaatcagtataaaattattaatgtgatttttaatattttatactgttttcaaaatcccatgtgtattttatacttgcagcacacctcaatttggacttgccacatttcaagtgctcagtatgtccatgtggagagtggttaccaaattggatagtgcccttcaggggagctggactgggaaatgacaaagttctataaaagaccaagacactgttatggatgtttgtcattttggggtacctagcatcttttgaacactctttctgtcctggggtagcttgcatattatgagtctcatttcatgaagatacgagggagaactcaatttctcagattccctttcagctaatgcattggaaggtaacgcatgcttgaccagtcagaaacaaccatatgagatttgaattgtaaacagaaaaaaatgaagaacatggccctgtatacgtggaattaattttctggcaaggctgatggtgaaggtatccagctttcatgggcaccaattggggtgatctgatatctagtactcagaatccataaatacatggtataatatacttcaagtatggccagcagcagagacagtaggggccttgctggcaccattccaaacaaacacggaaaaagaaaactaaaaaaactccacatgttaacttagtgccctggctttttaacttcttgttgtttctctttatgtcttattgtactgtctatgtcttgaaaagttgttgtagctgttatctttgattggttcatcgtttattctttctactttagtcaagataagtttatacatcacaactacaaagttatactattctgtgtttttctgtgtgcttactatggtaataatgagttttatatcttcagatgatatcttgttgctcaataacatcattttctttcagattgaagaactctctctagcctttcttataggataggtatggtattgaaatccctcaggttttatttgtctgagaatgtctttatttctccttcaggcttaaaggatattttctcaagatatactaatctaagataagagttttattctttcagcactttaaatatctcatgccactctctcctgacctgtaaggtttgcactgaaaagtctgctgccagacctattggagctccactgtgtgttgtttcttttctcttgctgcttttagaatctttctttatccttggccactgggagtttgattattaaatgccttggggtagtcttctttaggttaaatctgcctggtgttctataacttcttctacttgaatgttgatatctttctctaggtttgggaaattctctgatactatccctttgaataaactttctatccctatctctttctctacctcctctttaaagccaataactcttagatttgtccttttcaggctactttctaaatcttgtaggcatgcttcattcttttttattctttttcccttttgtctcctctgactgtgtattttcaaatagcctgtctctaggctcactaattctttcttctgcttgatcaattctgctattaagagactctgataaattcttcagcatgtcaactacagttttcaattctagaatttctgattgattctatttaattatttcaatctctttgttaaatttacctgataaaatattgaattccttctctgtgttatcttaagtttctttgagtttcgtcaaaacagctattttgaattctctgtctgaaacgtcatatatatctatctctctgggattgatccctggtacctcatttagttcatttggtgaagtaatgttttcctgaatgatgttggcacttgtagaagttctttggcatctgggcattaaagagttatgtatttattgtggtcttcacagtctgggcttatttgtgcctgtctttcttgggaaggttttctaggtattcaaagggacttgggccccaagcccaataatacggtgggttttgtacactcatagaggtactgctgtggtggttgtgggtaagatccagaagaatgctctggattaccaggcagaaacccttgttcttttcccttactttccccaaaacacatggagtctctctctctctgtgccgaaccacctggaactggggggtgtagtgatgcaatcacccctgtggccaccaccactgggactgtgctgggtcagacccaaagccagcacagcaatgggccttgcccaaggcccttcccgtcagggtagtgagttcttgtaggctccaggtgtgtccagagatgctgtctgggagccagaagttggagtcaaaaaccttagaaacttatgtgatgttctattctacggaagctaagttgagggaaaggaagtaaagtggagggaaaaataggaaggactttgcatggtactgaaccacaatacaaagtccctcctattcttccctcccctttccacaagatgtaagacaaagtaccctttaactttgatctcctctccttaaacggaaagaaacagtcacttccattgctacaagctgcaatcctgggtttgggggagggatgacttctctttactctcccatagctgtgccagctggtgtctccctaggtcatgttccactcctagttcactggcttgaagcccagcctagcactaggagttgcctaggaattgcagtctttgtgtcctagactgtctttcaagtttacctaggaccccagagcactttagccctaagtggtgaggtttgcacagaaactcaagtttggaccactgggatgggtgacccccctctggctagggctggtccagatgctcccattgtgcacaggcaatggctgagctcaatacagctttattctccactgtaacagggcagcactgagttcaatgtaaagtcgcccagcagctgtgctctccctccccaaagtgctcaagttctctctctgcactgcatggccactgctaggggatggaggtgaggtggtgtcagtgattctaaagtatctcttctgccctcctcaatgcctctgtcgttaaatccaagtactgtgaatatgacgttaaatccaagtactgtgattgcacacttgattgttggtttttgtgatggggcttttctgtgtacagatagttgttaagatttggtgttcaagccagagggacaaacagtgaaggcttctatcccaaccatcttgctccacctccctagatcttatttaaaccttttattttaattggcttttttttttttgacactgctctggcagggtataagtgagggcactgctttgtttctgccaggtggatgtcaaagtccaggttgcccattcagccttcattcacaccaaagggaggctcctcattattgctgagcaggtgggtaagttccacatctccagagtctcaactaatactgcagtgaagtgggagggtgttccctcaatatcaaccaatggggatgaagtgcaggctctctacttggacaccatcctggcaaggatgttgcaggagcacattagagtttcatgagggtaagtccaggctccctactcagcctttgtttgtgtgagaaataggacacaaattttttatgacatttggctagggtggagtggttattgtgtaaaacctttctgtcttgctagattggtcctttattgttctccttggctagagaaaactggcttttgttggggtcttttgtgtttgtattcattgagatttccaggtttccagcttcttcagcgccaagtttgggatattaaagacaagaagaaaacccagggaactcaccatcatgttgttccttgggttcttggctgacttcttttcaacctctgagtcttcttacatgttttttatatataatatttagagtttttagttacccttaataggaggaataggggaaagtatatttactctgtctttttggcagtagaagtaggtgtcattgccttttaaaatactgaatatacattctttattatctatatccccctggtagaaagtgaacctcaaaagggcatgctttttgtatggccatagtaacttattgaatgaatttataaagccacaaatgcgtgctattggaaaatacatcatttttaagttttattttttaaattggtgctgaaccagtgggaggaggtctgaaggtcaataggaatgaaggaaaggtctacataagaattacaagtaggagacaaaattaatattaaatataaccagatggtagtgaaacagaatttacagagctcaactgagggaaggtaatggtacaatacagctaggattacccactcttggaaacagatctaatttagtctccttcatgataagcaagcactaaataaagcatgagaaaaaggaggcatgcttcatattagctttttgggtagtagaaaaagtttggtccccttaaactgtcaccaacctgtctgcctaaatacctttttattgtcttcccttctaatcactctctctccagcattgaaaacaatgctcaaatatcaacctgtcttcaaggcaccaataaataagcatgagacatacttttcccaccaagcccacaaggtaaaaaaattttaaaaggcagtgattaggacacattaaattaaaagttgtgatacatcttgtcccttacttatccttatttttcccatgccaggaaaagtctgctcccaaactgtaaattaaaagaaaaggaacatctttatttctaccttcatttcgttatgtacccagtagtcactcaggagcaggttgttcagtctctatgtagttgagcggttttgagtgagattcttaatcctgagttctagttcgattgcactggggtctgagagacagtttgttataatttctgttcttttacatttgctgaggagagctttacttccaagtatgtggccaattttggaataggcgtggtgctgaaaaaaatgtatattctgttgatttggggtggagagctctgtagatgtctattaggtctgcttggtgcagagctgagttcaattcctgggtatccttgttgactttctgtctcgttgatctgtctaatgttgacagtggggtgttacagtctcccattattaatgtgtgggagtctaagcctctttgtaggtcactcaggacttgctttatgaatctgggtgctcctgtattgggtgcatatatatttaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagtccgcatcaccaaggcaatcctaagccaaaagaacaaagctggaggcatcatgctacctgacttcaaactatactacaaggctacagtaaccaaaacagcatgctactggtaccaaaacagagatatagatcaatggaacagaatagagccctcagaaataatgccacatatctacagctatctgatctttgacaaacctgagaaaaacaagcaatcgggaaaggattccctatttaataaatggtgctgggaaaactggctagccatatgtagaaagctgaaactggatcccttccttacgccttatacaaaaatcaattcaagatggattaaagacttaaacattagacctaaaaccataaaaaccctagaagaaaatctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactctaacaaatttacaagaaaaaaacaaacaaccccatcaaaaagtgggcaaaggacatgaacagacacttctcaaaagaagacatttatgcagccaaaaaacacatgaaaaaatgctcacgatcactggccatcagagaaatgcaaatcaaaaccacaatgagataccatctcacaccagttagaatggcaatcattaaaaagtcaggaaacaacaggtgctggagaggatgtgaagaaataggaacactttcacactgttggtgggactgtaaactagttcaaccattgtagaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaatgatgagttcatgtcctttgtagggacatggataaaattggaaatcatcattctcagtaaactatcgcaagaacaaaaaaccaaacaccgcatattctcactcataggtgggaattgaacaatgagaacacatggactcaggaaggggaacatcacactctggggactgttgtggggtggggggaggggggagggatagcactgggagatatgcctaatgctagatgacgaggtagtgggtgcagcgcaccagcatagcacatgtatacatatgtaactaacctgcacattgtgcacatgtaccctaaaacttaaagtataataataaataaataaataaataaataaataaatattttttagtctcaaaaataaaaggaaaaaaacaaacaaacaagcttaagcttttatttatccatttaccaccaaatgccagaattctaccacaaacccataccttctttcctattaatactcatggtatatgatgtgtgcccttgtaagcacaaatagcaggcacaaagttccagaagcacacaccactgtcaatatgccaggcaaaagaacaaagaaattggaagcttcagcatcagtggacactgcagatcctataatcttccatttttccactgtttataacctatagccaagcaaggctttccttgaccagggttgtggtactacctctactcctgataaaataaaaattttaaaactctagacttcagatttcttgtctgcaaaatggaaaatggaggtagaaaagataatactcaagatcctttctggccctattgatccaggtttttacatactaaagctatcttcatattgaacaacgagaagataagcccagttttgtaaagaagctgagtggcttctgaagacctaagttatttgccagaagaattccaacgttcaaaagttgaaagactatagataagaggcttgctctggagtgacccagaattgtttaatgtccctaatggagaaaaaataagactatatattcatatttgcttctatttcgataaagaaagtctagaacagacatcagcaatctactgccagtgggaaaaatcagcctaagtttgtgtttgtttaaaacaaacagcccatgagctgagaattatttttacattttttaatggttgaaaaaagtgaatatttcatgacacagaaaattatttttaaacattaaaatttcagtgccataaataaagttttattggcacatagccaataaaatttcagtgcccataaataaagttttattggctattggcctctagccatgatctcttgtatatgagtgcttttttaaaaaaaattaagttctgggatacctgtacaagatgtgcaagtttgttacataggtaaacgtgtgtcatggtggtttgctgcacctgtcgacccatcatctatgtattaagcccagcatgcatcagctcttttctctaatgcttcccccctccactatccacaacaggccccagtaagtgttgttcccctccctgtgtccatgtgttctcattgttcagttcccacttataagtgagaacatgcagtgtttggttttctgttcctgtgttagtctgctgaggataatggcttccagcttaatctatgttcctgtaaaggacatgatttcattaccttttatggctgcatagtatttcatggtgtatatataccacagtttctttatccagtctatcattgatgagcatttgggttgattccatgtctttgctattgtgaatagtgctgcaatgaacataagtgtgcatgtatctttataaaagaatgatctatattcctttgggtatatacccagtaatgggattgctgggtcaaatgatatttctggttctaaatctttgaggagttaccacactgtcttccacaatggctgaactaatttacattcccaccaacagtgtacaagcgttcctatttctccacaatgtcaccagcatctgttgtttcctaactttttaacaatcgccattctggctggcctgagatggtatctcactgtggttttgatttctctgtgatgttgagctgtttttcatgtgtttgttggctgcatgtatgtctttttttgagaagtgtctgttcatacactttgcctactttttgatggggttgttttttgcttgtaaatttgcataagttccttgtagattctggatattagccctttgtcagatggatagattgcaaaaatttcctcccattccataggttatctgttcactctgatgatagtttcatttgctgtgaagaagctccttagtttaattagatcccatttgtcaatttttgtttttgttgcaattgcttttggagatttcttcataaagtctttgcccatgcctatgtcctgaatggtattgcctagattttcttctagggtttttatggttttcggttttacatttaagtctttaatccatcttgagttaatttttgtaaaaggtgtaaggaagagatcccatttcaattttctgcatataactagccagttctcctagcaccatttattaaatagggcatcttttccccattgcatgtttttgtcaggtctgtcaaagatcagatagctgtagatgggcagttttatttctaagttctctattctgttccatttgtctatgtgcctgtttttgtaccagtaccatgctattttggttactatggccttgtagtacagtttgaagttgggtagcatgatgcctctggctttgttctttttacttagggttgtcttggctatgcaagctcttttttggttccatataaattttaaaagttttttctaattctgtgaagaatgtcaatggtagcttaatgggaattgcactgaatctataagttgctttggacagtatgtccattttcacaatattgattcttcctatccaggagcacggaatgtttttctatctgcctgtgtcctctctgatttgcttgagcagtggtttgtagttctccttgaagaggtccttcactaccctcattagctgtattcctaggtattttattctctttgtcacaattgtgaatgggagttcattcacgattttgatttctgcttgtctgttgttggtgtataggaatgcttgtgatttctgcacattgattttatatcctgagactttgctaaagttgcatatcagcttaagaaccttttgggctgagatgatggggttttctagatacaggatcatgtcattggcaaacaaagacaatttgacttcctctcttcctatttgaaatttcctttatttatttctcttgcctaattgcactggccagaacttccagcacttggttgaaaaggagtggtgagagagggcatccttgtcttgtgccacttttcaaagggaatgcctccagcttttgcccatttagtatgatattggctgtgggcttgtcataaatggttcttattattttgaggtatgtttcttcaatatctagtttattgagagtttttaacatgaaggtatgttgaattttactgaaggccttttctgaatctattggaataatcatatggtttttgtctttagttctgtttatgtgatgaattacatttattgatttgcatatattgaaccagccttgcattctggggataaaaccgacctgatcatggtggataaactttttgatgtgttgctggattttgtttgccagtattttattgaggatttttgcacagatgttcatcaaggatattggcctaaagttttctttttttgttatatctctgccaggttttggaatcaggatgatgctggcctcataaaatgagttagaggggagtccctccttcacaattgtttggaatagtttcagaagaaatggtaccagctcctcgttgtacctctggtagaattcagctgtaactccatctggagctgggcttttttttttttttggctggtaggctatttattactgccttaatttcacaacttgttattggtctgttcaggaattcaacttctttctggtgcagtcttgggagggtgtatgtgtccaggaatttatgcatttcttctagattttctagtttgtttttaaagaggtgtttatagtattctctgatggttgtttgtatttctctagggtcagtgatggtatcccccttattatttctgattgtgtttatttgaatctcctctcttttcttctctattagtcttgctaacagtctatctattttattgattttttcaaaaacacagctcctggatttgttgatttttcgaagtgtttttcaggtctctatctcccgagtttggttatttcctgtcttctgctagctctagggtttgtttgctcttggttctctagttattttagttgtgatgttaaggtgttgatttgagatctttctagctttttgatgtgagtatttagtactatagatttccctcttaacactgctttagctgtgtaccagagattctgatatgttgtctctttgttctagttggtttcaaagaacttcttgatttctgccttaatttcattatttaccccagagtcattcaggagcaggttgttcaatttccatgtagtggtgtggttttgagtgggctttttaatcttgagttttaatttgactgcactgtggtctgagagacttatgatttcagttcctttgctgaggagtgttttacttccaattatgtgatcaattttagaataagtgccatgtggcaccaaaaagaaatgtatattctgttgtttttgagtggagcgttctatagatatctatcaggtccacttgatttagagctgagttcaagtcctggatatctttgttaattttctgtctcaatgatctgtctaacactgccagtggggtattaaagtctctgactattattgtgtgggggtctaagtctcttaataggtctctaagaacttgttttatgaatctgggggctcctgtattgggtgcatatatatttagggtagttagctcttcgtgttgaattgaacactttaacattatgtaatgcccttcattgcctttttctttttcttttctttttttttttgagatggagtcttgctcttttgcccaggctggagtgcaacagtgtgatctcggctcactgcaagctccgcctcctgggttcacgccattctcctgcctcagcctcccgagtagctgggactacaggcgcccaccaccacacccggctaatgtttttgtatttttagtagagacggagtttcactgtgttagccaggatggtctcaatctcctgaccttgtgatctgcccacctcggcctcccaaagtgctgagattacaggcttgagccagtgagcctggcaccttcttcgtctttttttatctttgttggttgaaagtctgttttgtcagaaactatgactgcaacccctgcttttttctgctttccatatgcttggtaaattttcctccatccctttcttatgagtctatgtgcgtctttgcacatgagatgtgtctcttgaatacagcacaccaacaggtcttctctttgtatccagcttgccattctgtgtcttttaatcagggcattttgcccatttacatttaaggttaatattgttatgtgtgaatttgatcccatcatcatgatgctggctggttaattttgcagacttgttaatgtagttccttcatagtgtcattggtctgtgtacttcagtgtgtttttgtagtggctagtaatggtttttcttatccatgtttagtgcttctttcaggagctcttgccaggcaggcctggtggtgacaaaaatccttcagcatttgcttgtctgaaaaagatgttatttctcttctgcttatgaaacttagtttggccagatatgaaattctgggttggaatttctcttttttaacaatgttgaacattggcccccaatttcttctggcttgcagagtttctgctcagaggtccactgttagtgtcatgggcttccctttgtaggtgacctggcctttctctcttagtgcccttaacattttttccttcattttgaccttggagaatctgatgattatgtgccttggggcagatctttttgtggagtatcttattggggttctttggatttcctgaatttgaatattggcctgtcttgctaggttggggaagtggaagttgccctggatgatatcctgaagggtgttttacaacttggttccattctccccatctctttcaggtatccaaacagtcacaggtttggtctttttacacagtcccataattctcaaaggttttgtttgttccttttcattgtttattctctaatcttgtctgcctgccttatttcagcaagatagccttcaagctctgatattctctcttctgcttggttgatctggctattgatacttctatttgcatcacaaagttctcgtgttgtgtttttcagctccatcaggttgcttatgttcctctctagactggttattctagttaacagctcctgtaatcttttatcatggttcttagcttctttgcattgggttagaatataatcctttagctcaataaaatttgttattacccactttctaaagcctacttctgtcagttcatccatctcagctttagccccattctgtgtccttgctggagacgagttacaatcatttggaggagaggaagcattctggcttttgagattttcagcatttttgcattggtttttcctcatctttctggatttatctacctttgatctttgaggctgacaacctttggatagggtttttgtggggtcttttttgttgatgttgattttgtttttgctttctatttgtttctttttcttctaacagtcaggaccctcttctgcaggtctgctgcagcttgctgggggtccactccagaccctgtttgccagggtatcaccagtgaagattgcagaacagcaaagattgctgccggctccttcctctggaagcttcatcccagaggggcactgacctgatgccagctggagctctcctatataaggcatctgccaaccactgttgggaggtctcacccagacagaaggcatggggtcagggaccctcctgaggaggcagtctgtcccttagcagagctggtgtgctgtgctgggggaaatccccctcttcggaatcagccaatcttttcagagccaagaggcaagaaagatcaggtctgctgaacctgggaccacagccacccctcccaccaggtgctctgtcccaaggagatgtgagttctgtctgtaagcccctgactggagctggtggactcctgcagggatgccctgcccggtgagggggtatctagagaagtagtctggccacagccactttactgcactgtggagaattctgcccagtccaaacctcccagtctccttagccctctcaggggaaaactgcctactaaagccacagtaatggtagttgcatcacccctgcctgggaattcgatccccccaggcagactccagacttctgtacttgcaatgggaatttcaagccagtggttcttagcttgctaggctccatgggagtgggacccactgagcaagaccacttggctccctggcttcatccccctttccacaggagtggactgttctcctgtctcactagagttccaagtgccactggagtatgtaaaaactgcagttcagtgcctgcctgaacagctgcccagttttttgcttgagacccaggggcctggtggtgtaggctcacgagggaatctcctaatccccagatagcaaaaatctttgggaaaagcatagtacccccagtgggtagcacagtccctcactgctaccttgactggagaagggaggtgcccccaactccgtgcacttcccaggtgaagtgacgccccaccctgtttctgctcttccctatgagagcttttaatgctacaagaacagagttcagtcattgtgactgagattatatggcccataaagcctaaaatacttacttattttgaaagttttggccaggtgcggtggctcacgcctgtaatcccagcactttgggaggccgaggtgggtggattatgaggtcagaagttcaagactagcctggccaacatggggaaaccctgtgtcccctaaaaatacaaaaattagctgggcgtggtagcacacacctgtaatcccagatactcaggaggctgaagcaggaaaatcacttaatcccgggaggcggaggttgcagtgagctgagacagcactactacactccaaactgggcgacagtaggagactccatctcaaaaaaaaaaaaaaaaaaaaaaaaaaacaagttttccaactttttggaaaattttaagtttttcaacctcctcctctacaacaatatacaataacgttttaaaaataattacctgtgacaatggagccaagatggctgagtaggaacagctctggtctacagctcccagcgttaagcgacacagaacacgggtgatttctgcatttccatctgaggtaccaggttcatctcactagggagtgccagacagtgggcgcaggacagtgggtgcagcgcaccgtgcgcaagctgaagcagggcaaggcattgcctcactcaggaagtgcaaggagtcggggagttccctttcctagtcaaagaaaggggtgacagacggcacctggaaattcgggtcactcccaccctaatactgcgcttttccgacaggcttaaaaaacggcgcaccaggagattatatcccgcacatggcttggagggtcctacgcccacggagtctcgctgattgctagcacagcagtctgagatcaaactgcaaggcagcagccaggctgggggaggggtgcccaccattgcccaggctttcttaggtaaacaaagcagcctggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccaagcagcctaactgggaggcaccccccagtaggggcagactgacacctcacatggcccagtactcctctgagacaaaacttccagaggaacgatcagacagcagcattcgcggttcataaaaatccactgttctgcagacacctctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaattctaaaaagcagagcacctctcctcctccaaaggaacgcagttcctcaccagcaacggaacaaagctggacggagaatgactttgacgagttgagagaagaaggcttcagatgatcaaactactccgagctacaggaggaaattcaaaccaaaggcaaagaagttaaaaactttgaaaaaaatttagacaaatgtataactagaataaccaatacagagaagtgcttaaagtagctgatggagctgaaagccaaggctcgagaactacgtgaagaatgcagaagcctcaggagccaatgtgatcaactggaagaaaggttatcagtgatggaagatgaaatgaatgaaatgaagcaagaagggaagtttagagaaaaaagaataaaaacaaacaaagcctccaagtaatatgggactatgtgaaaagaccaaatctacgtctgattggtgtacctgaaagtgagggggagaatgcaaccaagttggaaaaccctctgcaggatattgtccaggagaacttccccaatctagcaaggcacgccaacattcagactcaggaaatacagagaacgccacaaagatactcctcaagaagagcaaccccaagacacatcattgtcagattcaccaaagttgaaatgaaggaaaaaatgttaagggcagacagagagaaaggtcaggttacccacaaagggaagtccatcagactaacagctgatctcttggcagaaactctacaagccagaagagagtgggagccaatattcaacattcttaaagaaaagaattttcaaccaagaatttcatatccagccaaactaagcttcataagtgaaggagaaataaaattctttacagacaagcaaatgctgagagattttgtcaccaccaggcctgccctaaaacagctcctgaaggaagcactaaacatggaaaggaacaaccagttccagccactgcaaaatcatggcaaattgtaaagaccatcgaggctaggaagaaactgcatcaactaacgagcaaaataaccagctaacatcataatgacaggataaattcacacataacaatattaactttaattgtaaatggattaaatgctccaattaaaagacacagactggcaaattggatggagtcaagacccatcagtgtgctgtattcaggaaatccatctcacgtgcagagacacacataggctcaaaataaaaggatggaggaagatctaccaagcaaatggaaaacaaaaaaaggcaggggttgcaatcctagtctctcataaaacagactttaaaccaaaaagatcaaaagagacaaagaaggccattacataatggtaaagggatcaattcaacaagaagagctaactatcctaaatatatatgcacccaatacaggagcacccagattcatgaagcaagtcctgagtgacctacaaagagacttagacacccacacaataataatgggagattttaacaccccactgtcaacattagacagatcaacgagacagaaagttaacaaggatacccaggaactgaactcagctctgcaccaagcagacctaatagacatccacagaactctccaacacaaatcaacaaaataaacattcttttcagcaccacaccacacctattccaaaattgaccacataggtggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacacaacgaaatgaaggcagaaataaagatgtcctttgaaaccaacgagaacaaagacacaacataccagaatctctgggacacattcaaagcagtgtaaagagggaaatttatagcactaaatgcccacaagagaaagcaggaaagatccaaaattgacaccctaacatcacaattaaaagaactagagaagcaagaacaaacacattcaaaagctagtagaaggcaagaaataactaaaaccagagcagaaatgaaggaaatagagacacaaaaaacccttcaaaaaattaatgaatccaggagctggttttttgaaaggatcaacaaaattgacagactgctagcaagactaataaagaagaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctccacacatacaccctcccaagactaaacaaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcatcatcctgataccaaagctgggcagagacacaaccaaaaaagagaattttaaaccaatatccttgatgaacattgatgcaaaaatcctcaataaaatactggcaaaacaaatccagcagcacatcaaaaagcttatccaccataatcaagtgggcttcatccctgggatgcaaggctggttcaatatacacaaatcaataaatgtaatccagcatataaacagaaccaaagacaaaaaccacatgattatctcaatagatgcagaaaaggcctttcacaaaattcaacaacccttcatgctaaaactctcaataaattaggtattgatgggacgtatctcaaaagaataagagctatctatgacgaacccacagccagtatcatcctgaatgggcaaaaactggaagcaatcccttagaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccgaaatctccttaagctgataagcaacttcagcaaagtctcaggatacaaaatcaatgtacaaaaatcacaagcgttcttatacaccaataacagacagagagccaaatcatcagtgaactcccattcacaattgcttcaaagagaataaaatacctaggagtccaacctacaagggttgtgaaggacctcttcaaggagaactacaaaccactgctcaatgaaataaaagaggatacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccacatatctacagctatctgatctttgacaaacctgagaaaaacaagcaatggggaaaggattccctatttaataaatggtgctgggaaaactggctagccataggtagaaagctgaaactggatcccatccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccattagagtgaacaggaaacctataaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcacgatcactggccatcagagaaatgcaaatcaaaaccacaatgagataccatctcacaccagttagaatggcaatcattaaaaagtcaggaaacaacaggtgctggagaggatgcagagaaataggaacactttcacactgttggtgggactgtcaactagttcaaccattgtagaagtcagtgtggcgattcctcagggatctggaactagaaacaccatttgacccagccatctcattattgggtatatacccaaaggactataaatcatgctgctataaagatacatgcacacgtatgtttattgcggcactattcacaatagcaaagacttggaaccaacccaagtgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacgctgcatgttctcactcataggtgggaattgaactatgagaacacatggacacaggaaggggaacatcacactctggggactgttgtggggtggggggaggggggagggatggcattaggtgatatacctaatgctaaatgacgagttggtgggtgcagcacaccagcatggcacatgtatacatatgtaactaacgtgcacattgtgcacatataccctaaaacttaaagtataataataatacaataaaaaattataataaaaaaataaataaataaaaataaaaataattatctgtgagaagaataaaggatgagggtaaaaatgggagacttgtattgagtatcttttaatattattttgatttttagagtacataaatatattacctattaaaatagcttttaaaataaattgcaatggtttctgcaaagatcatttctgtacccttgtggtagacagcctccaagacaggccctaatgatccccaccccttcgtattcatagccctgtgtagtaccccccacatcatactaggaaggtctgtgtgacaaataacacatggtgtgtcacttccaagactgtatgataaagacaatggcttccatcttatttattctcttactttctctttttctctctccccctgctgtctctatacactagctctggataaagccagctgtcatatcatgaggacattcaggaagcctatagaaagcctatgtggtaaggaactaaagccattgaccaacagctagataggaactgaggactgttaaaaaccatgggaatgattttctaaatgtatcctccccaaattgagccttcggattagactgctgcctcagccaatattttgaatgaaatctcatgagagaccttaatcagatccacccagcttagcagcttccaattttttccccatagaaactgagatgatgaatgtttgtagtttaagccactcagttttggagtagtctgttacacagaaatagatatctaataaaacaatcatctttgactttttaagagaaaaagaaaaacatgggatagggttgaggaccaaaatcccagagagggagcagctagaggtacagggaagatgctgatgggccaaatagtttaagaacaagaaggcagatcaatttgaaaggcaaagggtagtgacaggtaatgagctcaagaatgattgacatgagtccataagtgcccagatggaaaatgtattaagggacagtatctaaagcagcagaggcagagagcaagaggacagcaaggaggcaggaaagagctctgctggactgggatttaaaagaccagcatttcttaaggcaaatgggacactgaacaagcctctcggtcactctggggctttagttttcttatctaaaaaggaaagagataggatgactataaattctaccattagaatattctctttgcacaatgctagaggtggtagcactgccttaggtgaattatagtttatactatttcagtggttttgagggacaagctattggtagcgcaccttctcagtctggaaagcaacccattttatgcatatgcattatcatttattcagtaattgtttactgagtatttcctctgttctaggcataacatactaagctttagaggggagaagggattagaaaggtcaataaggcacaataccattcctcaagggacccactaattctgcctggcctaacattatcacaatgcctgcctattagcttaagtaacaagtatcctccttcattcatccatgtttgaaatccttagttagcttccagtttctccatccttgacctttttaagtttttacatctattcttgtatcttctccacactgctaactttggaaagaaagggtacttgaaagccaaggaccttactgagcactattcattttaataaccggggaaaccattatgcctctttttatgagtactacatatctattaacggagcctaagattgccttagattgttttgctgtcacgccacaatggttgctcaatcaactgcaaattcacttaggtgcaaattcatcattttagctacaagatgtatgacatgtaagcctttgcaaattgctttgctgaaatcaatataccttttgtgtatggaattccccaatacatcaagccactatccccacccaaaaaaagaagtgaatttactttggctggatttcttcttagtgaacctaagtcggctcttactgattaacatgttttcttctaaatggtcacaatgtacaagttttataattccccaagttgtttttacagatactgaaatataaaagcactctattattaggttaatatttccagaattcactccttttctttaaaaaatgacctttggctcacatttgatctgctgatagctttctctacttatcatatttgtagatgatacagaaagattctctcattgctttctttaccctcttaacccaaccaataaagaggaaatgcagtataaattatgatccatcaacataatgaaataatatattaccattaggttatcattttaattgctacctagaaagacagaaaatacttgctatataatattaaaagcagaatagaaagtgagaggtagacacaattataactctgtaaatgtttttgggatgcgaagaggcttagaagacagtatgcaaaagtgcattaagtaaatggaattctgggtaattactttcttttcaaagtttttctttaattttctatctactgctttccttatcaaaactcctttagaggaaatgaaatggtacctaaaaagagaaacaattagataattctgatgtcttgtttagcatttactgttcacattgcaatatttcattgttcccattcctcaaaattagctgggatgaagacagagcacagattatatagttgatccttgaaccacacaagtttgaactgtgcgggtcaacttatatgcagattttttcaataagatatatcagaaatttttttcaagatttgtgacaatttgaaaaaacagacaaactgtgtagcctagaaatatcaaaaaaataaggaaaaggttgtgatgagcacataaaatatgtataactatagtctactttatcattttctaccataaaatattacacaaatctattatagaaggttaaaatttgtcaaaatttacgtgcatggccagacatagcagctcacacctgtaattccagcactttgggaggccaaggtgggaggattgcttgaggtcagaagttccagaccagcctgagcagcatagtgagaccccacctctattaaataaaaagtagccaggtgtggtggcacatgcttgtaatcctagctactcactaattgggaggctgaggcaggagcatcgtttcagcccacgagttttagactgcagtaagtcatgatcataccactgcactcaaacctgggcaacagagtgagaccctcactcaaaaaaaaaaaaaaaacagaaaagaaataaaacccattgtgacaaatgcaacatattaatgtaaaatgagaacagcagaggaaacagagtgttgggtatatgggaacttactatcttcacagcagttctgggaactaaaactatcctaaaattaaaagttaatttaaaaattgaatgttgtgaagacattgttaaaaaaagtatgcacacaaacacttataaactataaatggcaccatttacagttaaaagaaatgtaaacaaatgtaaagaggcagtattaagccataactacataaaattaactagtatctattgtactatggtaataattctgtagctacctcctgtggctattgtggtgagctcaagagttgtattccgttaaaacaccatgtgaggctaatcatcttcacgtgagcaatttgtctctccagtaaattgcatatcacagtaaaaagtgagcacttggagttctcacttattttttatcatgttaaagtgcaataccagaaaccatggggcccataaggagtgccactagtgatgctgtaactgcttccaagcagaagaggaaagtcataaccttacaagaaaaggttgaattgcttgacacataccaccgattgaggtttgcagctgtgatgtgatgcccaccatttcaagataaatgaaccaagaataaggaccatggtgaaaaaagaaaaggaaaatcataaagccatcactgcagctattccagaaagtgtgaaaaccttgcaaaatttttgcaaaataccttcttatctcatattgaaaatgcagcttttatgtaggtacaggactgctataagaaaggcatacctatagactataatatggttagagaaaaagcaaggacatatatgacaacttaaagcaaaaggaaggtgaagtatctaaagctggagaatttaatgccagcaaaggatggtttgataatttcagaaggagatgtggcttttaaaaagtcaagataacaagagaagtagctcctgctgacaagaggcagcggataaattcccaggcaccattaagaaaattttaaggagagaggatatctgcctgaacagatttttggtgcagacaagtgccatattctagaataaaatgccacacaaaggacatttattagtaagaaagagaagcaagtaccaagatttaaggtaggaagagacaggctaactttattgtttggtgtaaatacagtagggtttatgaacaggactgcccctatctatgaagctgctaaccccaagccttaaaggaaaaagataaatacaagctacccaccttttagttgtacaataagaaggcctgaacaagaaaagccctttttctggattggttccattgatgctttgtccctgaagtcaggaagcacctttccagtaagggatggcttttaaagttcttttgatattaaacaacgttcctggccacccagaaccccatggattcaacactgaagtcatcaaagtggcctacgtgtccccaaacacaacatttctaattcactccctagatcaaggggtcataaggaccattaagggtcattacacgtaatactacaggaaaggatttcaacactatggaaaagagccctaatagagagaacatcatgaaagtctggaaggattacaacattgaagatgccatcattgtttaaaaataaaaagctgtgaaagccatagtccaaaacaataaattcctgctggagaagactgtgcccagattttgtgcatgacttcacaggatttataacagagccagtcaaggaaatcatgaaagatattatagatatggcaaaaaaggtgagggggtaaagggtttcaaggtatggatcttagagaaaattcaaatgctaatggacaccacacaagaggaattaacagaatatgacttggtggagatgagtgcttccaaaccaatgccagatgatgagaaagacgaaggggaagaagcaatgccagaaaacgaattgacattagacaatctggcagaagggttctgattattcaagactgcttttgacttcctttacaacatggatccttctatatgatatgggcactgaaactaaagcaaatggtagaagaaggattggtactgtataaaaacatttttagagtaaagaaaaagcagaaaagtcaaccagaaattatgatggtatttctataaagttacaagacgtgtgcctgcctttcctgccacaccttctacctcatctacttcttcaccctctgccaccctgagacagcaagaccaccccctcctcttccacatcctcctcagccttctcaacatgaaggcttttgtgatgacccacttctacttaatgaatagtaaatatgttttctctttcttatgattttcttaataaccttttctctctagcttactttattataagaatatacaatataataaatacaacatataaaatatgtgttaactggctgtttatgttatcaataaggcttctggttaacagtaggctattaatagataagttttggggaagtcaaaagttatgtgcaaattttttgctgcacggggagttggtgccccctcaactcccgtgttttcaggggtcaactgtagtctgtattttagacacacagataagactattcctttcacccacatacaaaaacaacaataaaataaccaagtgttttaaaagaatttttgtttctaacaataatcctttaaaaaaaaagtgtaatcctccaacacgcacacgcacacgcatgcgtgcacacacacacacacacacacacacaaattctaaccaggtagtttacttgaggattgttaatatagacccttacccctccccacaatggatgtaacccaaggtgggccaatcagtatttctatggcatttctcacaccagagctggggaaaaaattcagtctttctctggtggcaaagttgtgtcagagatgtaaaaaataggagctgctagtaaccaagcttccagccatatgaaaaaagccagtctgacaagatgaagctgaccagagagcagcagagtttacagatggaatcaggcaattcttacaacattttagttcctgatgtcagtaattcctgagcctcaattgcacccctttctgaagttacctgaatcaataaatttatatggttattgtttgtctaagttggacagacctgggtttctatcatttgaaataaaaagtcatgcctaatatagaagatattattattcctgttttttacacataggaaacctaaagttcaaaaaaattaagtaagattatgaagtcagttagcgttggcctggaagcacatgtgttttttataaagacaagttgcatcccactgaagaaaaaagcagctaaaggaaagatatataaaaagaggaaaacagaacaggaaggcagaagtatggcaaatgaacaaaaatgataacagcatttatgtcaagttgaaactttaaaaatatcaagttttctttattaagttaggaaacaaaactcttgagaatcttcaggaacagctgattccatcctagtgtttttattttttctttatatggtatccaggtgcagtttaactggttcttcttcttttagtctctcacgttgagcttctccatagagcatgatacagcgtggtagcttgcttcatcagaacaagcaagcaagaaggcaaagaagagtgccagcaagaaagagaaagtcctagtaaggttaaagtcctagtcttttgtagcctatatgaagtgataacccgtatgttttgccacattctgttcttaagaagcaagtcactagatccagcccacccacacacaaggattacccaaaggcataaatacccaggagtagggattagtggcagtcatattacaacctgcctgacacactagtggtacttgaaatattaataataatgtatttcacaatccaagtgttagagtcattgaaatacattagaaggtacccagtaaatgtttgttgaatgattaaaatgaatggaaaaaatgatgctatcctttttgaaaaaatcaattatagttttcctgctatgttctcaatatttcctaatgtctctgaccatctctgtggctgcaccaacttctttcatgctgattttcttaaagtcaggaacacagaaacaatataattaatctggcatttaattttggtattatggtgatggcggaacacaccagcaccttttacttcagtgcaatattgacatatgttcactcaataaacaaatcagcattcccatctcaaataactcattcaagaggataggcaactcaaatgttaaactatgagttgacaacatgctaccttttccaaaaaccatataatgccattgtgatgcttagtttcttgagaagtagcaagactcatccaccccatctttacttgttctaactattggtaccactgtttacacatgtactgacctctgtctggctttctgtgccactttatgtcagagactgtaataaaagaaagttcacgagatgacaatccaagataggcctgtaagtacaagtgacaaaaaaaagtggtggtcagcccctttctcatactactagtttaactagacaaggtagaggggcacaagatgaggaagaagatgaaagagccattttaatagcatgaggagataatcactggccccttttcttttttaaaccaaaaagcacactgtcaactctggatgacaacagtaagactaaagaaatgccgcagacttgtctccaactaataatagaagcaaaagtatttttatcttagttggtaccattaagatgccctgatcattcttacagagctgttttattttgtttttacaagaaaatatactgtcttcatgaagaaatgacagtcagcatgtgtgatacgtggagcctctgcactagatgttcttccaaggaagtgtccctcctttgcatgcaagaaaagggtctgctttggagaagcaccagggaagtgacaaaaaaataatacatgaggtataatatttggccacattgtgcacagggccaggaagaaggatgcaaaaaagcctagtgtagttgacttcaaaaagatttaggaaggcagataaactacgtgtgcaggaaaatgtgacagtggctttactggaaaatgggaattctgaagatgtttaaaagacttggtgtctatgaggatctcttaatctcataggaatcctgcatgccatttttcatactcataagctccccaaaggcagaaacagaccattatctcccttcatatttccaaggatagtgccctttacaggagatgcttactaaataataataaagctaacatttattcactgctcagccagattctctactacaagcttaacagattatccaactaaattcccccagccctttgaataggtattaccataaaccccatcttatagatgaggaaatgaaagtttaggaggtaatgtgacttgcctaagttcttacaactatattgtggagccaagattcaagcccaggtagctgattccaaagccttaaccacttttaaccctataccaaatgatggcagatttgaattgctgttcttaggtatacaagtggatcatgagtgacccctttctgattctatttcataggattttgtttttcacttgtcatggtcagaaaagaataatctactgccagaggtaaactccttttcacaagtgaggtgctaagcaggtcacctgtttttcccgtggctctgccactccagtgtgtgtaaagagggtgtcaagaaaatgtaagaccattgaggaaggattccccgctcaaaagaatttgtttgtgtgtgtgtgtgtgtgtgtgtgtgtgtgtgtgtgtgtgtgtgtcagggtgggtatagtagggcaaaatgggcaagggtttggaaggtggaaaggagtggaaggtgggctgcaaaaatgtcattttaaaacggtaaatcctttcttccccaagtaagacttatcagtcattcacaactcaatgtgaattactttgatcagtttgcttttctcttagaaactaaaagaattcctgttgctctggccaaagaaaatgaccagccactgaggacaaaaacattgtattagtctagtcagcttgggctgccataacaaaataccatataataagtggtttaaacaacagaaattattttctcacaattctggaggctggaagtccaagaccagggtgctagtatggtagggttctggtgagggctcttttcctgatttgcagatggctaccttcttgctgtgtcctcacatggccttcccttggtgcatgtgcatgatctctcttcttcttataaggccaccaatcctattggaataggaccctaccctgataacctaattgaaccttaattacctcctaaaatctctgtctccaaatatagtccacattgggagttagggcttcaatatacgaaattagggaaggtgggggaagcaattcagtccaaagcagtagtggtagtaagctctgacaaagaatgatgactgtgacacccaacacacactttctctcccccacgacttctgccagggcctggaatgagtccttgagactgttgcatagttgaaaaaagatgctgaaggctcctggtggacaaggggaatatgtcttaaacaagagagctgggcttccttctggtagcagggtaaacctggcaactctaagatgttccataaaaggctccagctgtaagatttccgtgagagctgtaagtcatttggtgttctcctcggtgcaggggtcttgggataggattcttcccacatgactagaaccttgctgacttggccttatcccacactgcacatgtctaatccagttctgccactgtgactacgaccctttggccttatcaatgccagcttacctcaccatgtttctatctaatacagcaaggacctgggcagactcagccatctcaccacatcaaactctgctcacgctgcctaggtctggtcccttctacccccgatctaggtctgtgttctgtagtatcctgtattatctatctagccctgcttgagggctgtgggctcactaggttcagagtacacgctccacattgacggagtggaaggaggaactgttttggagcttgaggatttggggaagatggttaagacatatttgtatgctacgtggcaactagagagtgaaaaaaacaggcatcatggggatggtataatatggccatatagcagggaaactggttaaaaacacaggctttagagctcaataaacctaggtcttcacctcggctctgccttttggtgactacgcaacattgaatactctattcaactcctctaagcctcagcttcttcatctttaaactggaaataacacctccaaattcatgtttttgccaggattgaaaaggtaccataatcaaaatgctgattatactaccaaatctataataagcattcaataaatagtagttattactattgagaagaaatatgaactgggaagaaaagagcactaagttggccggatgcggtggctcacgcctgtaatcccagcactttgggaggccgaggcaggtggatcacaaggtcaggagttcgagaccagcctggccaatatggtaaaaccccatttctacttaaaaaatatacaaaaattagctgggtgtggtggcgtatgcctgtagtcccagctactcaggaggctgaggcaggagatcacttgaacccgggaggcagaggttgcagtgagcagagatcgcaccactgtactccagcctaggcgagagagtgagactccatctcaaaaaaaagaaacaaaggaaaaaaaaagagcactaagtttggggaaggctgtaagcaggaaagtgaggggaagtcctaaaaatcctcattcccttttccattctattgggagccctaggacactgaacgtgtcactaaaaatcttcctgattaaattaacacttgtgagagttaacacattaagaatatttaagttaatgaatgttccttagttttccattactttcaaagtactctaaatcagcatttcttatatcaccagtggttgcctctgaatcatttttaatgtgtttttctttgtggggtcaaaagagatggcaagttgaacacctttcggcatcacgtagccactgggatcctgaaagcactaaccttaccccattgatcactttaggaagaaataaattgaatgaaaaaattccatttgatttgaggcaacagtcataaacataaggtcagtacaatataaactccgcattttccaccttgtttcgtttcattatatatatagcttaggttatgtgatagtgaaactaccaataacccaatttgattggtgtacatgcttagagatgacagtggatgtctcccaaaaaaacacttagaagtgaaagttgagtattcaatactcagtggatctaagcatcaattttatatatatatatacatatttatatatatatatacatatttatttatatataactctaaggctagaaagacctatttatatatattactctatccaaaagaatggtgattcactggtcagccatggaacagaatcatagagacaaatgctgatataagtggaaggaattttaacctatggatttcattcactcagcaatttgttattagacaacctacagaataggagaaattttttgcaatctatccatctgagaaaggtctaatatctagaatctacaagaaacttgaacaaatttacaagagaaaaacaaacaaccacattaaaaagtgagcaaaggacgtgaacagatatttcccaaaagtagccatttatgtggacaaacatatttttttaaaaagctcaaaatcagtgatcattagagaaatgcaaatcaaaaccacaatgagataccattgcatgccagtcagaatggtgattattagaaagttaagaaacaacagatgctggtgaggctgtggagaaacaggaatggttttacactgtttgtaggaatataaattagttcaaccattgtggaagacagtggcgattcttcaaagacctagaatcagaaataccatttgacccagcaatcccattactaggtatatacccaaaagaatataaatcattctattataaagatacatgcacatgtatgttcactgcagcactattcacaatagcaaagacatcgaatcaacccaaatgcccatcaatcatagactgcataaagaaaatgtggtacatatataccatggaatactatgcagccataaaaagaaatgagattatgtcctttgcagggacatggatggagctggaagccattatcctcagcacactgatgcaggaacagaaaaccaaacactgcatgttctcacttataagtgggagctgaacaacaagaacacatggacacagggaggggaacaacacacaccagggcctctcaggagtgaaggggagggagagcatcaggataaacagttgatgaatgtgggcttattacctaggcaatgggttgataggtacagcaaaccaccatggcacacgtttacccatgtaacaaacttgaacatcctgcacatgtatcccagaacttaaattaaattttaaaaaaacaaaaacaaaaagtaatttgttattgagtacctattagacattgttttctctctgaagacaacacagtaaacaaggaagatgaggactcttcccacaaagcttatatttaaagcaggaaggacaaacaataaaaaaaagaaaataatgagaatttccagtcattaaacaagccatgaagaagacaaaccagagaataatggtatgatagagcatggtgtgttcaggcaggaaacatgatatgttaaattggtttggaataagtttggctgcatatacaaactaacctaaaataacagtggattaagtaagataaaacttatttctctctcatttaaaagaagcatagaggtagatagctcggggctattgtagagcctcacaaattcatcagagactcaggctttccaaatctctaccatacctagtgaataccctttctcccatggtctaagatggctactagagctcagccaccacattaggtattccagggaacacaacagatagagaagaggagaaagaagaatacacttctttccttttacagttcctttcaaagtaccacagtacaatttggtttacatttcattagccagaacttagtcacagggccacactcagctgcaagggacgttggaaaatatagttgctcagctgtgtggcaatgtgcctaacaaagaaaggaaggcctctctgaggagtcatatgacctgaagcctcaacgatgaaaaggtagccatgaaaggatctggagacgaaaggtttcaaagaggagaacaagtgcaaaatccctgaagtgggaaagaactctgtataccttaggaatcacaagaaagccagggcactggtacaaattgaatgagagagtgtgcaggaaaacagtctgttgcattccaagagtgatgccatattgaagtgaaaccaccatgatgactaatgttgcataccaacatgttctgcagcaaagtctttgaacaatacttgtagcatagataattcccccataaagatgcttatctaacctccccagtggtcgcaagtttggcaagaaagtctgaggtatgaccagctgcacatgtctttacactaaaagcatgctatatgaaggatactttctagagggcaggtgtgaggatccactatctagcagctacccaagaaatggcacctctttgtaagtccctattaaatgtttctttctgagaaactggctttgtcagcctctttctctggcctctcagctccctcggccttcaggggtagctttgcatagacctgctcactgttctcactgcagaacagagtgctacagcatgaagtcagaagactggcatattagacttaataataagtcatggtaataagtttagattggagtatttccagtccccttgaaagggccatgcccattatgataggaagggtaaggctgccttagcctgagccatcaaacatccaatttatctaagtcttcttgttgtaaatgcatgcccacacagcagtcttctgattccatagctctattaataacgtggctctggttcttgagtctcactctctctctcccgacttccttagcagcttttcccaattgtgactttggagtgcttgggctttaacaagatcatgtaggcatgccatgaacagagatacaattcaaggtagttaaatcttaaattccctcaaaataaacacatcagtcaagtaatataagatttcattcttggcttccaagaaaaatatccagaaaaggctctcttaaccttcgtttgcaataaaataaacagctcaacagtttcccttcggattcgcccagatttcatacaggggtttgtggggagtgttcacatctgcagagagaagaaagggaacagctggagaggttgtctcttcttccagcatttgctctctgtaaactctgataatctgagtcactgatcttccagaaagttcagctgtttaaagatggatctaaattcccaagagattagtaggattgtgaacaaaataatgccctataaggctagtgtctcagagggttttctttgtctatgtcactcactgcacactcaaatgcacacacatatatttacacatacacatatttgtatacatatacaacagctaaagcaggccaagtaatttgcatatgaaacaattttaatacatgtgcagaacctggcaggttaaagaccaagttaaagtcaaggattagtcaaacagataacaaggttaaaaaaaaatgcaaggaagaggtcacacagagaactgtggaacaaaggagactctaatgcaacaggaaaagttgaactttgattaaatgaataaataatgataatgattattatgcatgctatctattattgagcatttactacatgctaaacaattagcacatattaaatgaaataaggcttatctcatttaataaaaataaccttaagagacaggcagtattattataactgctttatagttaaagaaactatagattctttaactaaagattaaatttcttgccaagacctgagaaacagtaagtgactgagctgaactctagtcagatctgcctaactaaaccctgtgctctaacagcttcttatgcttatatgatacttatatgccacatggggtaggaaggacaatgaaaaatgtaaacttaagctacattaatattaaaagtttatagtatttctactggattaaattcctattatacctcacctgaagcataatatcaaattaggaaccaaatttaacaacacagacttttagagttagaaagtactggctccaaccactgctagctatgtgaccctggctagttccataagagcctcaatttctccatctgaagtgggaaaaatatctattttaaagagttgatgttaagagcagagataatgtatatgaagtcaaaaccaatgtttagcatgtagtaagcatagaaggcactacaaatatgaaaggcaatatatttactattattccaagaagaaggtgactaggacatagatcatgttttataaacattagcatgagatgtaaattcatattttctaatggagtgctttcattattactttgcattctgctacaaattacaattcttaacattcctaaagctgggctcttctgaggcaaacaaaatagattctataaacctaataatttcacattccccacagaacagaaaaggattctctccagtttcttgtcaaaactatctctggaaaaaaaaaaaaaaaaaaaaaggccagtggataggaggcccagtggctgctgatgtcctgccaaatccaaacacccatatatcttcaaaggtctagctcataaataaataacactttctgtcttgactgacagcatttatcttggattttaaagcatcaaagcactgtttgtgcccaaaacgttttgtgaaatgatactaatgtgttcaatgatctacatttgagaggctgtatttctgaagctgataaactccagcaaaatctccctagtgaagtctatttccagtacataaacttcatctgcatttgaaaaggcatccattattcacatctgcggaggcatttatagtttaaagcagacacatggtcagattgggggtggaggccttcatctatgtagagacaactagaaagaaggcattagaaatgtgggaaagctgacactaagctcatttttacatctagacccaagatgaattctaggggcagaaaaataaagctatgaaataagagcaagtatccctcctcctcttctttctcctttttctattgctaccatagaagccaatatgcttctgcaaagttttttccccccacaggaatatccttgcctcagattctgccagtcaaaagcctcagacaccacttcttccataaactttgcctctttccttcctgctgagattatatccatcaaacctaaaatctggactgttgattcaccaaaatacttccaaggaagtgagactggtaccacaagtggttaagggatgccatgaaataacattgaatcacataggagaaagttattctattttcattgctttttctgaatttctgatttgttaagaagcatgtctcactgccatgctagtatgtcattagcacctctcccacagttgttaagagttcttgttacaaagactcagtttcaaagccaaggaacaggcaatactacctagatagaatttaataacaccattttgtttatactgtctttatttttagttacggtctatttatggcaactgaattgtttttccatttatagtagtaaaataaagtttactttctaaattcatttatttacattattcgagttaaaaagattaatcaagaataaaattgtatgcagataaaaaattatgaaaaggggctgagaatgagtaaatgtgggagatactaattattatacaacctgaaaacggaagtttaaactgtatccccctactaccccaaggcagagctaatctatccctcctctataattccacagccttgtttgtatatctaatacaacatgagttcatcttctttgaattacagttaactatgtacatttctttttttttttttttttttgttttattttttttattttatttttttttttattatactctaagttttagggtacatgtgcatattgtgcaggttagttacatatgtatacatgtgccatgctggtgcgctgcacccactaatgagtcctctagcattaggtatatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatgatatctcacagtggttttgatttgcatttctctgatggccagtgatgatgagcatttcttcatgtgttttttggctgcataaatgtcttcttttgagaagtgtctgttcatgtccttcgcccactttttgatggagttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtcattgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccaattgtttgtgtcctcttttatttccttgagcagtggtttgtagtaataagagctatttatgacaaacccacagccaatatcatactgaatgggcaaaaactggaagcattccctttgaaaactggcacaagacagggatgccctctctcaccactcctattcaacatagtgttggaagttctggccagagcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaacaactatgtacatttcttatattccctaaatagaagtcagagtctttggtttattcatttttaaggatctgtcttgtgttctacagagcacattctctgtgaatgtttgttgaattgaaaacttgattcacctccatcccacctgtggaatagtggtaatcactttaaggaccttcaggatgcacatagcataagatttctctatagcatgagattctcattactcactatttaaatatcagtcaataaataatcaatatgtactttctgaccttctatcatgttcaagtcctttggagtatgcagaaaaaaaagacatattataactctttgttttctgattttaaaagttcaaatataattgcagaaaatttagacaatacaaaaagcaaaggccaaaaagcgtaaagtataaaaattaataaactctaattcccacacctgcagatgactgctattcatattttagagtgttttctttcagtcttttttgtttgtgtctcagtgccacactagtatgtcattagtacctctccaatagttgctaagctttcttttacaaggactgagtctcaacatgcttgttttcaaaattgagaatgcatttgtgtattaaatagtgtttctggctttcattttcttactcatccccacatacactcttgtgccaccttgttttatatttggtttctatatgccagccacatgaatgaaaagtaatggagaaacatcaagaaatacgtaagtatggttacaaatgtccccttccaaactttttccaagtagagacattgcataacttaacaggaaacataaaaacagttttgaaaaggtgcatcagaatgtttctctaagtgaagaacatcaatggtgggcatttccaattgaggattagtcatggaatcatgactaatggaatcatgacatggctgtgtgggctggaaaaggtttagagatgcctttgtaagactaggaaacaaagatcaagataaagttaatgacttagcaaagaacactgattacagaacacagaatagcagagtctattatctaaacctaatgcccgatggagataaaatatttcacattataatgcaagtcaatgggaaaaatagttgcgtgtttacacaacttcagaagagcacgtctattactatatgaggaacacctgcatagttcatagttcaataaataaacaaaaaagttttcctcactccagagcctgtccagtgaactgtcactactgccctcttgaatttttatctttcaactgcccaccctttcctaaatttgtgtcttttattttattttcaattattttctccttcccttttcatgaatgtataacataattcctatttcaaggtttctgtacagaaatctaagctctttgaaagaaaataactgtcacatattataaataaagaagtttattaaaagtggaattaaattgaactacttggtattcattgacattaatttacctagctaataacaacagtaattgtcattgttttaataatcttttagaatccatattatctgccagtatcaagcatctgctaggagcacattgcttattacatttgatttcttaatgcaccttccttcctttccatagaattcctctagtttggttttcccacccactaatcactctactctctatatttcaagtacctcctcccactccttcactctagatgttagtattcatcaaggatctatttgcaatcttctgctcttgtatctatcaaaagttcctaatccttcatatgcattcaagatatttgatacctcttttatagtcaactattaaataaatctgtcaagacctgacttatctctcaagttctagtcatatcttcttaacatgctacagaacatctttaattatacgtcttgttatcatcatacaaataactcaatttcattatattttcccccaaatcaatgccaatccctgatttatctttctctcttaatggaggtaaaccattcctttggtttccctctcttatccataacatttaatcctcaacaagcacttctggttcttccttagacttcttaatattcataacttgattctcatgtttccaatttccagatagagccacttattattatctcatgcagagactactgcaataccttccttattagtttctctgtcaacagaccacccacttctaacctatcctgtacatacctaccagaataatcttcctgaaatattactttcatcatgcaattctctgatcaaaataatctttaataggtactgttgtctagaaaataaagttccaatttcacatcaaattatccatgatttccaacttaacattcttatttggggattatttgtaagaaatagctcaggaaagtataaaggatactagactctgagtaaggagataaggagtttaaatactagtgctagttggtaattgtgtgatcttatgaatgtcaaattctttagaatataaggataaataaggatgttttcaaatagttggggtaaatacaaattaagtaaaaaaaaaaacaactgacatgcatgacacatggtaggcattcaatcagtctgaatctgaatatgaggtctcttctacctctaaagttcaatgattctcttctctaatcagtctttccaattccagtccaactcccgtattcacttttcccaaacagaaattcttccattctcttgtgcctctcctctacacctacacaaatattatcatccttcaagttctcttcaaaacctacctactctatgaagtcttcaacataaacctcatctaaaagtggtcattgcctctagcactcatgtctcttaacttattagttgtcttgcatcatcaacttttcatgtattcagaatatatcattctagtaacattacatgctccttgaagactactaatctgcatggctcctctttgtatgccctgttcattcattcagtcatttacagaaagtccttttttttttcttttttttgagatggagcctcactctatcacccaggctggagtgcagtggcgcgaatctgggctcactgcaacctccacctcctgggcttaagcgattctcctgcctcagcctcctgagtagctggggttacaggtgcctgccaccactccaagataatttttgtgtttttaatagagacagggtttcaccaagttggccagactggtcttgaacccatgacctcaagtgatctgcccacttcagcctcccaaagtgctgggcttacaggcgtgagccactgtgcctggccagaaagccctctttgatgaggactgagttacactgagttttaaaggatgagtagaaagtggccaggcaaagagagggagggaaagcttccaggaggaaggagtagcttgtgtgaaggttctgaggtcagaaaaatagttttgcaaaataaaggagctgaaaaagagatcaggtagagagacagaaaggcactagagagaagcagcataaggtggcagagaaggagaagcagttccttcccctaagcatatactatcaaagtgccatattttttaaacaggtactagtcatatattgaatgagagctgtttatactataatgaaaagacttcagaagtagcagcatggaagctgccagggtgataaaaacaggaaacagttaaatggtgggactgtattttgaatgttgctcttctaccaactaatggccacacctctactccctctgtgacgcgccccctcaactcagctgacattaaaatccttctcctgttaggtagaaaaaataagttctaatgcctgatagcagagtagggtaactatagctaataacaatatattgcatttttcaaaatagctacaagagagaacttgcaatgcacccaacacgtagaaatgataaatgttcaggtgacgaataccctgaatactctggcttgatcattacacattttatgcatataacaaaacttcacatgtactccataaatatgtacaaatatatcaaaaagattttttaatccttccaggctggagttcagatcatgtggggctcttccgggctaaggtaaaaagttagggctttatgttatgaagattatctaatttgcatcctaagaagatcaccctctgccatgactggcaccagtgaaccacgatttagaggagaaataaattaggagaagggggtagactccaaacggtttttttccgagcatttagctggcagttgccatgaagacttaagctcaaaaagctgatatagataatggagctgggtataagctcagaggcaatagaatatcctagaaagagtttagcacatgctaccatattagccccacctcagccacgccccaaatgtggttctccattggagtttatgatactgtagaatgctataacacagagaaaacaaagtcatattttcttcttcacacttaatccagtggaagtcttatttctacagatttacctaactcttcagctatttcaatgtgaactgtctccaagccatttgaggttgcaacttctctgtgctttgtctcagcacaaatataaactctttctgggaaagtctgaggaaagctcatgagatatttgtacgttttatttggtttctcgattggaaaaaacaatagacatttccctgtttaaaaagaaaaacaaatctgttgactcttacatacaaataactcaaaccagctgacctttaaaaatgtcagaattcacatgtggtcaagcctcagacagactctaagcttagtttggaaaaaaaaataatttaaataatgaactggtaaagcaaataaagttaaatatttgaatgatgattcagttgtgtaaccactagtgaccccaaactgccacttgttgcagatagatgtaagattttaacttgggagagcccagaaacaacccaattatggtgggtaacctttcaaattgaccagaggctacaagcaaaaggagagggaatatctgaccagtaaagactgaaattctgaggccctggggaatactagaaaaaagtctgttatacatatgactcacttactcctggcttgaacaatgaatttttcagattaaggtctaaaacctttaaaggactgaaaatcatagacttccccctccctatacatccccactatgtaattcaaaataaaaacaatactaacctataagagaaaaaaacatgtaaggaagcttgacagatttctaaatttcctcacaatggccactcttatgcctttaaaaattaataatttaaattattttaaaaacatacggtactctatttttgcaaacaccctaagcatatgcttagttcacctgtgggcaattagcactgtttggatccccatagatacactgttcaggtttcttattattaacatttcctgcattccaagaatggccataatttaaaaaccaaaaaataattgatgttggtgtgggtgtggtgaaaagggaacatttttaactgctggtgggagtgtaaactagtataaccactacagaaaacagtatggagcttccttaaagaactaaaagtagaactaccatttgacccagcaatccgactactgggtatttacgcaaagaaaaataagttgttatatgaaaaagacacatgcacatgcatatttatagcagcacacaattgcaaaaatacggagccaacctaaatgtccatcaatcaatgagtagataaagaaaatgtggtatatatacaccatggaatgctattcagtcataaaacagaatgaaataatggcatttgcagcaacttagatggagctggaggttgttgttctaagtgaagtaacttagaaataaaaaaccaaatattttatgttttcacttatatgtgggagctaagctatgaggatgcaaagcataagaatgatataatagactctggggagttgggaggaagggtgggaggggggtcagggataaaagactatattgagtacagtgtacactgctcaggtgacgggttcaccaaaatctcagaaatcaccactaacgaagttacccatgtaacccaaaactgcctgaatcccaaaaactattgaaataaaaaacataaataaataaatatcacaaaatatgtcctgcattccataaaattaattatggaaattcttaggtaagtatttttaacataaatcaaagtcactttacattactagataacaaaatgattatctgtaattttacaaaatgcgagagagcatgacatctcaatgagactcgtgtctggtcatctcattcctcacacaatcacttctcaaggctgagcatggcatatatgaaatataagcaccaaaatttcatcttggcttatgggaaactacataaagtcaagtttatgtaagtcaagccttagaacccaaaaggtttctatactaatctttcctttttctacctgcccttcagcatcataaaggaaataaccacagttcattcctagatcagatagttaatagttgcattggtctgaggcccagtgccaactatttttgcccagacttcccctacgcaataggaaagggaaaatcccacaactctcaaggtagcaaatggacaagtctatactttaactctctcttcttcatgtttctttttttatcttcctaggtaagtgttgagttcttgctggaggttaattaagaagaaacatgatgtagtttcttcaaagtacccttgactgaagacagaacatgctatgacattagtccagtcacttctcctattccctttcatttgtaaccaatgtcctgagggtttgtactatagtgacctaaaaggtcctgtgttaggccattcttgcattgctatgaagaaataccagagactgggcaatttataaagaaaagaggtttaattggctcatagttctgtaggctgtagaggaagcatggcaccagcatcttcttggcttccagagagaccccaggaagtttccaatcatgggagaaggtgaagggagagaaggtgtttcacgtggcaaaagcaggagcaagaggtggggaacagctgtcacccacttttttttttttctgagatgcacttttgctcctgttgcccagctggagtgcaatggcgtgatctcagctcactgcaacctctgcctcccaggttcaagcgattctcctgcctcatcctcccaagtagctgagattacaggtgcccgccaccacaccaggctaatttttgtatttttagtagagatggggtttcaccacgttggccaggttggtcttggaactcctggcttcaggtgatctgcctgcctcggcctcccaaagtgctgggcttacaggcctgagccaccacgcccggcctgtcacccacttttaaaaacatagatcacatgtaaactcagagcaagaggtcacttttcaccaagggatagcaccaagccatttatgagggatctgtccccatgatccaaacacctcccaccatgccccacttccaacaccagagaccacattttaacatgagatttggagcggacacatattcaaaccgtatcaggtcctttgcaacactgacactttataattatggaaacgtctttgccccaatgagggaaaggacaggtaagcttagattagtagaagattaatgattcaataacactgctcaaagtgggctaatatttaaaaagcacattgacttaagcaatatacccttttatcattgcattccttgaattcaggaaagtgctaacacaaaaaagtggcctaaaataaacttttctgattgtatcaagtatctgaaaccaccctgtgacttcatgagagaaagagctttatttcaagatcagaatgtataaaagcaaaaggtcatcaaacaacatgccacatttgtaaaatgaaagaagtttcccatggcataaagctcaaggtacttgagggaaaggatgaggcaaaaaaataggtaatcagaagccaaatcatgtgcctgttaaattttaaaaagttatttccccctaaaaaccttaaataaaaccaataaaatatttaatcatgtaagcaattaaatctgcatttcagaaagaagcctctggtatcatcttcacagtttgtgatatggtgtacattacagaggctatatttatttccctgattcaaagcagtttaaaatttgataacaactgtaaggaatacagaattactgaaaataattagttctattcatccatccattcatttattcattaaattaacaaacgtttaatactgactactacatgtgaggcaccagagttacagggactaacaagaataacaacataatccattcttccaaacaacttagaatttgtagaggaattgtggattttttaaaaaattctgttgttgttatgacattgttaacatcatttttacttgtgatctcaaatgcagaggatataattaattctactcagttaatgacacttcatcatcattgatccttgcaaagcctctctctttcattttttaattctctttgtacccataacacattcatatccccattcataagccagacaaccacttaaatgtgtttaatatatttttccttacatatgcttttataaatgtgtattattatctgagcatgtatttttaattcatgtaaatgttattgtactatatattgctgcccgtttatttcacaatgttattcactcatgttgttagatataacatcaaactgtttgcttttaagtgttgcataacattccttgttgtgcaatcattacattttatctatgcattctccttgaaatgaacatccagattgtcacaactccccaccacaaataaagctacaacaaataccctcatatctggccctttatagacccacatgagaattcccgtgggggcataaacacataagtgaaatttcaaattcaaagagtgagcatacccttcatttgttttccagaatagctataccagtgtacaatcccaccagcagaatatgaaggttcctataccccctactcttactccccaggcccctacattttatgtttttatgtcacaatttacatctttttatattgtttatcccttaacaaatcattgtatctatagttattattaatagtttttaaattatatcccctcgagcctttcaacgtatggcattatcaaactttttacttttgccagtttaataggtagaaagtaatatctcattgtttttataattagcatctttaaaattattaatcattttgaacatgtgtttgttagcttttagggttttttcctaagtaaaattttctgttcctattcttcatctatttttcttttcttgttgctgtattcttgttgattctaggcattctatacattcaagatactaatctcttgttgattacagacatagcaaaaatattctttccttatgttatgtgccttttaatattgcccctggaagctttgttgaaaaaaaatcctgaattttaatgtattaatgtttcctttattggctgtgctttattggttgaaattttgttgagaagacatttctcgagcccttagttcacagagatattcacttactttttcttctattaactttatagacttatttttcacatataggtccactgatttctagtgccactttatcatatataagtgatacacacatggctctttctttgagatctccattctgctccctcaggctgtttatctgaaattgtatcattgagttatttataagttaataaaaacaactttgctactgtctttccttattcctgtcttctcttacttagctcaaaccactccctcaatactctgcactaaaagcttgattacaaatggaagaaagacaaccatcctagttccattttctgtagtcctgcccttaatcagcaacgcataaagcattttacattcccagaaatgtagtctcacgttaatgtagttcttcttaatgtatttataagacatgtatggggtggggagctccaggtgggtaagttccttgtttagaagccaaaaacactttggatacagatgaccaggtttttaaagatgataaattttatatattgattcctgagtcatgtattagtaacactattatgttgaactgcttgtatattcttctagattgcactaagcaacaaaatcactgttcttacaagaactgcagtgatttctactatacaatataattttgaaataattcatacagatcaggtggaaatgataataaactacattattgaattataaatttaaggcttattaagccttccatcaatcagagcctgcagtaaccctttccaagaaagccatcaacaaagtagtaacacaaaattgacagtgtttgcaattttctatgtttaagctatatacccatgattataactgtcaaaattatctgaatgaataagcaatcttctgtctagataaactacaagtcacaactttgacccaaagaaggaagcatctttcataagaaagctgttacccaagtaaaagcaccaaggtgagccattaattgcaggctatccctacattgtattaccatctgagaatcctcaaagaatttcctgcctgcaaacacctttgtctccaaaggtaaattctcaggtatactgaagatgctgcctccaaagtaaaatacccaggcctacaaaactttaaaaagcatctggcacataaatagtaattctgaaatatattgtcttgatgatcacatcttagttataacaaaaggtaaatcttaagtttaccctaccaaatgtgatcaacttctaagaacaagaatatagcatttttgccaaggaaaaaaataagggacctgagtttttcactggaattttcaagaagtacatttgggagatgttttccaactttcctttctactaatttgtattttccatattgcctataatgagtaaaaaggaaaaaaagggggggggagatataatttattttaaaatactatattcatcctcatcatcctccatacccctattaccaatacaccaaccacttacacagtgacaaaagaggggtttaaaatatggggaagagtaaatgatcaaatagaatgatttgtaggctgggcatggtggctcacgcctgtaatcccagcactttgggaggctgaggtgggtggatcacttgagacaacaagtttgagaccagcctggccaacatggaaaaaccccatctctactaaaaatacaaaaaattagccaggtgtggtggtgtgcacccgtaatcacagctactcagcctgaggcaggagaattgctcgaacccaggaggcagaggttgcaatgagctgagatcgtaccattgcactccagcctgggcgacacagagtgactctggaaaaaaaaaagaaagaaaagaaagaaagatttgtaatgccaaagtttttttgtttgtttgtttgttttgagatggagtctcgctctgttgcccaggctggagtgcagtggttgggactacaggcaggtgttaccttaatgcccggctaatttttgtatttttagtagagatggggtttcaccatattggccaggctggtcttgaactcctgacctcgtgatccacccgccttggcctgccaaagtgctgggattacaggtgtgagccactgcacccggcctagttttgcttttaattatccttaaggtaggattttaaaagtctacagcaactttatagacaaaaggattacctggcgttcctacaaaaagatcgtggaaaattctacttgtatgttaggcattgtaattcaacttgaggcaccaatatattcatcataaagtatccattatattgatggaagacacaatataatcattataaaaattgtatcaccttattcccttttgttgttaataaatacctctccataagcaacactaactaaagattgtatgtagcggtactaatattattttggaagcaaggaacagatgttgaataaaaataacatcaagccttcattagtaagaaaatttaatgctattacttttattattttgatcttcaacatagtagttttgttattctagtattcaatatagcagatgaaatgtgggatttatcatctttgaatgaataacaactgtatgaagcctgaactatgaaaataaagtaagggtgttcttctaatttacttttgattttattttcttccgccttatttcctaagtggattcctgtttcacttttgtttgggtgactggttttcatgaaatcttattagatttaatgaagaaactgcaacagttcctgagattataatgttgaaatatctggctgaatcagtgtgcactctgttggatgtctacaaagtagaaaaactactgtgagagtaaactaactgatcaaagaatagaaacaacagccacctcttttcataagacatttactctttcttcttggctatttctatttacatcaaactctagttgtatgttaggcatggaaattcaacttgaggcaccaatatattcatcttaaagtatccattatatggatggaagacacaatagtcatgtgttctggtattgtttgggtgactgcttttcatgaaatcttattagatttaatgaaggaactgcaacagttgctgagattagaatgttgaaatatctggctcaatcagtgttcactctgttggatgcctacaaggagaataaatatttattgaaaaatataagcatatgtaatttattcaggaaattctctttcatatcagaggtgtttgaaacccagctcatgtgtttcaagagttgtaagagaagaagcaagtagatgtaagtgtagattattcaccagagaataatgcaaacagttgaggttggagctaggttaggctttgggcactcagtttgcctgaacaaattgttggacatcgggggttcttcagaaatcaaaagagttcagattcagaaaacttaatatcttgatatctggaaagaatcttataattaattcattttagagaaaaaggctaatcaatgcaggttttagaaatagaatagaactaaggaaaagagtattttccccgctcataacaaggtagaataaagttaccaaggtttgtccatttttccttaaaaactcttcacttagccaacctttttatatcatatcacagctccagttcaggcctcctttatcttgcagaagatttaatacaacgatctctgagatagacttttggtatatcattctacaaccagaactcagctatgttcatcctgtctcctctacaggatattagagacctcaaggaaagagactatacatatatatatttactataatatatttctcctatatctccaacaaaggcaagtatagcaatagctaataatagttaatgcatattaagtgcttactatgtgccaggtattgttctaaatgttttacatgtattagctcatttaatcctcacaacaagtacaattataattccaattttacaggcaagacttatttaaggccatgtggctagtaaatgatggggataggatgagggatttatagccaagtaatctaattccagagcctgcattccactatccttccaggggtggggatgggagctgcatattaaatttctcaatttagcatgggtggttgggaagatattcagaatttaatatactctaacgatacaattcttaacctgagctgtgttttgtacatactaccatctctctgcttataattggcaacataatcattcctcacacctgaagtaaggaacagtttgttccctcataaaaacggactgacaattgttgctatccgtggtaagcgaaaaaaaaaaaaagtcattcaaaatatccatatcaaatccttggaaactgtgactgttactttatttggaaaaaatgggctttgcagatgtaattaagcatttgaaatgagatcatcctggacaatatgagcaggccttcaatccaataacaagtatccttataaaagacacacagaggaaaagagatagaagaagaggaggcaatgtgacaggtggagattggagtgatgcacccacaagccaaggaatgcctagagtcaccagatgctgtaagagacaaggaatagaatttactcaagagccttctaatgaagcctggacctgctgacaccttgatttcagacctctggcctccagaactgtgagagagtacatttccattgttttatatcaccatgtttgtggtaatttgctatagcaaccataggaaaccatccatttgctatctgtgatagactagaaggtccttgtacaggaactgtgttttatgtatctttgtagcccttcctttatcaatttagtgtagtgcctatgatgtgcagatagaatggcaatgacattggaaaataaaagtggaaatggaaaacaaaaaggctgatttacaacataaaaactgtgtgaccttatgcatttaacctgtttattcaataatcacacactgtggatgtacactggggaggtactaggcaataaggtgggcaaccaggaaccacaaagacaacaaatatgatcttggcccatatgtcatttcaagtgacttattacattttcttgtaatcaataacagtgggaaaatgggattcattgtaaattcataagaggaacagctggcccagatttaacagtggtagagtctggcaagcaagtccacttaacttctctgggacttcattataaaacaaataataaataacaggggtgatataaacactgtcttccatagtgtcttccattatattctttcatgagactacaataacttttgcctctctgcctttccacaagaagagtcaaaagttattgtattctcatttaaaacaggttttttataataataatatatactttttataaaatgcttagaaagtgctatgtatcttatacagattatgaatttaactcttacaacctaaaaattatttatgtatataaattatatactaatttttatggtgtatatttaaaatatagatctcatatattttatatacccatgattatatttcatatatttacagtatgtatgaaataatgtattattatttcaccagtttttcaaatggagaaaacaaactcggagacaataaatataatgcccaaatccacatagctagtacaaggtagagccaggatttgaaacacgcttaattccacagcctgagattttaatcactactatcagatttgttatgcaaatgttaaaaactgaaaatactgttaaagccttcaataagtatgtattaaataaacatgtacctttgagtgggcataggagataaatttttttaaaaggctatggtttcgaaggaatcattttctataagcaggcctttaaaaaaaatccctgttatttattatttgttttgtaatgaagtcatagagaagagacttgcttcacagactctgctaccattaactctaggttagctattcctattatcaatttagaatgaatcttgttttccttctgttataatattaattacaagtattaggtagtaccaacaaaaatgaaaacaacaataacaacaaaaccctagcaatccagtactgttttgccacagttgcattttagccaactggtagcttattctgtgatttgaaaataattacttacttcagcttctatatggctaatagtaacctgataataaatctaaaaattttctttacgtaggtattctgagaaatatacagtattaaagcatgtgacaactttattcttactaattactacattcttgctaactccttcaaagcatcataaaagtcctgaaaattgcaatgcatacaaaactgtggtttgcaataaatctaattacagttgatccttgtttttgataattctgcatttgcatatttgtctacttgataaaatttatttgtaaccctaaagtcagtatcctcgacacttggtcatttgtggacatacacagaaaggtaaaaaattggagtcgctggacatgcatgttcccaactgaggtcaaacaaggagatgctctgccttcttgtttcagctcttgaactgcgaacacgtgttcttttcttggcctatttagtgccaccgtttttacatttttgtgctttttgttggtgattctgctgtttaaaatggcttccaagcacagtgcttaagtgttgccaagtgtttctaagtgcaagaaggctgtgataggcctgatggagaaaatatgtgtgttaggtaaacctccttcaggcaccagctagaggtaaaccttccttcaggcacgagctagggtactgctggccatgaattcaatgttaatgaatgaacaatacaacacatccagaaaaagaaagaagaaatttggtaattgataccagaggccacaccagacagtgctaaaataacatctacagtgcataatgaagctatggaaaagatgaaaaagtggctaaatttgtgggttcatgagatgatgacctattttttaaaaaataagcatagtgcacagcattgttgtgaggctgaaaaccaaagaaatttatagtcacattactcaaggtttggaaaaaattacatccttttcagctagtgctttattataaaggaatactgtattcagttaattatttgtacaaaagacatattaaagaggtgtttttaaacagaaacatttactaaacaaggttatgtattgattggttgattaaaaatgtgaccagaaacttaaccgtgtatttctcctagtagcaatggctctgtatttgctaattcagtgtttgctgcaactttatagtacagaactactacagaacaacaaatagaaaggaaataaatcatttcttattgatatgctgtttcaaacatcttccctattttccaaaggatatttaagcaacaaaagcagaagcgttagagaaggaattttcaagaagaatgaggaaaagccatattggattggcctcagaaaggataaaaagggttattctaaattcaaagccacattaggaactcacaagcagctagagtggatatccatttttgtatggcttagttgaaatgaaactaacacattctatgtcagatgaacgctgcaggccagtaattattattaaatgtatcttcatgtttgtaattccccataaggaatcaacctagtgttctacaacgcaggacatataaagtcagagagatcttggctaaaacccgaactttgctaccatccaacctaagtgcccttggacaactcttaacattttttagcctgatctctaaaaagaggaaataatatcaatctcacaattttgctttaagaattaaataattatgttaatcttttagtacatcataaagatttaataatgttaataaagtttattattttgttattactgttgttaaaaatcatggaatattggtgttaaaggaaaatttcagacaaattaaatttaacagagtgtaattgagcaaggaaaaaaaatcaattcatgaatcaggcagcctgaagaatcacagcagattaagagaaactccagggatgtctcatggtcagagcaaatttatagacaaaaaaagggaagtgacatacagaaaacagaagtgtagtacaggaacatctggattggttacagcttggcttttgccttatttgaacagttcgaacagtcagcagtgtatgagtgattgaagtctggccgctgggattgactgatacacagctgttgttacagtagcatactcctaagttaggtttacagtcttgtctacctactaagttaggttacggtttgtccacgaagactcaaatatggaagtatggacgctttctcaggccatatttagttcgatttaacaattggcaatttcatatgatcaaatctaatattattgcatagctcaacttttaacgttaaataaacagtaaagacaacatttatgtgtcggagctatgtattttggttgccaaatcaaaatatttttcctctatggctcaatatttgccatggtttggttactagtcaggagtatgataagatattataataagaatctttctaaattctcacaattttagtagctatctctcatggaatctctagccaaagatggtaatatgtttatgttacatggcaacgttccaacatattaagtagatgaaatatcaagagaaaaattcgagcataccagctaccagaaaactgaaataaatctcatgtagaatcaactctacacttatataaccaggttttgaataaaatattactggtgaaacagtcaaattcttacctgcctgagctactctgttttctttttaaaacaatttaattcctttatgctctccatctgccttatacctatgcatttcttaattactacctccaaagttcctttccaatttttccctgtctaggtgtcagagtcaatgtgatataaataggaagagtatggctttggagtttaactctggctctaccaagtgcactcactgtaagagcttggacaagtcccttaacatcctcatctaaaaagggaggctcatatcctcataggcttagtgtaagaatcattgaaataacatttatgaaaagttggcatgatatatgtttacagacaggttcaagaatgttaattcctcctgcttctccttgttctgtctccactgaaaaatccagtctttgcataaaaggacactagactcctgaaatttaataactctatttcagaaattgatatctcttctagcttcttgtccaattgatcacctatctggtagctatttctacctccttgtccttctccccttctaacccctcaatatatctaaaactggttttccctcctgaatgccttatttctacagctatttgtatttctcccttactactctctagaaaagtcaatcctacctttacacttatatattctttcccatttccctaataccccaatccctaataactgagttccctgtaaccctaataactgagtcttggaacaatgcaataccctccttactggcctctttttcttaaactatccacttgactagtcactaaccccatgctaatcttaaagcactgcttccaaattattactatgagaaaatagttctctatcctttttttttttcaaaaattagattttgtttctcctcgttcaacatacatttttaaataatttttttagagaaaaaagccttgacctccatcagaaattcaggtaaagatataaaagatcacctgtcagaaaaacaaaaactcccactgatctgaacagtgtcatcgaaagctctctttcaactgctatggaatttacccaaagagatgctctcttgtgaggaatctggagcagtgagaagagaaataaaggtaaaactgccaggttcgaagatatttaagttaatttcaaaacatacacacacaacacaataaaacagatggaagatctaggggtaacagaaagctttataaagaaagttttataaactcaataggttttctaacacaaggttctcatcgattcaaattcctatctcgctcagtttttaaagtcactgaacatttgatatctaaaagtaaaacaaataaatttttatctcttcttgatatgaaggaagaatcaggaaaagggagcttttaagcagctaaaaacagatatggctttctaatggcaaagttgccagtaagtaaccaagtgaagtcccaaataaagttaattttgacaaagaacattcactatgcattctagataagattataatcctaataagcaatcaactgaggataggaaactagtcacaaggaaaataaactgtgcttactgtactaatctatttcattttaatccaaagtttatctcatttagttatttacctctaataaaacaaataatgtcaaattctgatagttaattattgaggtgaaaaagtcaagtctcgagtttgaactatgtggctgatcacttgaattacttgttctctagaaaacatgaaaaacaactgccaagactagttcgggagacattctattggctgagcttaaggtaggtcatacaaattctttcaaattagtttctactcaacaaatattgttcatataatcaatatttactggctactattaaatgccagacaatgtgctaaaccagcagtccccaacctgtttggcaccagggaccagtttcatggaagacaattttttccaagaactggaaggcaggggatggttgcggcatcattcaagcacattacatttattgtgcactttatttctattattacttcattgtaatatacaatgaaataattatacaactcaccataatgtagaatcagtgggagccccgagcttgttttcctctaactagatggtcccatctggggatgatgggagacagtgaaaccagaagtgtgttgcttatgtttagtgtactccgtaatctcgttttggttgctgtcgctgcagaaaaccctgtttcacaaagatacgatgttggaaatggaagcaggcttttcagtgattttttgccaatctcgggatattccactttgactttaatccacaacgtatggagatttgaaattgtctcaaacttatttttaaggccaccatcatttgcgatctcaagcagttgatcctcttctagcacagacaaagtcaatttacctggcttattcacaaatgggtcgtgggtccattccttcccaggttgggggtcttttgtggctgggaagtaaagctcaaacttcggcgtgagccaaagcagggcaaggcatcgcctcacccgggaagtgcaaggggtcagggaattccctttcctagccaaggaaaggggtgacagacggcacctggaaaatcgggtcactcccaccctaatactgtgcttttccaacagtcttagcaaatggcacactgggagattatatcctgcgcctggctcggagggacctacgcccatggagcctcattcattgctagcacagcagtctgagatcgaactgcaaggcagcagccaggctcggggaggggcgaccctcattgcccaggcttgagtaggtaaacaaagcagccaggaagctggaactgggtggagcccacggcagctcaaggaggcctgcctgcctctgtagactccacctctgggggcagagcatagcaaaacaaaaggcagcaaaaacatctgcagacttaaatgtccttatctgacagctttgaagagagtagtggttctctcagcacgcagcttgagatctgagaacgggcagactgcctcctcaagcaggtccctgacccccaagtagcctaaatcggaggcaccccccagtaggggcagactgacacctcacacggccaggtactcctctgagacaaaacttccagaggaacgatcaggcagcaacatttgctgtttgccaatatccgctgttctgcagcctctgctgctgatacccaggcaaacaggatctggagtggacctccagcaaactccaacagaactgcagctgagggtcctgactcttagaaggaaaactaacaaacagaaaggacatccacaccaaaaccccatctgtacgtcaccatcatcaaagactaaaggtagataaaaccacaaagatggggaaaaaacagagcagaaaaactgaaaattctaaaaatcagagtgcctctcctcctacaaaggaacgcaggtcctcaccagcaatggaacaaagctggatggagaatgactttgacgagttgagagaagaaggcttcagacgatcaaactactctgagctaaaggaggaagttcgaacccatggcaaagaagttagaaccttgaaaaaagattagaggaatggctaactagaataatcaatgcagagaagtccttaaaggacctgatggagctgaaaaccacggcacgagaactacgtgacgaatgcacaagcgtcagtagccaattcgatcaactggaagaaagggtatcagtgatggaagatcaaatgaatgaaatgaagcgagaagggaagtttagagaaaaaagaataaaaagatacagacaaagcctccaagaaatatgggactatgtgaaaagaccaaatctacatatgattggtgtacctgaaagtgacagggagaatggaaccaagttggaaaacactctgcaggatattatccaggagaatttccccaatctagcaaggcacgccaacattcagactcaggaaatacagagaacgccacaaagatactcctcgagaagagcaactccaagacacatcattgtcagattcaccaaagttgaaatgaaggaaaaaatgttaagggcagccagagagaaaggtcaggttacccacaaagggaagtccatcagactaacagctgatctcttggcagaaactctacaagccagaagagagtgggggccaatattcaacattcttaaagaaaagaatttttaaccaagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaaccagtaccagccactgcaaaaacatgccaaattgtaaagaccatcaaggctaggaagaaactgcatcaactaacgagcaaaataaccagctaacatcataatgacaggatcatattcacacataacaatattaaccttaaatgtaaatgggctaaatgctccaattaaaagacacagactggcaaattggataaagagtaaacacccatcagtgtgctatattcaggaaacccatctcatatgcagagacacacataggcacaaaataaacggatggaggaagatctaccaagcaaacggaaaacaaaaaaaggcaggggttgcaatcctagtctctcataaaacagactttaaaccaacaaagatcaaaagagataaagaaggccattacataatggtaaagggatcaattcaacaagaagagctaactatcctaaatatatatgcacccaacacaggagcacccagattcataaagcaagtccttagagacctacaaacagacttagactcccacacaataataatgggagactttaacaccccactgtcgacactagacagatcaacgagacagaaagttaacaagaatatccaggaattgaatttagctcttcaccaagtggacctaatagacatctacagaactctgcaccccaaatcaacagaataaacattcttttcagcaccacaccacacctattccaaaactgaccacatagttggaagtaaagcactcctcagcaaatgtaaaagaacagaaattataacaaactctctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattcacaccctaacatcacaattaaaagaactagagaagcaagagcaaacacattcaaaagctagcagaaggcaagaaataactaagatcagagcagaactgaaggaaatagagacacaaaaaacccttcaaaaaattaatgaatccaggagctggttttttgaaaagatcaacaaaattgatagactgctagctagactaataaagaagaaaagagagaagaatcaaatagacgcaataaaaaatgataaaggggatatcaccaccgatcccacagaaatacaaactaccatcagagaatactataaacacctctacggaaataaactagaaaatctagaagaaatggataaatttctcggcacataaaccctcccaagactaaaccaggaagaagctgagtctctgaacagaccaatagcaggctccgaaatcgaggcaataattaacagcctaccaaccaaaaaaagtccaggaccagatggattcacagccgaattctaccagaggtacaaggaggagctggtaccattccttctgaaactattccgatcaatagaaaaagagggaatcctccctaactcattttatgaggccagcatcatcctgataccaaagcctggcagagagacaacaaaaaaaaaagagaattttagaccaatatacctaatgaacatcgacgcaaaaatcctcaataaaatactggcaaaccaaatccagcagcacatcaaaaagcttatccaccatgatcaagtgggcttcatccctgggatgcaaggctggttcaacacaagcaaatcaataaacgtaatccagcatataaacagaaccaaagacaaaaaccacatgattatctcaatagatgcagaaaaggcctttgacaaaattcaacaacccttcatgctaaaaactctcaaattaggtatcgatgggacatatctcaaaataataagagctatctatgacaaacccacagccaatatcatactgaatgggcaaaaactggaagcactccctttgaaaactggcacaagacagggatgccctctctcaccactcctattcaacataatgttggaagttctggccagggcaattaggcaggagaaggaaataaagggtattcaattaggaaaagaggaagtcaaattgtccctgtttgcagatgacatgattgtatacctagaaaaccccatcgtctcagcccaaaatctccttaagctgataagccacttcagcaaagtctcagcatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagcacctcttcaaggagaactacaaaccacttttcagtgaaataaaataggatacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagtccgcatcaccaaggcaatcctaagccaaaagaacaaagctggaggcatcatgctacctgacttcaaactatactacaaggctacagtaaccaaaacagcatgctactggtaccaaaacagagatatagatcaatggaacagaatagagccctcagaaataacaccacatatctacagctatctgatctttgacaaacctgagaaaaacaagcaatcgggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaatctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatctctggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccacttgacccagccatcccattactgggtatatatccaaaggattataaatcatgctgctataaagacacatgcacacgtatgtttattgtggcactattcacaacagaaaagacttggaaccaacccaaatgtccaacaatgatagactggattaagaaaatgtggcacatatacaccatcgaatactaggcagccataaaaaatgatgagttcatgtcctttgtagggacatggatgaaactggaaaccatcattctcagcaaactatcgcaaggacaaaaaaccaaacactgcatgttctcactcataggtgggaattgaacaatgagaacacatggacacaggaaggggaacatcaaacaccggggactgttgtggggtggggggaggggggagggatagcattaggagatatacctaatgttaaaggacgagttaatgggtgcagcacaccaacatggcacatgtatacatatgtaacaaacctgcacggtgtgcacatgtaccctaatacttaaagtataataaaaaaaaaaaagaaaaaaaactcaaaaaggcttgtcttttaatccaggatgcttggtctccatgtggcgaagcagttttgaatatttcatggccttttttggatagctgattgccacacagtatacaaagcaggcttggagaatgtatatcacctgttgcaatgaatcataatttaagtaggactcttggtattttcatttaaatgcagctttcttttgttggcattcttagagtcttctgctgtctcatcactgaatttttcctccttttcaaagaagctccctagtgatgtttgttttttactcattttgcctagagttagcttgtgggcgtaccaaaactgtgattgagacaagtgcacagtgttagaaagaggcgcaaacaaaagaagtaaaaaaagtaatgggcaggccatgtggagattaaaacaagtgtcagattctgacttaaagcctgccaccagatgcagctgtacaactcaagtacatcaactcacctgccaacagatgcagcttaattgtcacttgccatttgctgatagggttttgacatcagtctgcaagaaattggtttattatggtctctgtgcagtcaaacttctctgctaatgttaatctgtatttgtagccactctccagcactagcaccactgcctcagctccacctcagatcatcaagcattagattctcataaggagtacacaacctagatccctcacatgagcagttcacaatagggtttgtgctcctatgataatctattgctgctgctgatctgacaggaggtggagctcaggcagtaacgccaagtgatggggagtggctgtaaataaagatgaagcttcgctcgctcaccctgccacttagctcctgctatgcagcctgattcctaacaggccatggactggtcctggtctgtggcctggaggttggggacccgtgtgctaaacaatggtctttaccatgaaagcacttataataccatgatagtagcttgaacaacatgatgtcaaatgagtcttccatctctaaaatgaaaattaattgaaatctgttcatctatattccaaaatagccaagcttagatcctggagctctagcaacagggacattggagacattgttagcttctatgggatgtgcctaatagagtctatcctatttaatagcaagaaaggcatgctccattcttctgcaatcatttcacattacctacacatacacacaaaatgtcttagtttattcttcagaacttttcccagtatattctaacataacatcctaaattttatccatccatttcccaaatcaaaccccatgccccaatcatactggtctattaactgtctctataattgatcatgcatattcccacctccacttttttctcataccatttccctaatgtgaagtgacctaactagccttcatctatcaaatggctacccattttttaaaaatgtctacttcatccattcatcaagtgttataacacataggctctaagaatataacacagaacaaagttccttacattcaaagaagaagttacagacaataaattgctaaacaagcataaaatgtgaagagaaataaaggagttagaaagtgctgaggtcagagtggggactggtattttatttagacggccaggaaaaagcctctctgatatatgaacagatgcctgaaggaaatgagaaaccacacaggcatctgagggaagaaattttcaagcaggagaacagctaatgcaaaggcccttacactagagcatgctctgtattttaaggaagagtaaagaggccaatgaatataacaaataagagagtaggagaagaaaggtcagagagtgggcagacagtggggagtaaagtgggtggtagatggcagactttatagccttgtaagtcactgcaagatggtagctttcatctgagggacatgagaagccactaacaggttttgagcagcagagtcacatggttcaacttaggtttaaaaggatccatgtatatatgtcaatgaaagtaaaggataaaggagggaaattaagtgctgtaggttttgaagagagaagagaaagtgaagagaataggagaatgcgtggtggacaaaaaaaaacagtaagattggtgggcatcaccaacacctattttgggttaatgatcatgaaagtaaagtaaacccagttagcaaagtcatgctccaccaacataaaactggctaggagcaggtctgaagcaggcttctcccaggtggctccactgtctccaaaaccctccctgaccattctaggtttcaatcaccattttcattttatcagttccacatacctttctctaaagccatatagcaccaatgcctttccactcatgtagaaatgaatcaattgcatatttttcttatcttgtctttccaatcaaattttaatttccttaaggatagagacaaaatgtgactatatattcacaaaaacaggataaactcatatgtaaggcaacttttaaaaagaaatgttaaaaatgacaaaaatatatttcactggataaaatactttattgttcccctgggctttaagaaactagaatagccccttttccctttagctttctgccttctttaggacttgtcctataatttaaatagttgttttttttcatagtaactgatttgggtttttaatagaatttcttagtaataattctctaaaaggaccaaaataagacattttaaaatagaaaatgttaattttttccagaacacaggcatgtgattatgttgctgctaatcatttactggggagatcaacagggaagctgaggccatgagggtttgatttccaaggcacagctcagcctctgtgttgaatcattgaagcacagtaggatttaattcaattctacaggttttcattgagtacctactatgtacaaggcattgggctagatctgtcaagaaaagcacaaagaaaagtcttgcagtcaaggatcttattatgcaagaaattatatacaaaaaatagcagaatgatgcctataaaggaggcacaaagtacttaaagaaagaaataacatctttcttccctacaagtattctcaatggtagccatgtgtacagtaagttaaaatgtgatgcaggaatcaaaacaccttcatactgtactggccagaagcacagggtttgaagttagacagcactgggttccaatcctggctataattctttgcagctgtttgaccttggacaaattatttcacttctttgagtcccagttcacaatggggataatagttatgggaatttctacagttaaccaatatccagtttctagttctgagtacatagaagaattgtattttcttgtcccttctttgatttctttgatcgctatgatttctcatatattaagttagcgccatggtccctccatccagtcattcatcagtaaaaatttaggctgtaaaattcctaaatactgtgatcagtgctaaaatagagtaaattacaaggaacatagagcagggagtaactatttgcctggaaatgctgggtaagctttcacataagagatgccttttggctaggccttaaaaaatgaagagggctacggcatctgagccagagagaactgcatgtataacaacataaacatacaatttcatattctggaaaagacaaattgctcagacatatacaacgttctaaagtatcacaatgatttgttaaaattgaatatggttgtcctcttggacatcaacttcaaagtttaggcatgtccctgtcacagcctagtttcccttgactgccataatagtatatagttccactaactcatggaactgccattcattaaacctttgaaactttactttgaatatatttttatttttactcttcactacctcttcagttaatacattccagaaattatgtaaaagagttatttccttttagttaagcttccatttattaaggaagcttcagtgttggtcctctaatgctatagtactgagatccagcaactaagactatgctcatgttgtccatactctggatactttaatggattggttacattccctttcagcttcatgcatcacttccaatctgtataaattttttcctgaacagcatctctaacaccatcacacttcctcctcactctatattagttgacctttctgatttcataattttgaagtatagtgacccaaaaattatacatggtgtcctagatagaagggcaccagttttacataaggataaaacagagttttccagagattatcaacatacttcttttgccacaatgatgacatccagaacagtattccatagctcttggtttccatgttggtagccacactgaagttcactattatatttctttctgccagaatagcacagaaattaagcatgaaggctttgaagtcagactgcctgtatttaaactcttaattcaccattttcttgccatcaccttgaactcagcctgagggtggggaaaatcccagtgttaaactctggaaatgataccagctgtgggcttataaccacagaaggtgcacctcctttcagttaagcagcatggagaagaagctgtggggactgtaatctgcccaggtctcagtttcacagcagcccataggagggcagtgggtattgtcctaggtatatataggagagcctagcttccatgtccctcctcaaccagacagcagctgcagctacatcaagtcaaattcagcctaagggcagggcacagcccagcattaaactctcaaaatggctccttgggcctgcaaccagggagaatgggacccttcccaaacaggcatcataggcaagtagctatgtggcatgtggtctgcttatgtttcagtctcacagcagcccactgcagagcagtgcatcttgtcctagatatgcatagtaaagcccggttttcctgtctctccttggccagacagtggctatagccatgtcagcccaaactcagaccaagagtgaggcacagctcagtattgaattctcaggtcccttggtgatgggaccagagacggtgggttccctcccaagcaagcagcatggacaagaggctgtaggaattgtggtccactcacatcttagtctcaaagcaacctgttgtagggtagtgggtattgtcctagatatgcataggataacctggtttccctgtccctccttggcagagtggtggctatagccacatcagcccaaagtcaagccaagggtagggtgcagcccagcattaaactctcaaaacagcacctttgggccaagaccttagtgggtctatggtttctcatgtagccaagattgcaaaagcccatttttgattcctgggggtttctctatcactgtttccccatgtccaggagcttttcccaactctcagtctgttcctggctgaggaaggtgcttcgaaccctctccttacttgcttctggtgcttcccatctcttctctggtgaatcctagcattctctcctaaatgatctgttcaaaatatatctgctgactattctggctcctctacatggagaaggtacatattacctgcatctagtcagccatcttgtctcccaaaattgtatttaccatctttaagccttggtttccttacctttaaatgtagataataataattctaccttatgagtttgatgatgcctataaacaataagcaacgggtctgctacacatagtaagcacacaacaagtattaccaattactatttttattattgctgtaatattaggcccattcctgatgtatcccccttcaggtttgttttttcagtgtccagaaaaacttagttcaacctacctctttgaaaaagtcaccatttattctcctctccggataaatttttaaaatattaaacctgagttctctttctgctccataggaaccctattatacttcccccttaagataaatattctattcacttctacttatcaaaaaacaccattgagaaaataaatggacaagtaataggctaaggaaaaaaatacaacacttatatctgacaaaattatatccagaacaaataagaaattcttaaaaatcagtaaataaaaagccaataatcaaccccctcaaaaaagaatcaaaagaaaaccaggcaagacacttggacagacactttacaaaagaaaaatctataaatggacaatgagtacatgaaaaggtgatcatgattagtcagcaggaaagcacacattaaaagcatactgaaattaaatgcaatgtggtatcctggactggatcctagaaccaaaaaaagacattggtaaaaactaaggaaactcaaataaaatctacagattagttaacgatattataacaatgataatttgttttgacaaattaaatgcaatgtcatatcttggattggatcctaaaaccaaaaaaagagattggtaaaaactaaggaaacttaaataaaatctacagattggttaatgatattataacaattataatttattttgaccaacctatcaatgtattagttttcattaatataaaatgttaatattatgaaaagttgagtgaaggtttatgggaacttgcaactcttctgcaaatccaaaattgtttgaaaattaaaagttaaaataacaagataacactaagcgcccattagaatcagtaaaaaaattaatgttggtggggatatggagcaaccagaactttcatatattgttggtaagagtgtgaaatggtagaaccactttggaaaatagtttggcagtttcttaaaacattaaacatatctctagctaccctatgactcagaaattctgctcctagatatttttatgagaaaaacgaaaatctatgtctataaaaagtcttaggtgtgtccatagaagctttactcatgataaccaaatactttacagtcagtaaattcagatatccatcaacaattcagacattcaccaaaaggttaacggataaactgcggtatattcatttaatggaacagtactcagcaacaaaaaaagggatgaagcatttatataaacaacatcatgagtgaatatcaaaaacattatgccaagtgaaagaagccagacacaaaaaagtacatgctacatgattctatatatatgaagctctacaatagtctaacataatctatagtgatagaaatcagatgagtggttgcttagaattgggactaagtaagtgctgactgggaaggagcataaggaaactctctgggaatgatgaaaacgtactgggtgctgatagtgttggggtaacacaagagtaggcatttgtgaaaactgatcacttaggacctttacacttcactgtgtgtaagttatatctcaataaaaaaatttttaataatttaagtatgtatttattcctttttatttcctgtccctaatgtccttactttagtcaatacagaccctttcttttttttttttttttttgagacagagtctcactctgtcacccaggctgcagtgcagtggagcgatctcagctcactgcaacctccgcctcccgggttcaagtgattcttctgcctcagcctccagagtagctgggactacaggcatatgccaccatgcccggctaattttttttttctatttttaacagagatggggtttcaccatattggccaggctggtcttgaactcctgacctcgtgatccacccacctcagactcccaaactgctgggattacaggcttcagccactgtgcccagccaaaacagacctttctactccacactcaatgcaatgactacatcttagaggcctttgattagaaggcttgttatagattttgaaagtctaactggattatatacatttattccgttcaaaatagcaacttatcgtaaacaggagactgaagggactgcaatatttccagcatttgtattttatactttggcacaatttcacacacaatttaagaatatacaaatagccctcttatctgaaggaatcctaagtgttttacaaaccttcaaaacagatttttaaactatctaatattttataggaagaacatttcatgcgcactaaagtgcagccacatctggcctgcaacatggcagctgtttaacagccatgacacctcacaaaaatttaggacaggaagtaaagaattctacagccaaccaaagtgaagacgaggaaggttgcagaagcagaaagctacaatggcttgggctggagcatgaccagcacgatgtggttaacacatctgtcgtaatgaaaagcacaagtgtcattagtggtcagagcctcatctcacagaaggtatgtcccacagcacagtgaccttttccttccattggtggcatttctaatacaacaggaaaaatgctcccactagccatgcccaaaacattccttcctgaagtctccattccaggtactacactacatacaagtttagctgtgctgaaatttgaaaaggtctttatcttcatgtcagaagctcaagccaacacttagttggatatatttcatcacaggcaaatagaaaagagaaagttgtgatttgggttaagggactacagtcaaatacattatcatgaaaatattctccttttcattttcttttcaaatacttttcattttgttttgccaaattaaagaagaaaattttcagtggtttttcctgtgatagtcttaaagtatcttcctgatgaaagctcaactagtttcattaatcctagaagagaattctagatgtagaagagattaagaagaccacggatttcttcatgtgattttggctggtagtatctgcctaagaaggcttcttgtaagaagggcatcgacatgcctgtaaataatcatcacaccttggctttagctccctggaaacgtaggttctccttcatttagttccaaacttttctggatgctagacctcaaatcattttttccaaacacaggaagtgaaccagatcactcagtcctccagcaactcctccatcactctcaggattacataagaatttgtatcttgaatttccatgcctccccctttatactcatgtattcactatttaaaaagccaggtaaagaaaacccagtacccagagttctgtactaaaataaaaggtctacccatgcaaaaggtatactctactctttcacaaggcatatgaggctgtagagacacctcctggatcccaaagcatactaatgagactccaaccttatcaaaggacatgttattattccccttcaattctgcccgaagggcaagccaagttagagatggaattccatataaggctggaattacatttatctattattgcttggatccaagtatatgggtttgtatgtaagaggagaggggtttcttagaatgactgaggtttatagaaaaggagagaaattattgcactaaaacactaatgccatcaaatgaaataatgtctcagttactggcccaaagcacactgctaagtggtatagactacgtgtgtgtgtgtgtgtgtgtgtgtgtgtgtgtgtgtgtgcatgtgtgtgtaaagagagaaaaagagagatcagaaggagctaactcatcataatgggcaataaatatatggaggaaatatgagttttgcaaacaatgctattgcaatttgattttggaaactcagatgcaacaaacatttgtgggcaatttccaggtgcctgaagagcttacgtgtgcctatttatttaatcttcccaacatccttgtgaaagtaattgtatactcttatttttatagatgaggaaacaatggttggccaggcaaaagtgatttatccaaagtcattcatgtgcagactagaagtaagtcctctgacttcaaatctcttgtttttcttcccatgcaccatgctgcttttttatgttgccagtctgcaatgaagtaatctcattggaagtgagatgtgagctgggaattgaaggatattctgtggagaggaacgggaaaagcattttaggtaggcagactagactctaccatgattttcaagcagaaaagcccaaacaaaagaccagttaagtgggcaacgaggaagcttgctttaaaggaaagattatatagaaaagaagagggaactaacactccaaagataggcctggacaaaatcatgcaaagattttaccattaagcttaacagtgttgccttattttcttgataatggggagccactatagttctttgaatgacatttttgaattcgcttttaagaaatatcatcttaaaagtgaatttgcagtatgatagatgaattagtggagaaagaatagagaaaccagtctgaggtgtttgttttagcagtgcaaatgtgaaatggcaaactaggacagaatggagagaaaaataaaaataaaaacaatccttggcatgcagtagacactaattagtaagtgtaacatttataaaaaggcagagcagggggaaaaaaaggcagtgtgaggagagaatcattagaacttgttaacttactggctatggaaaacaagagaaagtgtgtattaactgtcactcaaatgtcagacccagacaaccttgatgatagtgggatcattaacagaagtaagaaatttagaagaatggaaccaaatttaagaaagaaaaataacaggttaagattatgaaacactaaatttgagacaactcaaggtgcctcatgaaaatgttttgtggacacaattacccaagagaaagatcaggctggaaatttagatttgtccatcatctttacagtggtggaaccaaagtggaaacaaaatcaccaagaaaaattgcatagagtgacaagagataatggctaagaacagggtgcaagaacaaaacaaagcatacactcagaggtgcaaaacagtatcgaatgttgcatgcaaatcaaagacactaaggctgggaaaagactatttgatttgacaattaggaggtcatggtgaccttcaagagctcggattcaggcaagtaattaggaaaatgcagatttctgagagctaaggagaatgtgaattgaaaatggaggatgtaagacagattacttatttgaaaagattggcagtagaagacaaaaaagggggttttatattatatgctaagcttaatgtctctaggagaactttaactttttcagtccattattttaatttttatttttatagtaaaattctattttaaagcaccactatgctacaacctgaattaagctataccatgggtcaaatcctgtcctgtcccctgcgtgcacagtgttatataggatattggtctcaatacaccaaagaaagcatatgagtaatagacttgtccaccccattcctatctgtgttattaaatagctgaactgtaatttgaatttataaaactaatgttgtctctttgggattttaatatgtttattatctgaaataaacaacctcatttctctaatcaccctctattgacaactttactaatttggtacattagaaaatgatgatgatgttgaagtgtgaaaaccatattgatataagatttatatttaaatccagatgtttacacttattaaaccactatgaagccttatgatttattttctctcactataggtcacagcatatagcttagagaacacttaagagaagtaggctaatgcactcatacttcattcctggaacctttggttctagtttgactaaatttaccaataaaataagcttgatggacatgtgcaaaactctagtcaacattattcactgtaacgaaattctctacttatctgcttccatgaggtagtcctagtgctaccaacaagaaatttctcaagcacatagccatttaaataactcaggccatgattacataaattactttagtccaggttagtaaaaagaataaagacaaaatagattttacctttaaattttttctttcaccaaaaaaactactgacagaaaagatactttgtaactagtcaaatgccaggcaaggaaactgtaatggccaaaggaccatagccacacaaacccatgaatgttcagtaaaggcttgttgacggtacacaccattgatgattatactttagggtaaagataatgttatgagtaaaaaatatgacataaatttgaatcttaaaatcctagaaattataatccatcaagctacagtacattactaaaaatcatagagaatgttctgatcaagagtcagcaaattttttttttctgtaacaggtcagactgtaattagtttaggctttacaggcaatatggtctctgttgcagtgaattaactctgccactgtagtgcaaaagtagccataaagaatatataagataataactgtggctgtgttccaataaaactttatttacaaacacagatggcaaaagcaactactcatcaacaaaaatctgcaatgaggaggtacgtcaaagagacatgggagccaactgaaagagctccacatagctaaatctagaacaatttgaacaacaaaataaagtaatattataacccaaaatataaaataaatatccatattcactattaataagcaattgatcaataaatggggagaaaagacaaatatctcatgcagaatacaaataattgatgtagatattccatcctcatggaggtggagcataactctccactctttaagtgtgggctgcacatagtagtgacttccttccaaaaactacggtatggataccgaggaagggtaagtaactttacactggagaaacctgacaaacactaccgcagccaggtgataaaggccaacatgaacagtgataagtcacattgatagtgacttataaccaaatctataacctcagtttaaattgtaagaaaaatagcagaccaatctcatacagacaccttataaaatacctgaccaatattcctcaaaactgtcaacatcatcaaaaacaagaaaagtctgagaaactgtcagtcaagaggagcctaaagagacatgatgactaaatctggatgagatcctgaacagaaaatgaacacatgtaaaaactaggtaaatatctataaaatatgggctttggttaattttttcagatcaaaaagtattttatatttttatttaatagaaaaataaaaattacaaaatacgtatacaaaataatgttttgaaatatgtatacatggtggaatggatcaactaagctattaacataggtatcacctcacatacctatcttttttgtgatgagaacacttaaaatctactcaatacattgttattacctacagttaaccatgttgtacaatagatcctttgtacatatgtctcctatctaactgaaattttgtattctttgaccaacatcttcccatcctccctatcccctggtaaccaccactctaccctctacttctctgagttcaattttttagattccacatatatactatgcagtatttatctttctttgcctctttatttcacttaatataatgtcctccatgttcatccatgttgtcacaaatgacaggatttcctccttttttaaggctgaatagtattccattgtgtgtatataccacattttctttatcaattcatttgcttgtggacacttagattgattccatatatggctattatgaataatgctgcaatgaacatttcagtgcagatatgtcttcaatatactgaattcatttcccttgaatacccattaatgagactgctgcatcaaatgatagttctatcttcagttttttgaggaatgtgcattctatttttcataataattatacacatacccaccaacagcatgcaagggttcccttgactccatatccttaccaacaagttatctttggtctttttgataatagcaattctaataggtgtgaggagatatctcactgtggtgttaatttgcatttctctgatggttaagcacatttttgtatgcctgttggccatttttatagcttcttttgagatatatctattcaggtcctttgcccagttattaatcagtttctcttcttgctattgagttgagttccttacacattttggatatgaaccctttaccagatggatggtttgcaaatattttctcccatcctataggttctttcaacattctgttgattttttttagctgtgcagaaactttttagtttgatataatcccatttgtctatttttcctctttttgcctatgcttttgaggtcatgcaatttatccctagattttcttccagtgactataaagtttcagattctaaatttaagtcttttatccattttgggttgatttttgtatatgttgtgagacaaggttttaatttcattctagtgcatgtggaaattcagttttctcaacactattttatttgatataagtatagttaccctgctcttttccatttgtttgtttccatttgaatggaatatctttttccatcgcttcactttcagcctgtgtgcccttaaaggtgaaataagtctcttgtacacagcacacagttggcccagcttttttttaatccattcagcccctctatgtattttaatagaagaattcaatctacttacattcaagataattattaatatgtaagggcttatcactgttattttgttattgttttcttgttttgttttgttttgttttgtttttagaacctcttttctttctctcttgctgtcttcctttgcagttaagtgatttttctctagaagtatgctttaccatcttacttctgatctttggtgtatcgattataggtttttgctttgtggttactttgaggcttacataaaaccttatagttgtaacaggctctgttaacccaaagatttgattgcattaaaaaaaactaaacactttcattcctcctccaatattttatgtttttgatgtcactgtttacatcttgttatagtgtgtaatccttaagaaatttttgtagctattaatctttttaatagttttgtcttttaaccttcatactaaagatatgtgatttacatattacctttatagtattagataattctaaatttgactgtgtacttacttttactagtgagttttataccttcataagtttttgtatcactaattagtgtgctttcctttcaacttgaagaactacctttagtatgttgtataagacgggtctggtggtgatgaactccctcagcttttatttgtctgagaaagtcttgatcttgccttcatttctgaaggacagctttgctgaatacagtactcttggttggcagggtttcttttttcctttagtactttgaatataccattccactatctcctgcctataaagtttctgctcagaagtccactgatagccttattggaactcccttatatgtgatctgcttctttttccttgttgctttcaggatcttctctttgtctttgatttttaacagttttattataatatgtcttggcataatcttgtgtgaactgaatttgattgaatacctttgaccttcttttacctagatctctggatctttatgtgttttcccagatttgaaaagttttctgttactatttctttcagtaagctttttaccccatttgtctttctcttcttgaaatcctataactcagacatttgctctttttacattgtcccataaattctgtaagttttcttcactccttttctttttaatttttatcattcgactacatattttcaaataatctgtcttcaagttcacagattcattcttctgcttgatcaatgctgctactgatgctttctattgcatttttcacttcattcattgtgtctttcagctccagaatttctgtttgacttttaaaaacaatttcaatctctctgttaaattcctcactttggtagtttactattttcctgatttcatacaatttttttctgtattttctttaattttgctgggcttccttaagacaatcatcttgaactgttttttaggcagttcataatctctatttctttgagggttagctactgggagattattgtactcttttggtagtgttatatctccttggtttgtcatgtttcctcttatcttacattgaagcttgcacatggaaagaagttggaattcactctagtttttgctgactggctttgtatgggagagcccttccttttcagtccatccagagattctgagtaagttgtctggcattctgagtaagttgtccataggtgggtttactgctggagtctttggacatgtagcctcgtaactgggtcagcaggtgggtgggcctggaacctggttccacggggttaagcctagggcctaaacacaccagagtggacctgttgattggttcctcaggaggagacctggagcctaggtcacagagggtaggcctagaacctatttttccaggggcttccctgaagcctgtatccacatgaactgatctggcactggggtggtctctgagcccaagtctgcaggggtcagccaggtgctgggatggtcctgggaactgagtccacaggagctggcttggaactagagtggggatgggacacaagggtgagcctgggttctggatctataaggtggtcctagagtcttgatccatggggaccagtctagaaccagagtctgttggagcaggcctggaccctggatctgttggaccttgtggccacaaggactgccctggaggatggcaccacagggacaagtctggcactgagcaggcccagagcctatatccacaggatcttgccttgtatctgatgccagaggctatgacctggtgctagagtgagattaaagcctgaaaaggggctgcaaccatcctggctttggcagtcatgggctatcatggctccaggctccaaaatctagggcagaactgaagcctggggtcccagaagctggcctggcactgggtgggcctagaacctatatctgtgatgtccagcttggtggtttggtctataggtaccagcttgatgactagggcttcaggggatggcctcatgcagggttgaacctacagcccaagtctgtagaggttggcctggtgctatgtcatgcctgaaacccagggccattgaggccagctcagtgctggtaccagtctcaggcctggggctgctggggtaggcctggtatcggggcagccacaagtcctagtgtgcaagtcaggcctggagccaagggctgcaggattctgttttgtgccagggtgggcttggaagctcaatttacaggtactagtatggagcctggggcttccagagctggcctggggctaggtgggtctggagcctgtttctgcagaagccagcctggaggctgtgtccacaggtattggcctgaagaccagggctttagaggccaatctggtgctggggcaggcctgaagcctgggattattgacactagcccactgctgggggtggcctggagcctagcactgtggggatcaacctggtgtagggtagcacatagaacaagtcctccgggtagacctggagtgtagagcttcaggatctggtctgacaccaagatgagcctagacattgagtccacacataccagcctggagtctggggctgtgagggcttgtgtggcactgggttttactgggatagggctagtgttggggtcccaggcagcatccgatgctcacttccctgaccctcccccaaggagagagtatctatctccacactttgctgcctggagttgaaggaggagagatgcaggtgatgtaaaactgtctttcctaccctcttcaatgtgccccttcttatttctgtgctatacttaagtgctgaaatctctcacctggcttctgttgctgatgtaaaggaattttcatgcatgaatagttgttcaaagtgatgtttttgcagaggacaatcactggaaagtcatattctgccatcttgctgacatcaatctggactttagttaattaaaatatatataaataagagatggcaggccagattttgcctggaggccatagttttctgaatccagtctaattgccatatttactgaaggtcatgatggtctcctacagtcataacacaaaacagaaacagatgacaaaatgggagcagggcctttagagtctagccccttatttcacatctgagaaagcaggagcagtgaggttaagttccttacccaggtccaaccagtctgtaagcagtggacctaaagcggagattcagggtccaacttcctggctaatgctttttatgctacatgatgctgccaccctctccccatgccctgtatgcataattccaagtcactcaagaaaaagagaagcactttggcaattcaactgacttaggcagtccaaaaagaaaatcctagtatgacttcttgctttcttcccagataagatttttcctctaagttcttgcagctgaaggctagaacccatagagcaccagagcccagaaggactgactcctcactgctttccatctcctgatcttgtttacatgtgtttatctgcaaaagttttaatggaataagagaaaacgagtgctttaacttcccaataaaatctgtgccccagcatgagtcattgttttctttttttacactagcaaggataaagccttctggttttaataactaatactgctgagttcaataaaaagcacttaatttaatttaatccaaaccttgatcaacgccagcttcccctggaattttatctttgttttaacttgagtctttatgttcagaaaaatgagaggccaaaaggaaagaaacagaagtcaattagcttgtaggcttgtttctagacaaaggacatgaaaatacaagattgacaggtaaactccaaggctctaatgtttctgccccactggacaatcttttcctggcagaattaatgctttctttaatcctgaataaagaaactgaacaattcacagccccatttggaaaatgtttttaaacaaaatattccaaagccaattagcatcagatttctaaactagaaatatattgcgtttaatgtgtcaataatcgagagatatgctactgtaaaattagatacagaaaccctcaagtccatctgtttcaattctaaagcagccagactcagtgcttaagggactgaaatgtatatagggactaaaatggaaataaaatgaagcacccctgaagatagttttgataagcttttcttaaatgatccctttattgtcacaacagagttcagtcctatttctaaaaacatccattattgtagaattgcaatttactattaactgaaaccactttcataacttcaacctgaaagttcctgctgctgtgtcaagtttgaaccaaaaactttgcaacagttgaggggaattatgaaaatctgcatttttggttcaattatgtagtttttcagtgcaaaagcttttagaaatgttctgaaggctattaaaagagaactgaggccagacacagtggctcaactataatcccagcactctggaaagctgaggtaggaggatcgctagaagccaggggttcacaaccagcctgggcaacataacaaggcccagtgtctacaaaaaaaaaaaaaaaaaaaaaaaaaaaacattgccaggcatgctggtacatgccctgtaggcctagctactcaggaggctgaggtgggtgaattgcatgagcccaggagtttgaggctgcaatgagctattactgcaccactgcactcctgcctggatgacagactgagatccagtctcaaaaaacaaacaaacaaacaaaaagcaggactgaacatcagggatagcattcagtctccctccagagccgggttactactggcagccacatttccttgccaccatctggaagtactgattcaacagtggaccagagggaaaaggcagccagtttcttgtagaattccaaacttcagttcctgtagcacctggtttccataggggtttcatgtccaagtctgattaaaccacaattcatagactatagaaatgttaaccctgggaggagacaaacagcatctaagccagtgattcacatacttagggatttcaggaccagtaatatttcaaaaagaaaaatatcagggcaccaaaatagagttgctcatttttttcatagtcatttgcttttgcaaaacaaagacatttaaaatagcaactaccattaattatcaacatcatttcataacttcaataacaaaaacgtaggaaggacataaacttggaacttaaaaattaaataaatttagtttcataaaaacttgtcacttggttcttattttgtcccaagttgctaaaagcttcatagactgaaattcatttacagaccattgtttgggaacaattagctagtttaattcctaacagcagacccttagaatccgctctgttgtgaccacagctgttctccaataaaccaataatctaaaactcagtgagattctttaaggaatgagatgatttactgtgcttaaagaggacatcaaatgaaacttgtagcaatcattgttttggaaagccaaaagacctgaagtaaattaaatgtgtttattttctatttttttatctttgaaaatcctttagcataaaacattataaaaggtaaataaaacatacttggggaaaaatgaccatgaaatcagcctgtttgagaatcttcacctttgcctagaagcaataataatgttaatgatatactttcctgagcttgggaaaaagcaggctcatgaattgcagccttgtgaaagagggatttacttgactcctattgattccagagatcagaattaccataaatgggcagaaattttaagagaggcagtatatagataaagataagaacttgtttttagaggcataacttcttaagtaaattcaaagatgactgggcaacttcatggtatgagaggccaacctattctggaagtgcttaagcaaaacctggttaacaatttggcagctttactgaaaagggaaatcaaggtagtagattagctcagataacctctgagaagccatctaactctaagaatctaggattcctttcccatcctagcccttaccagccaagaatcaataaaatattagtcaaatactcgagaatagacacaaaattctcttgaggatgaatattaattgcacaatttcagaacactgacaagtcggtaatcatcagtctttttttttaactgttaagttcaggggtacatgtgcaggtttgtcacatatttaaacttgtgtcatgggggtttgctgtacagattatttcatcacccaggtattaaacctagtacccatcagttatatttcctgatcctctccctcctcccacccttcaacccctctgtaggccccaatgtgtgttgtgttcctctctatgtgtccatgtgttctcatcatttagttcccatttgtaaatgagaacatgtggtatttagttttctgttcctgtgttaggtttttttttggtggggtggtaatttaggatttacttttgtaaaaccatgtagacaaatattaaatgttatgcttgcattttgaacattataaatatgaaacacaaaacatccaatgttaaatactgatctcctatgcctgatctagatttagatattgagtatttcacattttacagaaaggaactttcaaagttggatcaatacttatagtatgtactattattcaataaaatcttcttgaaatttaaaaggctgaaatttagtttttttttcttaaatatgctaaaacgtatcagtttggattaaccttcagattttcaagccatgaaagatatacaggctgggcgtggtggctcaagcctgtaatcccagcactttgggaggctgaggcaggcagatcacgacgtcaagagatagagaccatcctagccaacgtcgtgaaaccccatctctactaaaaatacaaaaattagccaggcatggtggcatgtgctggtagtcccagctactcgggagactgaggcaggagaattgcttgaacccaagaggcaggggttgcagtgagctgacatcatgccactgcactccagcctggcgacagagcaagactccatctcaaaaaaaaaaaaaaaaaaaatgctctaagcaagcataaagagtattttgggtcaagttacttctttgtacaaataatacattgtatcaatcaatctttaaaagaaattcttaaaagcattcaaaaatgcttgcattttataattctcaaacaatgtatttatattacagaagatacaacaaattttacataaataaaaaatctcacactatattctcagtcctaaaataaaaaagaactttgcaaattaaagaattatcaatgttgttcagaaaacataccttacttttactttgaaattcactttaactgcttgacatataatttaatacttaaaaataatatagctaaattattttataatatttatagaatattatttctctgagtagacatgtttcacacaacagtttccaattaatgcagataattcatttgataattttaatcacaatttatgatagactgattaatggattaaaaatttattcagtaatttagatgccataagaaccattgaaagtaataatctgataattactcattgtacaatcctgcccattagtaatactaagccaagaatctgatcgctatcacattctgttgaattatgtttccatctgtgtgattggtcaacaacaaaaaatagatacacaatatcatgctttttccttttcctttttttttttaacaagcagctcaatgatttggagggttggttaatacaatacagagaatatagggagaaagtataaaatggcacctaacaccaatgccagtacttatctcattatggttatacctaaggatattattaatatttgtgttatttgcttttctttagaacttaaatcaaagccattaacttgaacttgaggtatatacacaatacatatacaaccttatgcaaaatacttcccatatgtaacatattttaaaatactggaaactgaatatctgtgctgatttgtattttgacttaacggaccaagaagagaataacactcaactagggagggttatactgataataaagctctcaaaattcaaaatgtcttcctctccctttgtacttaccaggggctacacaatgtcctgagaggattcattatgagaaaaatgtgattcacagctttaataacttactttggaaaaaactaatgagaaagcagattggaaggtgagacttcatctttgttttcaaataagtggtcttactttttcttctcatagaaaaagtttaaatcagttgattataaatatatctaaatctttaattgctgcagctttcaggtaaagtttagcacttcatttatacaaagtctatgagaagaggtcagtagagataatctaatcttaagtcgtgacattaaccattcaagtccttggcacaatccctcaccagttagagaacagcatgcctggatatgccactggtgatctttaatagatgttagcttcacaaactgggagatttctgctacagttatgcattttttaacatcttgtttattagcaaaaatcagtaacccagcttttcttaggtcctcatgtgctaacattttatagagttctctagttacagaaatcctctctctgtctgtactgttcacagcaactatacagactctgtgttagtatagtaagtgtttcaggaagaacgaagagattcttggccaccaatatcctccattaggaaatgtatattattatgattatgattattattattatttgagatacagtcttgctttgtcacccaggctggagtgtactggcacgatcacagctcactgcaacctccgcctcccaggttcaagcaattctcctgtctcagcctcccgagtagctggtattacaggtgcgtgccaccatgcccacctaatttttgtatttttagtagagacgggccttcaccatgttggctgggctggtctcaaactcctgacctcaggtgatccacccacctcagcctcccaaagcgctgggattacaggcgtgagctaccagctggaaacatgtattattaatcactatctcttttacattacttcctattgtaggagatgtatgtacaacttcattcacagaaaactgttaaaggatggtagttttccctgcactatccagcccaataatgatacttttgtgctcctggtgattgaacagtctccatatcctggtgaagagaattcccattctcgggcagtggaccctgcctccagacacccagaccgcctggcctccctggctcaggctaagggggtggcagagagagacacactggagcctctgcctctgcagctgctcccgccctggttgctggcccacttccagagaaccagagggaggccaaaacccaggtcaccctgccacacgcgagtccctgctactgccacacactcacctggctcgtggacattgccaccaagttgtctgcaacgagcctcgcaagccaccgtcctccccattcatgtgttagtttgctaaggataatggcctccagctccatccatgtccctgcaaaggacatgatctcattctttttatggctgcattccatggtgtatatgtatgatgttttctttatccagtgtatcattcatggccacttaggttgattccatgtctttgctattgtgaatagtgttgcaatgaacatgtgcatgcatgtgtcttcataatagaatgctttgtattcctttgggtatatactcagtaatgggattgctgggttgaaaggtatttctgtctttaggtctctgaggaatcgccacactgtttttcacaatggttgaactatttacacccccacaaacagtgtataagtgttccgttttctccacaacctcaccagcatatgttattttttgactttttaataatcgtcattctaactggtgtgagatggtatctcgtggttttgatatgcgtttctctagtgattggtgatgttgagcttttcttcacgactgtcggttgcatgtatgtcttcttttaaacatgggcaaggacttcatgtctaaaacaccaaaagcaatggcaacaaaagacaaaattgacaaatgggatctaattaaactcaagagcttctgcacagcaaaagaaactaccatcagagcgaacagccaacctacagaatgggagaaaatttttgcaatctactcatctgacaaagggctaatatccagaatctacaatgaactcaaacaaatttacaagaaaaaaacaaccccatcaaaaagtgggcgaaggatatgaacagatgcttctcaaaagaagacatttatgcagccaaaagacacatgaaaaaaggctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccatttgacccagccatcccattactgggtatatatccaaaggattataaatcatgctgctataaagacacatgcacacgtatgtttattgtggcactattcacaacagaaaagacttggaacgaaaccaaatgtccaacaatgatagactggattaagaaaatgtggcacatatacaccatggaatactatgcagccataaaaaataatgagttcgtgtcctttgtagggacatggatgaagctggaaaccatcattctcagcaaactatcacaaggacaaaaaaccaaacactgcatgttctcactcataggtgggaattgaacaatgagaacacatggacacaggaaggggaacatcaaacaccggggcctgttgtggggtggggggagaggggagggatagcattaggagatatacctaatgttaaaggacgagttaatgggtgcagcacaccaacatggcacatgtatacatatgtaactaacctgcacgttgtgcacatgtaccctaaaacttaaagtataattaaaataaataaatagataaaaactaaaaaaaaagtttctgttcacttcctttgcccacttttttatgggcttgtttttttcctataaatttgcttaagttccttgtagatgctggatagttgacctttgttggatgcatagtttgcaaaaatgttctaccattctgtaggctatttactctgttaatagtttcttttgctgtgcagaagctctttagtttaatcagatcccatttgtcaatttttgctttagttgcaattgcttttggcatcttcatcatgaaatctttgcctgtgcctatgtcccaaattgtattgtctaggttgccttccagggattttaaagttttgagtgttgcatttaagcctttaatccatcttaatttttatatatggtataaggaaaggttccagttttaatcttctgcatattgctagtcatttatcccagcaccatttattgaatagggaatcctttccccattgcttatttttatcaggtttgtcgaagatcagacagttgtaggtgtgtggtcttatttccaagttctgtatttggttctactggtctatgtgtctgtttttgtaccagtaccatgatgttttggttactgtagtcctgtggtatagtttgaagtcaggtagtccttcagccttgttctttctgcttagggttgccttgggtattcaggctcttttttggttccatatgaattttaaaatagtttttttttctagttctgtgaacaatgtcaatggtagtttaataggcataacactgaatctataaattgctttcggcaatatggccattttaaccatattgattcttcctatccatgagcatggaatctttttccatttgtttgtgtcatctctgatttctttgagcagtggtttgtagttctccttatagagatttttacctccctagttagctgcattcttaggtattttgtgtgtgtgtgtgtggcaattgcgaatgtgagttcattcctgacttggctctcagcttgactgttattgatgtaggaatgctagtgatttttgcatatttattttgtatcctgggactttgctgaagttgtttatcttcttaagaagcttttgggctgagactggaaatttctagatatagaatcatgtcatctttaaacaaggatagtttgacttcctctcttcctatttgcatgccttttatttctttttcttgcctgattgtcctggccagaactttcaatactatattgagtaggagtggtgagagagactatcctgtcttgtgccagttttcaagtggaatgcttctagattttgcccattcagtatgatgatggctatgggtttgtcacacatagctcttattattttgaggtatgttccttcgatacctagtttattgagtttttaacatgaatggatgttgaattgtatggaaatccttttctgcatctattgagataatcatgtggttttgtcttcagttctgtttatgtggtgagtcatgtttattgatttgtgtatgttgcaccaaccttgcatcccagggatgaagcctactatcaagtggtgaataagctttttgatatgctgctgaattcggtttgccagtattttgttgaggatttttgcatcaatgttcatcaaggatattgcccttaagttgtctttttttgttggatctctgccaggttttggtattaggatgatgccggccttatagaatgagttagggaggagtccctcctcctcaattttttgaaatagtttctgtagaattagtaccagttcttctttgtatgtctggtagaaatcggctgtgaatctgtctactcctgagctttttttggttgatagcctatttattactacctcaatttcaaagcctgttacttgacgtggctaccattaggagttgggactctttactcctaagaataatgctctttcttcaaaagaatattacttttccttatgttgacatttttaaagtgactctgatatatgctttcaatacacatttttgaacacctacttcatgccaggcaccatgcttaggcactgtcctgaaataaagatactctgacatgatatggaaggaagcttcttgaagcctctttaaccttaaaaacttttactaccctagcagaggagggtttagtaataataaagaggaaaagtaaaagcaatatgtacctacttaagagcttccctgtctctgaatagctccttaccacctaacagttcatgaaacctcatcagtaggaatctgttcccttgattcttgaagattttgttagaagacttctattacaaagcaaatatcccctgggaagagaaataacttaaaactctagcagcttaatcacttccccactttggacttcagcttacccacctataaaataaggggttttgaccacatgatctttgtggtctcctctagtatgaaaatctagacttactaggcctaaaggccagggaatgggagtagtttacggctgggttttcaaggctgcctagaaagagcagttggaattacaagcagcctcaagtattctctcccaatcctgaagttatagggaaagatttaaacatgcttccaagcctcatgggcaaatcactcccttagagctgttggacaacctttggctaataaagattaaacaaataaatatgaaatatggttctatccagcatcctgagaggccaatttgctgttaatggtagtgtttaggccctaaaagggtattaacttacagagtagtaaagtttccaaacacagcccagagctttaaaagatgtacaggtgccaaaattaagggccaaattaccaatctgttttaaatgatggtctgggaatgctcaatatgacaaggaaaatgtatgacaaataatatcttcaatacaaagaaaaagttgcttgaatttattaaaggaaatggactacctcttgggactccttttttgcccactcctcaaagaggtgatttttcaaaatcgactcgaagacacagctaatgcaaaatgaccctttaagcataaagtaagctcatttttaactaaaacagttttcatgtcagcatttgcctaaagctttgggaatttagaaatttcaaagaaatgcacattccattagtatcaaaactaggtgcttccatgatgtactaaatgcatactcaacatatgcaaaagctttaagccagagtaaagccggctgcgtttctactcattgacaagtttaaagaattcattggcagccctgctggatgacagcagaatgacttcctgtcaagtaacctccatcctccaaggtgacaggaaatgggcttaaacactggtaatatcactaatcaatgtaaggaagcacatgttcccagcctgcaattgtgaagtttggttgcaatgtgttagctgcttgctgggccatgtgattcagcataacgacagatgaaaggaaaggtcagatttactaagtgttgaagaggtgtcatcaagtgttgcatattacttcaagatgtcctctgcatcagaggcatctcactatatgggagttaatttctcctgcagaattctttagtttccctacaaccctttatggaagcccccaaatttatttcaacacatgaagaattggactttctcttatttctgattgacactaaatagtccaaggtaatggtcttacctttatatgattctaccttggtttttaagataagtacatacatgtatataccttcaggctttgccaaatacactcttgtagagtcaaaatagccagattttcctcaaaagttcattctagtgcttccagtttcttcaggtggttttccccctctcaaatacaacggcaggtgtattccttttcaaagaagcactatttagttttttgttgtttttttttttgagatggagtctcactctgtcccccaggctggagtgcagtggtgcaatcttggctcactgcaacctctgccccccagattcaagcaattctctcccccgtcagcttccctagtagctgagattacgggcatgcaccaccatgcctggctaatttttgtatttttagtagagatggggtttcaccatgctggccaggctggtctcaaactcctgacctcaagtcatctgcccacctcagcctcccaaagtgctgggattacaggtgtgagccaccgcaccgagcctattcagttttatactaaagaggatgtgaggaaacataactttccctttatttatataataggaagggaccttcaggatcctctcccagagctcattcctatcagattcatttcttcagtcataaatttttcataattacttattgagcacttactctacatcaggcattatactagtggttacaataccaaatagaaccagacgtagtctctgatctggagatatttaattaaataatcaaataggtaattattgaaataaatatataattcataaactacttataattattaaataaattaaataactattcaacgaatgtatagttgttaactggagatgagtaaacagacatagaaaggtgaagtgactttctaaggtcccatcataagtctgttatggaatactggtctcctggctcccagcccagttctcttttactctgtatcctagtgcatttcagtgtgctttccctggactgaaagatgatctgacattccctttccaaggcagtctcatagcagcttctccagagcaggactttccaagttttttacctccttttgcaagtttaaaatgctttgctctttgctgaggtttacctgagggaagggcagtgtgtatgcaagtgtatgtgttgagggagggtggtgaatgtcataatggaggtcttctaaacttttgtgaagaacacacaagactatgctagtacaagaaatacagcagtgtccacctagcctttcatgatccctacccacagtgaaaaagagatgtacctggggacaggtgaagggagacattctaggtgattttctaaaatcaccaccagctttttcataaatactacctgaaaatggtgagccggccaacttacagggccagggaacacacaggccatggatatgttctggaaaactatggcagaggatgatatttattggttacgagagtagagacagggctttctgaagcattatctccaaagttaaagtagcaggacaagatggtccatttattcctttccaggtcttggaagacacagcagtaaagaactcgaaattatctgatccctccattaaaagctttacagtttacacacctgtctccataggagagaagcatgctgtctttaacactcaacctacaaactaggtccctaatcaatatttacttaatgcataaatggtgtggacaatggcatcaatctgcacttataaacattaataataagagtttattgagcacttagtatgtaagagatactatgtgaagggtgtgaatgcattattaaccctaataacactgtaaaacagctaaaattattactcttatttcatagatgagaaaaaaagagatcagcaaggttaaataattcatccaaggttactcatcttataaaagaccagagccgggatttaaatataaatctgattcacttcaaagctcatgttcctggtcaccatatttattgcctgcttgatggtttaggcaagacaagatatagagcgtctcgctaagggtcctactctaaattaattatgacacaacagcaaataagaaaaaaaaaatacataaatgtaatacataaaaagagaagacaaagtaaggtgttttaaggattgattaattgagtagcttagtggtataatgcaagtcctttccaatttcttctctgatgtccttagaacattggcttttgtcctcaggcttgtgccttaataatagcaagatggctacagcagctgcagacatcacctcctcacacagttatatatgaaggaagaacaccaagttaatgactatctacaccaaaaaaaaaaaaaaaccccaacaccttcatgagaaccaaaaatcagggaggcactcattgtacctgtttttttattattattattatactttaagttttagggtacatgtgcacaacatgcaggtttgttacatatgtatacatgtgccatgttggtgtgctgcacccattaactcgtcatttacattaggtatatctcctaatgctatccctcccccctccccccaccccacaacctggttttaacttaatatcactgaaagaggcactgaagagatagaaaatacagcctgaatctctgacaccaccccttctctgcctaccagcagtggcagcttggtgcagagagtttctctgggcactaggggaggaagaacacagaaattctgagaaattgaactcagtgccatcctgataaagaagaaaagaaaactggaccaaactcagctgatgcccacccacggagggagcatttaaactagacctagccagaagggaatcaccaatcccagctgtctgaacttgagtgcctgcaaaccttgccagggagggctacagcactctgtgtctccaaataaacttgaaaggcagtctaggccataaggactgcaactcttaggcaaatcctagtgttaaactaggcccagacacagtggactgagggggcatgtgacatactgagacacaagctggagaagacaaggaagtgcttgcacgactcttcccctaaccccaggctgcacagctcaaggctccgtaagagatcccttccttccacttgaggagaaaagaaagagtagggaagactttgtcttgcatcttggatacctgctcagccacagcaggataggcactgatcagagtcatgaggtccacgtttcaggccctacttccagatgacatttctagacacattctgggccagtagagattcccctgccttgaagaaaaatacccagccctggcagcattcattacctgctaactgaagagcctttgggccctgaataactagcagcgatagccaggtactataatcaagggccttgggtgagcctctgagacttgctggcttcaggtaagatgtaccacattaccacctgtgctggctacaaggtaaaacaccctctgcttgagaaaaacagagggaaaagtaaaggcggctttgtcttgcaccttaggtaccagcacaaccacagtgggatagagcactaagtgggctcttggggtccctgattccaggacttgactcttggccatttctggacctgccttaggctagaggagaaactaatgccctgaagggtgagtcctgggccaggcagcattcaccacatactgacttaagagcccgtgggtcttaagggaacatcagcaaaagtctggcagtattccttgtggcctggggtggcggtggctatggggtgaggctcctctgtctttggaaatgggaggaaagagtgggaagaactgcatcttgtagtctgagtgccatgtcagccacagtacaatagaacactaggtagacttctaaggtttttgactctagtccctaactccaggatggcacttctggacctagctgggactgggggacatcaccgacctgaaaagaagaatacaggcctggctgacattgccacttgctgattgtagagctccagggcccttgcatgaacataggagtagccagggagtggatataacaggctttgggcaagactcagtgctatgctggcttcaggactgacccagcacagtcatagtaatggtggcaacagaggtgcttgtgtcactccagctccagctttatgttgctcagaacagagagagagactctgagagaaaataagggaaaagaacaagagtctctgcctgataatccagtgaattcttcaagatctagtctaagaccatgaaggcagttcctctatgagtcaacaagaaccacagtgttactgggtttggggtgcccccaaaagcagatacagcttagatcacaacacccaagtcctttcaaatatctggaaagccttcccaagaaggacagctacaaataagtccagatagtgaagaacacaataaataactaactcttcactgtgcacacaccaaagaacatctataagcatcaacaccacccaggaagacatgacctcaccaaataaactaaataaggtgctgctgaccaattctggagaaacagagatatgtgatctttcagaaagagaattcaaaatcgctgtgtgaggaaactcaaagaaattcaagataacccagagaaggaattcagaattctatcagatacatttaacaaagagattgaaataattaaaaacaactaagaagaaattctggagctgaaaaatgcaattggtatactgaagaatgcatcagagtcctttaatagcagaactgatcaagcataagaaatagcttgaagacaggctatttaaaaatacacagaggagacaaaagaaaaaggaataaaaaacaatgaagcacacctacaagatctagataggttataaaatcgtatttgcaaccctcggggtatcctcaaaccaaaaaacatgcaatggatgcacaaataataaaataaaatatagcctcaaaagggcaaaactaagagttattggccttaaagaggaagcagagaagtgataggggtaggaagtttactcaaagggataataacacagaacttcccaagcctagaaaaagatatcaatatccaagtacaaaaaggttatagaacaccaagcagatttaacccaaagaagactacctcaaggcatttaataatcaaactcccaaaggtcaaggataaagaagggaccctaaaagcagcaagaaaaaagaaacaaataatatacgacatgtctaatagcaggcttttcagtggaaaccttacaggccagaagagaatggcaagacatatttaaagtgctgaagaaaataaacatttaccctagaataaatattatgtctagtaatgtatccttgaaacacgaaggagagataaagactttcccacacaaacaaaagctgagggatttcaccaatgccaggcctatcctacaagaaatgctaaaggaagttcttcaatcagaaagaaaaggacattaatgagcaataaataatcacagaaagcaataaataatcactgataatagtaagtacacagaaaaacacagaatattataacatggtaactgtagtgtgtaaactcctcttatcctaagtagaaaaactaaacaatgaaccaataaaaaataataactacaacaacttttcaagacatagtacaataagacataaatagaaacaacaaaaagctaagaagcagagagatgaagttaaggtgtagagtttttattggttttctttttgctcctttgtttgtttatgcaaatagtgttaaggtaggaatgttaattaggtcaaccattgtgcaaagcagtgtgacaattcctcaaagagctaaaagcagaactatcattcaatccagcaatcccattactgggtatatacccagaggaatatgaatcattctaccataaacacacatgcatgcaaatgttcattgcagcattattcacaatagcaaggacatggaatcaacctaaatgcccatcaatgacagattgaataaagaaaatgtggtacatatacaccatggaatactacacagccataaaaaaagaacaagatcatgtattttgcaggaacatggatagagctggaggctacaatccctagcaaactaacacaggaacaaaaaactgaataccacatgttctcacttataagtgggagctaaattataagaatttatgaacacaaagaaggaaacaacagacactgggtatacctgagtggggagggtaggaagagggagaggagagaggagcagaaaagataactgttgtgtactgggcttaatacctgggtgatgaaataacattgggtgatgaaataatatgtacaaaaaacccttgtgacatgtatttacctatgtaacaaaccttcacatgtagccccaaacctaaaagaaaagttaaaaaaaaattatcaggttaaaataataggttataaaatagtatttgcaagcctcaggttaccctcaaaccaaaaaacgtacaatggatacaaaataataaaaagcaagaaactaaatcatgtgagcggagaaaattgccttcactagaggaacacaggaaggaaaaaaaagaaggaagagaacaccacaaaacaaccagaaaacacataacaaaatggcaggagtaagttcttatttatcaataataatatttaatgtaaatgaactaacctctccaatcaaaaaaacatacactggctgaatggatgagaaaataagaaccattgatctgctgcctacaagaaacacacctcacctatgaacacacaaattgactaaaaataaagggatggaaaaagatattccatgccagtggaaaccaataaaaagcaggagtcactatactttatcagacagatgtcaggagaaaaactatcagagacaaataaagtactatataatgattaaggggtcaatttagcaagagaacataaaaattttaaatatatatgcacccaacactggagcacctagatatataagtacaaaaaggttaatattagaggtaaagggagagagagtcctcaatacaataatagctggaaacttcgacaccacactttcagcattggacagatattccagacagaaaatccataaagaaacatcagaactaatctgcactacagatcaaatggatctgagatatttacagaacattttattcaacagctgcagaatacgcattattttcctcagcacatggataattcacaaggataaaccataggttaggtcacaaaacaagtcttaaaacattcagaaaattgaaatagtatcaagtatcttccctgaccacaatagaataaaactagaaattaaggagaagaataattttggaaactgtataaatacatggaaattaaacaatatgctcctgaatgatcaatgggtcagtaaagaaattaagaataaaatttaaaattttcttgaaaacaaatgataatgaaaacacaaaataccaaaacctgtgggatacagcaaaggaagtactatgggaattttatggctataagtgcttacatcacacaagaaaaaaacttcaaatgaaaaatctaataatgcatcttaagtatctagaaaagcaagaacaaactaaacccaaaaatagtagaagaaaataaataataaagatcaaagcagaaataaatgaaattgaaatgaaaaaatatacaaaagatcaatgaaaccaaaagttgtttttttgaaaagttaaacaaaattgacaaacctttagtcagactgacaaaaaaggagagaagatccaaataaagaaaatcagaaataaaaaaaaaaaagacattacaagtgatactgcagaaatccaaaggatcattagtggctactatgagtaactatataccaataaattggaaaatctagaactggacaaattcctagacacaacctaccaagactgaatcaagaagaaatccaaaacttgaacagaccaacaacaaataacaagatcaaagttgtaataaaaagtttcccactaaagaaaagcctggggcctgatggcttcactgatgaattctacaaaacatttaaggaagaattaaaaccaatcctattcaaactattctgaaaaataggaaaggaaggaatacttcaaaactcattctatgaggccaggattaccctgataacaaaatcagacaaagacacatgacaaacaccaccaccaccactaccaccaccaccaccaccaccaccaccaccaccaccactacgggccaatatctctgatgaatactgatgcaaaaatcttcaacaaaatactagtaaaccaaactcaacaatacatcagaaagatcattcatcatgatcaagtggaatttatccctgggatgcaaggatgtttcaacatatgcaaatcatccaatatgatacatcatatcaacaaaatgaaggataaaaaccacatgatcatttcaattgatgttgaaaattaattgaaaatttaccatcccttcataatacaaaccctcaaaaaactggggaaggaacatacctcaatgtaataaaagccacatacaccagacccacagctagtatcatactgaacaagaaaagactgaaagcctttcctctaagatttggaacatgacaatgataaccactgtcaccactgttattaaacatagtactggaagtcctagctagagcaaccagacaaagatgtaaagggcagtcaaattggaaaggaagaagtcaagttatatttgtttgcagaggacatgatcttatatttggaaaaaactaaagactccactaaaatatattattggaactaataaattcagtatggttgcaggacacaaaatcaacatacaaaaatgagtagtattttctatatgtcaacagtgaaaaatgggaaaaagaaatttaaaaagtaatcccatttacaatagccacaaataaatacctaggaattaaccaaagaagtgaaagataaatgtaataaaaattacaaaacactgatgaaagaaattgaagaggtcatcaaagaatggaaaaatattccatatttatggatcagaagaatcaatattgttaaaatgttcatactgcccaaagcaatttatagattctatgcaatccctatcacaataccaatgacattcttcacagaaatagaaaaaacaatcctaaaatgtatatagaaccacaaaagacctacaataggcaaagctatcctaagcaaaaagaataaaattggagaaatcacattacctgactgcaaattatactacagtgatacagtaaccaaaacagcaatatactatcattaaaaacagacgcatagatcaatggaacagaatggagaacccagaaacaatctacatacctacagtgaactcatttttgacaaaagtgccaagaacatacactgggggaaagacggtctcttcaataaatggtgctgagaaaagtgaatgtccatatgcagaaaaaggaaactaggtccttctcaccatatataaaaatcaaatcaaaatggattaaagacttaaatctaagacctcaaactattaaactactacaagaaaagataggggaaaatctctagcacattggtctgggcaaagatttcttgagcaataccttacaagtataggcaaccaaagaagaaacggacaaatgggatcacatcaagttaaaaagattctgcacagcaaaggatacaatcaataaagtgaagagacaaacaacagaatgggagacaatatttgcaaactatccatctgacaagagattataaccagaagatataaggagctcaaacaactctataggaaaaatataataatccatgcagggaccagccccacagggtcggtgggtctctccccatgtgcggtgacgagagagtgtagaaataaagactcaagacaaagagataaaagaaaagccagctgggcccgggggaccactaccaccaatgcgcagagaccggtagtggccccaaatgtctggctgcgctgttatttattggatacaaagcaaaaggggcagggtaaagagtgtgagtcatctccaatgataggtaaggtcacgtgggtcacgtgtccactggacagggggcccttccctgccttgcagccaaggcagagagagagaggagacaaagagaaagacagcttacaccattatttcagcatatcagagacttttagtactttcactaattttctgctgctatctagaaggcagagccaggtgtacaggatggaacatgaaggcggactaggagtgtgaccgttgaagcacagcatcacagggagacggttaggcctccggataactgcgggcaagcctgactaatatcaggccctccacaagaggtggaggagcagagtcttctctaaactcccccgggggaaaaggagactccctttcccagtctgctaagtagcggatgttgttccttgacacttttcgctaccactagaccacggtctgcctggcaacgggcatcttcccagacactggtgtcaccgctagaccaaggagcccttctggtggccctgtctgggcataacagaaggctcgcactcttgtcttctggtcacttctcactgcatcccctcagctcctatctctgtatggcctggtttttcctaggttatgattatagagcgaggattattataatattgggataaagagtaattactaccaactaatgattaatgatattcgcatataatcgtatctaagatctatatctggtataactattcttgttttatattttattatactggaacagctcatgtccttggtctcttgcctcggcacctgggtggcttgctgcccacaaatccaatcaaaaatgggcaaaatatttgaacagacatttctgaaaagaagatatacaaatggcatacaggcatatgaaaaagtgctcaacataattgatcatcagagaaatacaaatgaaaactacaatgagatataatctcgccccagtcaaaatggcttttagccataaggcaataacacatgctgataagaatgcagagaaaagggaaaccttgtaccctattggtggaaatgtaagttagtacaaccactaagcagaacagtttggaggttcctcaaaaaactaaaaatagagctatcatacaatccggcaatcccactgctggctatataccccaaagaaaaaaaatcagtgtatcaaagagtcatctgcactcccaagtttgttgcagtactattcacaatagccaagatttggaagcaacctaagtgatgaatggataaagaaaatgtagtacatatatatacaatggagtaccattcagctataaaaagactgagatctagtcatctgcaataacacggatgaaatgaagatcattatgttaagtgaaataagacaggcacagaagacaaacatcgcatgttctcacttatttgtggaatccaaaaatcaaaacaattggacttaatggacagagagagtagaaagatggttaccagaggctgaaaagagtagtgaggtggtgagggcaggaagaaggaggaaatggttaatgggtccaaaataaatagaaagaataaacaaaccctagtatgtgatagcacaacaggtttctatagtcaatagtaattcaactgtacattttaaaataactaagagtataataggattgtttgtaacacaaaggctgaatgcttgaggggacggataccacattctccaagatgtgcttatttcaccttgcatgccataccaaaacatctcatgtaccccaaaaatacatatacctaccatgtacccacaaaatttaaaattaaaaaaatgtttaatgtgaagaattttctatgtggggtaccatgtccatagtcttagtttttctactctaatattaatctcatataaccctatgcattatcccctgaaactaaaatttttactaggtcctagaggaatgaaaagaatcagaaattccctatctcaaggagttagtgaatactcaaatttccataatacacagcacagtcctctctatgagatagacacatttcttcctattcagagggaataagaaaacatttcatataagggatagaatttgagcctggatttttaaaatgcttgaactttcagtacactaaaatggaggtatgattggagagaattctaagtagtgggaggaattcaaagttgagtaaaggaaaagatacaactagttatgggaaacagaaaacaaccagttttgataatatttgggttatctacagtgtaatattggaagacacagcaggaaagactgtgaaagtcctcaaccacattgataaacagttaagtcagtaagtccatctctaaggtaaatgtgaaatattagcaatcaaaaaggaactggctcagcactttttacgtttatatagaaaataccagccaagttcaaatatggcaagctattagggatttttgttcctgggatttctgctaccttattaagcatgagagaaatcccaacattcacaaaatatgcatgaatcaacctaggcttttagttttagtttgaatgtctacatcaatcacaccacatatatctcgcttaaatataagcacaataatctcaatctccacttgccacatcataaatatgacattgaaaggcgttttttacagatcctgctgaatgtttggaggacatcagtaagaaggtgagaaacagctgttgtatctagattcagcagacacacatttgcacatagggcaatatttagaaaatgtcttcaattggcaattacttcctgagatcatgatgtcccctctgttcacccactgcttaaagaaggggtggaaagaaaaaaaatcgtcaaataagaaactatgagtacatgaaaatcagaaaatcataccatcatccaatcattaaaaatcaataatcttcaacacgaattccatgaaacactaaggattccactgaagtaacccaggatccccacttactccctgccccatccctttcaaacccatgttatctattttaatatttatttatgcctctgcttttataatttttttaaaacctatagcggatgaacatattgatgtagaaaaattatcttgacacttgtttcagttttctattgctgctataacaaattaccacaaacttcatggcttaaacaatacaaactggtcttatataaatggaaaagtatgaaatggatttcagtgggctaaaatcaaggtattgggaaggctgcattccattctggaagctctaagggagagtctatttcttttccttttccagtgtctagaagctgtccacactccttggctcataagccacttcctccatcctcaaagccagcaacaagtcaagtccttctcatatcacatctaatctctcacatttgctcttctgcctaggtcctccacttttaaggatccttgtgattacactggatctacctagacaatccaaaataatctctgtattttaaggtcaactgactagaaaccttaatttcatctacaacttaaattcccctttgccatgtaagttaacatattcacagatttccagaaattaggacatggatattgggaatggaggagaggggtgacattcttccagctactacaacactgaagtttcaaaaaggtatgtagaaaacaatagacagaatgtgcatttgattagatacatatatatttcttatttacaaatagaaaaaggtctagaaagatatgtaacaatatggttattactgggtggtgaaatgttttctatttccttttggggggagattatttgtattttctaatttttcttcaaaaaaattatttattttaaaagaaggcaaaatatgatttctaagttaaaatccaaagtatgaatagacactttgccaaaaaagatatacagatggcaaataagcatatgacatgacattcaacaacagtcattagggacacacaaatcaaaacaatgatacagtactatatacctattagaaaagcattaaaaaaccagtaacaggccaggcgcagtggcttacacctgtaatcccagcactttgggaggctgaggcgggcatatcacaaggtcaggagatcgagaccatcctggctaacacggtgaaacctcatctctactaaaaatacaaaaaaattagccaagcatggtggtaggcgcccatagtcccagctattcaggaggctgaggcaggagaatagcgtgaacccaggaggtgaagcttgcagtaagccaagatggcgccactcactgcactccagcctgagtgacagagactccgtctcaaaaaaaaaaaaacacaaaaaaccaacaacagcaacaacagcaggcgctataaaggacaaagactaaccaaaatccttatacactcctggtagaaatgcaaatggtacagtcagtttggaaaacagtgtggcagtttcctataaacacacacttacatttgacctggaaatctcactctgcactccaaagtagagtgaatcaaatgcaagtgaagttttaacatgctcaccaaaaacctatatgtgcatatgtttagcaactttattcatgactgcaaaaactgaaaatgatccccaatgcaattcaatagatgcctgagtaaacaaagggtggcacttccgtataatagaatattattcaacaattaaaaggaacaaactatgatttatgcaacaacatagataaataataaatgtattttgttaaatgaaagaaaccagatccaaaagcctggttgtattgtatatatacaaacctatgtattgtatgattccatttatatgacgttggaaaaaggcaaactatgaggataaaaaacagatctgtggctgccatgggttggagtgaaggaaagataaactatcaacaggtaccatgaggaaatttagtgaataatagaactgttctatagcgggggtggatacatgactgtctaaattcatcaaacccatagaactgtacaccaccaagagtaaagcttattgtttctaatttttttaattcaccacaatgtcagaggaagatgaaatgcaaactgtgacaaatgattctacctgtattacatgatacgtgtacacagagacataaatacacagatatagaaaaacagacacatgtgtgtatatatatatacgttagtaaacatacactcatgcatcacttaacaaagggatatgttctgagaaatgcatagttaggtgattttgttgtgtaaatgtcattgagtgtatttacacaaatctagatgttatagcctcctacacacctaggctatgctcctaggctacaaacctgaacagcatgttattgtactgaaaactataggcaattctaacacatggtaattgtgagtatatataagcatatctaaacatagaaaagatacagtaaaaatatggtataaaagattttttaaaatggtgtacctttatagagcatttatcacaaatggaacttgcagaaccataagtttccctgagtgtgtcagtgagtgagtggtgagtagatgtgaagagctaggacattattgtacactactgtagagtttataaacactgtacacttagggtacactaaatttatttgttaaagtatttctctcttcaataacaaattaaccgtagctttctttaacgtttttactttataaacttttacatttttctaacttttggacgcttttgtaatagcacttagcttaaaacacgaacaaaaaatatacaaaaaatgtgttgttaaatccttattctataaacgtttttctattaatttaactttttaaactttttgttaaaaacaaacacacgaacacatattacctaggcctacacaggatcaagatcatcaatatcactgtcttccacctccacatcttgtctcactagaaggtgttcaggggcaataatgcatggagctgtcatctcctatgataacaatgccttcttctggaataccttctggaggacctgcctgaggctgttttacacttagttttcttttaataactagaaagagtgtgcttaaaatactaagcatagtatacacgtaaaccagtaacataatcatttattatcattatcaagtattatatgctgtatatagttttatgtgctagctatacttttatacaagtggcagcacaacagatgatgtttacaccagcatcactataaacacatgagtaatgcactgtgctacaatgttatgacagctacaatgtcattacgtgataggaatttttcaggcaggaatttttctcataaaccatcatatatgtagtccatcattgacagaaatgtcattatgcagtgcatgactgtacaatactttctagctttgtccgatgagagaaccaagatgcagtgacactccagcagcaataagcacatttaacatccagatagtggtctctaaacaccattctctaggctgagcctggtggcctatgcctgtaatcccagcacattggaaggccaatgcagaagattacttgaagccaggagctcaagaccagacagggcaacaaagcaagaccctgttcctacaaaaaaaaaatttttttttaaactaggcatagaaccatgtgcctagagtcccagctacttgggaggctgaggtggaagaactgcttgggcctaggagttggaggctgaagtgaactatgaatgcaccactgcactccagcctgggtgacagggcaagaccctgactcagaataaataaactaaataaaataaaaataaataaatatgattctacaataaaagaaaccagggatctttagagaaatagttaattccaaggaaatcaagatggggaaaatatagatgagcctggagcatcttgtgttgctagaaagacaggtggtgctcaaaacaataagaatgagacatatctaaaaaacacaggtgtcaacctgaaggaattctcaatgaccaaagctggaacgatttgagaaacaaaataaataatattagtattgaatcactacctaaagaataaaataaatatccctaagtccttagtgatacaaaatttaaaattggataaatgaataaatgagcaagaaaggacaactaactctttcttacagaagaatttcaaattataaaggtaaaatgaatgaaataaatgaaaatcagcattagaacaccacaataataattgctacaggcaaggtccacaaatgcatgcttaaattagtgggtaaaagtttaaagaggtcatggatattttcatagcttcaaacaatctctgcccaagatacttattaattactatggtggttttaacatatgtccagaaatccctccatactcctcgtttcatggggtgaagcttaattcccatcctctttagagtgagcatacttactcagttgcttagttgtttgcttctaatgaatagtcaaagaaaggggaaaattgtaagttaacagagaaaaaacctggcaaacaccgcagtaactaaaagagcaagattagtatcactaagaagaagaaatactggtattatgtaccctctgaaatgatgtaaagagaaaggcacatcatatctgtggtaaacttcccaaaaatccataacttcagtctaaacataggaaaacactagacaaacccaaattgagggacgttccttggctagtattctttgaaactgtcaaggtcatgaaagaagaaaagagcaaggaattaccacatattagaagagactaaggaaatatgacaactaaatttaatgtggtatcctgtattagatcctgggacacaaaaaggacattggtagaaaagctggggaaatctgaataaaatctgcagttaattgtattatacaatatctctttcttagttctgataatcataccatagttatacaagattatattggggaagctggtgacacatatatgtaaagagtactatcttagcaactctaagtataaaattagtttgaaattaaaagtttaaaaaagcatttagctatatagattaaccttaaaaacatagaaacatggtatataattcaaaggacatcaattaaatgcaaagtgtaaacaaacttgcaagaatacatacatatatgtacataatattaatatattagaattgtgatttataagaaggagaaaggaataagagtaaagtacagggattaaaaggaataaagaaataaaatgagagaagacttgcatcaaccaatgatgataatgttctacgacatgagggaaatgattaattcaataataccttgcctattaggttaaaaaataagaaaaacctgaaaagtaaagaaaatagcattataaaatataaagccaaatcgaatttctccaaactcacagtaaaaaaacaaacaacccacttagaaatgggcaaaagacataaacagatatttcatcaaaaaggagatacagacgacaaataagcacatgaaaaaatgttcaatatcactagccattagggaaatgcaaattaagaccatgatgatatcactacatatctattccaacagttgaaataaaaagtagtagcaatattaaatgctagcaagaatgcaaagaaacattttgtaagagtgtgaaaatggtatagtcactttggaaaatagtttggcagtttcttaaggaactaaatatacactcaccataccacccagcaatcatactcctaaggatttatccttgagaaatgaagactatgtcctcacaacaacatgcacacaattgctcataatttgcaatagccaaaaactggaaagtaccaaaatgtctgacaacaggtgaatggttaaacaaacaggggtcagccacaccatggtatactacttggcaataaaaagaaatgaaaaattaacaaccataacgacttggatgactatcaagagcattatgctgacaaacaaaagacaatctcaaaaagtcaattactatatgatttcaattatataacattcttgaagtgacaaaattatagagacagaaaacagattagttgttgccagggtttaggaattggggggaagcaaagaagtaggtgtgactatcaaaaggtaacaagaagagatctttgcagcaatggaatatttctgtatcttgactgtggcggtggctatacaaatatattaatatatatgaaaaaatgacatagaatttatacacacacttcataccaatgtcgacttcctggttttgatattatactacagttatgcaagatgtaactaactcgggaagccgggtgaaggatataggagaccgctctctattatctttgcaacttcctgtatattgcttatcactaaaatgcttccaaataaaaagtttttgaatatcattatataagtttaatatcctctaccaattgcctccctcattcaatcgcttttctgtgttataaaaagaataagagaattttagagttgaaaagaaatcaactaacctagaaattgcaaaccagaacagaagcccataggctggatctggccagcagaatgtcttcaattggcagcaacaatacatttttttttaagtatcagtcttcagagggcgcgtatcagctgtagtttactagtttccactgctttataactttatactctgtgctccactcatttaaaatcctgtctaatccttaaagacttttgagtttgccaccctgactaatcttttacaatagtgtgaagcagaaatctgaagaggtaaaatgaaatgttcaaagccataggcttctgtttcccagccagtgctctgcccaaattttggagttatctcatgtcctgttggtcattctctcattctgagtagatacatagatctaagttttcactccttgctaccacttatctcaactgtcttgaatacgacaccaaccatgccaagcctctttttaaaataggaatacttgcctttcccaactggcagaactactggaataatcaactaagatagtccatgtaaaatcactatgtaaagtcctttaaaaatgaagactattaggatattaaatatataaatatatgtgtgtatattatatattatatataacatcatattataatatatatttgccattttatctttgaagcagctggtactctggtctgtgatgttctgtttggcctttgcagatacagagtaagtcatcaaatatatgtgtataattatctatcggtgtaatcatagaaagtcttcaataagatcatcatattgcaatggattataggtccaagctagggattatagcacaaggaaggggaacaagtaaaatggaaatagtctctgggaggcttggaatcaatcagtagaaagggaaaattaatgttaagagtgaaaggaaagaagtcagctctttaatccaactgtctcacttctgacctggccaaacaaaaataaccagagtcagggctgtatatttactcacccttaattattctttgaaagtgattttcaagtacaaatgtctaccttcatcccttaaaactatatgtaactgctgttgcctgtataatattcactcttccataatttttctatgattatccagatagattattgattacatacacacatatttgtatacatagaccttcataggtacagttttctttttgtagaggtcgggtaatgctacacagataattcttcaaattgcatttctcattttaaaatatatcacaggcatctttccatatcagcacatatagttctactgcattctttttaatagttgtatgtatttcaattgaatggatataccaaaatttacctaatcgttactctattaatgcacatttaattatttctaatattttgtcattttaaagtatgctataaagaaaatgtatattaatatactcatggtacttttctatgaaatagagtcctagatttaggattattaagagtgtatctcttaatttgtataccaatttatattctcaccagtagagtccattttgacacatgttcaccaacactttgtcttctatattcgtatccattttcttctaatctgtttttcatcttttaactttacatatcattttaactttacatatcattttgtaaaactgaagtgtacttttatgcaatcaaatctgccgctcatttatgtcattatttcaatgttttatgacttgaatatttatacccaaaaataaaaaaaacttccacatctctatagtatagtaacatctctatagttacaaaaggaactctatttagattcttaattcatctggaatttatatgtgatatgaaatagaaaataaaatctaaatttacattcttaaaattgcacagccaagccaggtgcagtggctcacgcctgtaatcccagcactttgggaggccgaggcgagcggatcacaagatcaggagatcgagaccatcctggctaacacagtgaaaccctgtctctacgaaaaatacaaaaaaattagccaggtgtggtggcgggtgcctatagtcccagctactccggaggccgaggcaggagaatggcatgaacctgggaggcggagcttgtagtgagtagagatcgcgccacttcactccagcctgagtgacatagcgagactccatctcaaaaaaaaaaaaaaattgcatagtcaagtattcagcacattgatctgaaatgtcacaaccttttttatgtactaattcccaaaggaagttccaagatggcttactagaagtagctagtgcacactgctctcacagagaacagagtggtgagtaaacaggctcttcaagtggatcatccaggaggccacattgagattcataaaggatgcaacagcaacccacaaggagcagagaggagcgaggcagaacagctgcccacccaggattgtcagcagaaccaggggaggctccctacctctagggaagggtgaatgagtgagagcccctggggacccatacttctgccatggatctttgcaatcttgggtatgggcaatcctcccaacccccaatccctctgggactccaaactaacacagagagctgcctggagtctgaacagaactacccactcaaacccaggttgagccccacaggccttggactcctgaacaccccagcaccagcttccctagcctcaccaacaacagaggccaggcactctcatgtgcccttagggtaggggccgcatccatagtgctgaggagtgcacggattgcaggcctcacctctgctgcacctcaccaggaacagccaactggcctgggcccccagtgtagtcatcccacccacacctaagcactctggccctgcatttctctgggatggagctcacagagataaccgacaggcccgttgtgattgcctctatagtccctgctaccctgaggctgggaagggagctaagagcctgagaacagtcacaagcctccaacatgctgcagctaccatatgaaaagacagctggacagttttccatatggttcactgctcctcacacatattacatacacacatatttgtacacacagaccttcacatgtatagtttttaattttaggtataaaaacccaagtcatagccaccacactcccacctgatcacttcagttcagtgtttctctggggtggaagtccctagagacaactggcaggccctctcctattgcttctgccctggtccctgcccttcctcccaacaggctagggaggaaaccaagagcctgactactttcctgcaccgacagcacaccacgacagccgtcctatggagaagaggccagactgtgttccatgtaaactcctgacccctgccccacccttggccagacaaggcgtccctggcttgggcccacagcacagctgcccacccacagctgattatcccaactggcagaagcagctctgcatttctctggggtggaattcccagaggcatttctctggggtggagttcccagacagtccctctgccataccaaccactacggtccccattcctgctgcccccaatataagggggaacaaaaagcctgagttcaccacagggctgcagtgcaaagcttgggagtgctgagccaagatctatgaccagcactggagccggagagcagtgcacactcagagcacaaaaaagggtgagtctggctggcttgtggactgccgtgggagcagtgcatgcctccctcggaagggcccaccgagaaaggtgtggcttatctctgccactgcctctgccagagagagccccgtggcccctcacctaacattcaacaaaagaaatgaaggtgcagtcccagtgatcagaggggactctccagaggcctaggagtggacctgctgagggggtcacctctctccacactgcaatacagagcagggctgcaaatgtcagaaactataaaagagccacaagactaagtctattggccttaagcgccatctactggatcacagtccaaacaacaccaccaaaaatattttgctaatatacatccctgtgaaactaaggacaagaattcagccacaaacagaccccacacagagccttgacccactaaaaacatccagaaacgaagccaactgactatactcaacttacaccacagttaaagggacaccgaccctccgaaataagaaaaaatcagcgtaagaactctggcaattcaaaaagccagtgtccccttccctccaaataagttcactagctccccaacaatggttcttaaacagctggaggccgggcatggtggctcatgtctgtaatcccagcactttgggaggccaaggcgggtggatcatgaggtcaggagatcgagaccatcctggctaacacggtgaaaccccatctctactaaaaatacaaaaaattagctgggcgtggtggtgggcacctgtagttccagctactagggaggctgaggcaggagaatggcatgaatctgggacccaggaggaggagcttgcagtgagctgagattgcaccactgcattccagcctgggcgacagagtgagactccatctcataaaaacaaacaaacaaacaaacaaaaacagttggatgtgaatgaaatgacaaacatataattcagaatctggatggcaaggaagctcatcaagattcaggagaaagttgaaacccaatccaaggaatgcagtaaaatgatccaagagctgaaagatacaatagtaattttaacaaagaaccaaactgaacttctagagctgaaaaattcactacaagaattttgtaatacaatcagaagcattaatagtagaatagaccaaactgaggaaagaatcacagctcaaagactggctcttcaaatcaacccaatcagataaaaataaagaagaaagaatttttaaaaataaaaaaaactccaagaaatatgagattctgtaaagagaccaaatctatgattcactggcattcctgagagaggagagagataaacaacttggaaaatatatttgagaatacagtccacgaaaatttccctaatcttcttggagaagttggtatgcaaatccaagaaatacaaaggaccctggctagatactatacaatatgactatccctaaggcacatagtcatcagattcactacaaaataaaaaatcttaaaggcagctagagagaagagtcaagtcacttacagaggaaaccccatcaggctaacaggagacttctcagcagaaaccttaaaagccagaagaaatcaggggacctctgtttagtgttcctaaagaaaagaaattccaagtaagatttcatatcctgccaaactaagcttgaaatgtgaaatagaaataaaatccttctcagacaagcaaacactgagagaaatcatttcaattagaccagccttacaagaggtccttaagggcatgctaaacatggaatcaaaataacaacacctgctaccacataaacacacttaagcacatatgccacaggcactataaagcaatcacacaatcaagctgacaaaacaaccagctaacgacataatggcagaatcaaaatctcacatttcaaaagtaacgctgaatgtaaatgaactgaacaccccacttaaaaggcataaagtggcaagctgaataagaagacaagacccaaccatttgctgtcttcaaaagatccatctcacatgtaacaacacccacaggctcaaagtaaaaagatggagaaacatttaccatgcaaacagaaaacaaacaaacaaaaaaaatagcaggaattgttattcttatatcagataaaataagttttaaaccagtataaaataacaagggcaaagaagggcattacataatgataaagactacaagcacacaagaagacttaactatcctaaaatatatacacacttacattggggcactcagattcataaaacaagttcttcttggcccacaaaaagacttaagacaaccacacaacaatagtgggagacttcaacacctcactgatagcattagacagatcaaggcagaaaacttacaaagaaactatggactcaaatgcaacacttaaccaattagacctaatagacatctacagaacactccacccaacaatgacagaatatacattcttcccatatgcacacagaacatattctaagatgaaccacatgcacagtcataaaccaaacttcaataaaatcaaaaaaattgaaataatatcaaccatactcttggaccacagtgcaataaaaacaaaaaccaaagatatctcaaaactacacaaatacatggaaatttaacaatttgctcccaaataattcctgtgtaagcactgaaattaaggcagagattaaaaaattcattgaaattaatgaaattaggaacaaaacatgccaacatctctggaatgcagctaaaacagtataagaggaaatgcctttgagaagttagaaagatctcaaattaacaatcgaacattgcacctaaaggaactagaagaaaaaagaacaaaccaaccctaaagctagcagttcctctctaacaataattacagaagaaccaaatgaaattgagatgcaaaaatccatatgaaaaaatcaatgaagacaagaattcattctccaaaaaaataaacaagattaacatatggctagctagattagcaatgaaaaaagagaagatccaagtaagtacaataagaaaagacagcaatgactttacaactgatcccatagaaatacaaaatatcctcagagaatactatgaacaactctatacacacaaattagaaaatctagaggacatgaataaatttctggaatcacacaatctgtcaagattgactcaggaagagattgaaaccctgaatggaccaatatcaaactctgaaattaaatcagtaatttaaaaaacctaccaaccaaaaatagccctggaacagatggattcacagatgaattctatcagatgtacaaagaagaactggtagcaatcctactgaaactattccaaaaaattgaagaggagaggctcctccctaacttattttaggaagccaacatcagcctaataccaaagcctggcaggaacacagtgaaaaaataaaagtttaggccaatatccctgatgacacaaaaatcctcaatgacatactaacaaactgaatccagcagcacattaaaaagtcaatataccagaatcaagtaagctttaattccttggatgcaaggctggttcaacatatgcaaatcaataaatgtgattcaccacattaacagaattaaaagcaaaaaccatatgattacttcaataaatacagaaaaagcttttgattaaatccaaaatgtctttatgataaaaaccctcaacaaactaagcactgaaggaacatacctcaaaatagtaagagctatataacaaaccctcagccaacatcatactgaaaaggcaaaaactggaagcattccccttgataactggaataagacaacaatgtccactctcactactgttattcaacatagtactggaagtgctagccagtgcaatcaggcaagaaaaaaagaaataaaacacaaataggaaaagaagacatcaaactctctctctttgctgccgatatgattctatacctagaaaaccctaaagactccccaaaaggctactataaaagatcaatgattttaataaggtttcaggatacaaaatcaatatacacaaatcagtagcatttccaaacaccaataatgtccatgctgagggtgaaattgagaacacaatcccatttacaacagccacaaagaaaatgaaatacctaggaatatagctaactaagggggtgaaagatctccacaaggataactacaaaacactgctgaaataaatcaaataaatgaaaaaacattccatgctctggatggaaagaatcaatatcattaaaatggacatactgcccaaaggaatctgcagattcagtgctatacctatcaaactaccagcatcattcttcacaaaattagaaaaagatattctaaaattcatatggaataacaacaaaaatgaacccaaatagccaaagcaatcctaagcacaaagaacaaatgtggagacagcatgctacccaacttcaaatgatattatagggctactgtaaccaaaacagcatggaactggtataaaaaacagacacacagatccatgaaacagagtagcaaactcaaaaatacagccacatatttacaaccatctgatctttgacaaggctgacaaaaacaagcaatggggaaaggaactcctatttgattaatggtgctgggataactggctatccatatgcagaagaataaaactagacccttacctttcaccatatacaaaaattaacctaagatggattaaaaatgtaaatggaaaatctcaaactataaaaatcctagaagaaaacctaggaaatgcacttttcaatattggtctaggcaaagaatttttggctaagtccccaaaagcaattgcaacataaacaaaaattgatgagtgggacctaattaaacagaagagcttctgcacagcaaaagaaactattactaaagagacaacctacacgataggagaaaatattcacaaactttgcatatgccaaggtctaatagccagaatctataagggacttaaatcaacaagcagctcttttctggctggaaccatggatggtgtagaagagaagaagaagacggttcctgctgtgccagaaacccttaggaaaaagtgaaggaatttcacagagctgaagatcaagtgcctgagaaagaagtttgcccaaaggatgcttcaaaaggcaagaaggaagcttatctacaaaaaagcaaagcactatcacaaggaatataggcagatgtacagaactgaaatttgaatggcgaggatggcaagaaaagctggcaactttaatgtaccttcagaacccaaactggcgtttgtcctcaggatcagaggtatcgatggtgttagcccaaaggtccgaaagatgtttccgtttctttgccttcatcaagtcttcaatgaaacctttgcgaagctcaacaaggctgcaattaatatgctgtggactatagaaccatatattgcatgggggtacccaaatatgaagtcagtaaatgaactaatctacaagcgtgcttatggcaaaatcaataagaagcaaattgctttgacagataaccctttgattgcttgatctctcggtaaatatggcatcatctgcacggaggatctgattcatgagatctatactattggaaaatgcttcaaagaagcaaataacttcctgtggcccttcaaagtatcttctccacaaggtggaatgaagaaaaagaccacccattttatttttctaagctggtcagttaataaatagtacctgctctcaaactgaaaaaaaaaaaataagcaagcaaaaacaatcccattcaaaaaggggcaaaggacattaacagacacttctcaaaagaagacatacaagtggccaagaaacatatgaaaacatgctcactgtcactaatcattagagaaatgcaaatcaaaaccacagtgagataccatctcaaagcagtcagaatggctatttttaaaaagtcaaaaaaacaagatatattggtgaggctgtagagaaaagggggtgcttatacactgtttttgggaatgtaagttagttcaaccactgtggcaagcagtttagaggtttctcaaataacttaaaacagagctaccattcaaccccacaatcccattactaggtatatacccaaaggaaaatagatcattatacaaaaagacacatgtacttctatgttcatcactgtgctattgagaatagcaaagtcctggaatcaacctaggtatccatcagtggtggactagataaagaaaatatggtacatatacaccatggcatattatgcagctataaaaaagaatcaaatcctgttacttgcagcaacatggatggagctggaggccataatcctaagtgaactaacacaggaacagaaaaccaagaaccatatattttcacttataagtgggagctaaacattgagcacacatggacataaacatgggaaaaataaacactgtagactactagaggagggaagaacggagaagggcttggcttgaaaaatctgcctgttgggtactatgtgtactacctggatgcaatatacccatacaagaaatctgcacatgtactccctatatctaaagtaaaagttgaagttaaaagaaattcccatatattttatagttcttttctatactctatgccattgatcttttcatttattccagtgttttaaaacattagcattacaacataatattttctaaaaataagcaaagagaaagggaacagaaaaaatatttgaagaaacaggggctgaaagtatctccaaaacgataaaatataaaaactaaatattgaaaaagctcaagaaccccaagtaagataaacatcaagagatccaaacctagtatcacagtcaaattttgacagacaaaggcaaagtaaacttttgaaagcaagagaaaaactcttaattatacacagaagaataacaatataattaaaggctagcttctagttagaaacagtagagaacagagggcagtagactgacatattcaaagtacaagggaaaaaaaacaacttgtctaccaaagtttctagctccagcaaaagtatactacaaatgcaagggtataataaagatataccagataaataattattaacaaataataattaaaaggattttatcaaataaaaaacatttgctcttcaaaaaacaacatttagaaaagtttaaaaacaagctatagaccaggagaaaatattttttgcaaattgcttatctaataaaggacttctacccagaatatataatgaactctgacaacttaataataaaaatgaacagtccaattaaaaatgggcagaggaactgaacagacatttcactatatataaatggctaataagcacatgaaaatatagagaacatcaccagtcattaaggaaatgtaagctgggcacagtggctgaggcctataattccagcactttgggaggccaaggcaggaagattgcttcaggccagaaatttaagaccagcctgagcaacatagtgagacctcatctctacaaaaaaagtgttttaaattagtcaggcatggtgacatgcatctgtaatcccagttacttgggaggctgaagtgagaggatcacctgagcccaggagtctgaggctgtagtggggtatgactgcaccactggactcaagcctagacaaaagagtgagactctgtctcaaaaaaaaaaaacccctaaaacttgaaaagataacaagtgttggtaagaatgtggagaaaagggagcctttgtacactactggtgggaatataaattgatacagccattatggaaaacagtatggatattcctctaaaaactgaagatagaactaccatatgatccaacaatcctatttctgggtatatatacaaaggatatgaattatgtatgtcaaagagataactgctctctcatattcacaataacgctgcaataaacgtggaattactgcaataagttatggaatcaacctaagtgtctatcagcctaagtatccatcaaccaatggacaccaagaaaatgtggtatatatacacaatagaaaaaattagccatttaaaagaaggaaattatgtcatttgggacaccatgggtgaacctggaggtcattagtataaatgaaataagccaggcatgggaagacaaattccacatgaaatctaaaacaatcgaactcagggaagcagagagcagactggtggttaccaaaggctgcagagtagggataataaggagatgttagtcaaacggtacaatgtttaagttacacagcagaaataaataacaaatatttgaggtttggatatgttaattagcttgattcaatcgtgtgtgtgtgtgtgtgtgtatggaaaaaatatcataccatcattttgtaccccataaatatatacagttatcatttgttaatatccaataaaaaagcacaaagtgaacaattcagtgaaaaaaatatatatcactggtgaaaccccgtctctgctaaaaagacagaaaaatacaaaaaaattagcagggcatggtggcatgcacctgtagtgccagctacttgggaggctgaggcaggagaatggcatgaacccaggaggcagtgattgcagtgagccgagatcgcgccactgcactccagcctgggcgacagagtgcaatatttgctttactgcaatggtctggaacagaacctgcaatatttccaaaatatccctgtaaaatattctccatttttcccatgcagcattgatttagcacataaacaaaaaaaagaaagacctataaataataacttacccaatactctattcagggcattcatcagtctgtgccaaatggtacagaaatccccaggacacagagttcagggcaggcaaagaagctagtaattgagataggaaatccaggagaagaaaaagccatagaaaagggagttaccagaactaagcataaattgtaagcatacagttgtaatctaagtataaaatctaagtataaactaacttccaaactgtgagactccaaaaagtctggtaaagcaacagttggaaagctgaaaagtctgaacagaggtttcagctgctacctaattcagggagagtgtgttttaagtttgaatcctgtcaagttaaagagttttgataaacatctttgattctccagtgtgtctgcagaaagtagtaatgccataggagtaaagactatgtctcaggactatagattcacactaagaataaaagaaaaatgaaaacagacctgctctagaaaagtgtaaaataaagtctacactagtttaaggtgatcagccaataactatgctgtctgcttgaaattaaaaaaaaaaaatcactctttagggaacaagaacaaaatccagattctccagggtatatcaaatataatttccagttacaataaaaattactctacagggtaataaaaatgtgacccataattaaaagaaaaagcagtcaatacaaagaaaccccaaactgacacagacgttacaaatacagacaagaactttaaagatgatattataaacataatcaaggactataggaaagaatgatcatgatgaatgaaaagatggaaaatctaagtaaaaaagattataaaaaataaccaagtggaaactctagaaatgaaaagtacaacatgtgaaataaaaaagtaaatagatgagattaatagaagactgaagccatccccaagaaaaggtcaccaatttgaaaacagaacaatagaacaaccttaaagaccacagagaaaaaaagacaggacaaaatgaatagagtttcaatagagttaacaatatcaaatagttggccatatgtgtaattagaatctcaaaaagagaaaagtatgaaattgtggggggaaattatgaaaaaaaaatggatgaaaacttcccaaatttgatttaaaaacattgacttttagatccaagaagctcaataaaccaaattaggaaaaacataaagagaaccacacacagcacatagtaaaatagccaaaccaaaggtaataagaaaatcttgacagcagccagagcaaaatgacacatcacatataaaggaggaatgatgcaaaggaaaactgactcctcactgtaaagaagaaaaggccaagaggaaagtaagacatttaaaaaataaaaagcaaaaactatcaacttagaattctatagcttggtaagatacccttcaaaaatgaaagtgaaataaagacatctccatatgaacaaatgcagagaggatttatcttgaaaaaacacacacttcatgccaaagaagttatctggtgaagagaaataataccagatggaaattcaaacatataaagagaaataaaggggactggaaatgataaatatatagataattttaacagatggtattttccatcttttattaatttcttgaaaaaaaaacaaactgcctatatatacttaacactactaaactatacacttaaaaatggttatgatcataaattttataatttatttttaccacaataaaaattggtagtttaatgaaaaaattataatattatattgtggggattataatatatgtaaatgtaaaatacatgacaacagtaccaaaaaggatgggtgagaagttaaataaaattatgccgttgcaaaacttttccattgtatggaagtagtataatattaactctaagtagattgtgataagttgaagacccatattgtaatctctagagcaaccactaaaaaacagtacaaaaagttatagctaaaaagacattagaagaattaaaataaaacatttaaagatttgattagcccaaaataaagcaggaatttaaaaaacagaagaaaaacaaaacagacaggacaaaggaaacaacaaaacgacacctagaatcccacttccaatcatgttggtactacaccagccctcctgacataagcaactataaacttgaacaaaatatttgctgaaaccattttcagggagtgggcaatagataggacatgattacaacccttgaaagaaaggaaactaatgatgtgagcatctagctcttactggacacaatttcctgaattaagtacagagagttacagtcttttttttttttttttttttttttttttgagacagagtcatgctctgtcatcaggctggagtgcagtggtacaatcttggttcactgcaacctccacctcctgggttcaagcaattctcttgcctcagcctcccgaatgctgggactacaggtgcacgctgccacgcccagataattttttttttttttgtattttagtagagatggagtttcaccatgttgctcaggctggtctcgaactcccgagctcaggcaatctgcccgcctcggcctcccaaagtgctaggattataggcgtgagccactgtgcctggtcaagagttgcagtcttagcagatcaaagtgatcccactgacctgaggcagcagaaattagagttcaggctggtgaaagtcactgtaatctacgagacaagacatcagagaaaaggtggctatgaagagaagggagacccaggagtttacatggaaaattgcatgtgattcctaacttaattcacagttagatagtgctaggtttatcagatagcagatattacagagttgagaagggaacagagatattagaagaaaagcaatgttagagtaaaagcagagttcctggccctatcagaacagagcgatcttgttaataactttaataacactgctggcattcagttgagacatcaaaatgctacactatagaagtaaaagccaagctctagtttagatctcccctaaatccacactaacaaggtctgaaaccaagtactgatgagatccacaacagagacacagtttgcaagttaagtcctattaaaatagagggacctgaagaaacacctcaagatcacagatcttccacagatctgtactaacaaagcataaaaccaagcccacaatagtttaaggtgaccacccagtaactgaattgcctgttaaaataagaatcaatactattcagaggaagataatggaatccaactactctacaatatttattgttttttgtttgtttgttcgtttttgagacggagtctcgcactgtggcccaggctggagtgcagttgtgtaatcttggctcactgcaacctccgcctcttgggttcaaacgattctcctgcctcagcctcttgagtagctgggattacaggcacccagcaccatgcccagctaattttttgaatttttttagtagagacagggttttactatgttggccaggctggtctcaaactcctgaccttgtgatctgcccgcctcagcctctcaaagtgctgggattacaagtgtgagccactgtgcccggcctactctacaatatttttaattgtaatgtcggtattcaattaaaaattcaccagatacataagaaacatataccagctatatatggaaaatgttatccatagtcaaaaataaataaataaaccaaaaaagcattttaattggtcaacagaaaccaaatcagaaatggcccagatgttggacttagcagacaaagacattcgagcagctattgtaaatatgtaaagaattaaaggaaaatgtagttttagtaagttaagagattaacagtggagaaatggcaactaaatacacatacaagggaccaaataaaatactagaactggaattaaaaactcactagatgggcttaaaagcaggttgtagaagaaagagaagtgagcttgaggacaagtcaataaaaataatacactttgaagaagagagggaagaaattattggaaaatataaaagcctcacggatatttggaacaatataaaatgacctaatataattgagtcctgaaggaaactggagctgataaaatattggaaaaaataacggccaaaaatttcccaattttggtgaaaaacacccactgtaaaccttaaaatccaaagactgaaactcacaagtatgttatcttaccacaaaattaaattgaaaatcaataatactgagatatctagataatctcctagtagttacaaattaaataacatatttctaaataacccatgggtcagggaagaaatcagaagaaaaattagaatgtatttctaactgaataataataacataatgtatcaaaatttgtgggatgcagccagaacagtgtttgaagaagggaacttacagctttaagcgcctatattagagacaagaaaaatatttaaaatcaattatctaaatctccaccttaacaagctagagaaggaagggcaaattaaatccaaagtaagtagtaagacaggaataataaagatcagagttgaaatcagcaaacaatagaacaaattaataaaatccaaagtttttcttttaaagaattaataaaactaataagcacctagcaagaataaggaaaaagactttaagaacacaaattaacaatatcaggaataaaagcagacatcactacagatcctatagacattaaaagaacaatatggaactattataaacaactttatggcaaaacatttggtaacttaaatgaaatgaacaaattcctttaaaaaaaaactacaacttaacaaaattaactcatgaaaaaacagatctgaatattcccatacatattagagaaactaaatatataataaaaatttcccaaagagaaaacttcaggtgcaattgggttcactggtaaattcaaccttgaaggaaggcttaacatcaatagtacacaaatgctttctgaaaataaaggagaaaagaatgctttcacctcattttatgagactgcttaagcctgatgcaaaaatctgacaagctgttaatctgagaagaaaaaaaggttataaaccaatagcccaaatcctcaactaagttctgggaagggtggtcttttcaacaaatgttgctggaacaattgaataaacataagggaaaagtgaatattaatctccctaaaaattagttgatgtgaaatggatcataaacttcatcgtaagagctaaagctattacatgtgtagaagaaaacaaaggagaaaaaattttatgcccttgggagtagacaacaatttcttaaatgggacacagagagcattaaccataaaataaaattttgataaactggattttatcataatcaaaactttctactctataaaactgaaaacaagttagaagttaacatgagaaatcatatatcaattgtaggatattcatacaatggaaaacaacccagaaattttttaagtgaactactgatacatacagcaaagtagatgagtattgagaacgttaggttaagcttaaacaagaaacaaaagagtacgtatgaagtatatgaacaggtgaaataatctatagtgacaggttgcctttgggaggtgaggatttgctggaaagaaatgataaggggactttctgggtgatgaaaatgttctagatcttgactgaggtggtggttacataggtgtataattttatcaaaactaatcaaattgtacatgtaagatgtttgcattttaccacatataaattttacttcaattttttaaagttacaatatgggaaaaactttcagttcctaccaatttatgtaattttgtatctagatttcagtaagtaccaagcactaaataaaataacagcaagtgactcatgtgccttacctgaaccaaactacagaccataacatagctaaaatgaaagattctaaaatcctcccatttaatactctacagattaggaaaggtatattcagaatttgtttgtgaatatacacaaaaggagggtaggcaacagcatgggatttgatctgtcatctgcttcttcccttaaccaccgcccaacaatgctaaacttccaagaaaaacccacctgacctctgtggagatcaaaaaatgcctataagcttttcagacattgccaccataagttggggataactccacactcagtttgtcaacaagacaacaaccaggtccaatccagaagcagttgcttcctcagtagacccatcaagttcattcaagtcaggaagactgacctttcccaacattaacccaggattctaatcaagctgacatggtgatgaacttattttgtccagctggctgcaaaaatacacgcatgaattctttctgttcactctcatgctatcctttcccgcccctcttcctgtttcttttcttttcattcatgcacaaacagtcacattgtcttacaagacaagtgaacgctgaatcttatgggttaaaaaaaaacagatgtcttccaattttccttcgcaaaaccatattttatattgggttcttctatggatttatagccagtgaagggatgttactacattagctcatggaggggaatgataaaaactgtaaaggaagagtcagacaaggcaaagagaagctatccagaaggctgcaattggagaagcatgacaaatgggcagcacagttttagagggttccggcagaaaggcagattgcctgactgggagagattctccacagctggagcatcacacacaccatctggaattttttaaatctgctttccccaggtgatctgattctcagagtgccagtagagatgagaaaaggggggaattgtatagctcaaaacagcttcaaatgttccccaaattagttaatgaaatcttgtttgaatcagtttcagcttctcctccaaactgagcctctagttttgtgttgtcacttccatttcctcacaaagacctgaatgtttggagtctcacccctaaacgtttcctgtaccaaggagcaaaacaggattcccagcatggtagccaaaaatggcactcaaacttttggatctgatccaaatttcccaataccagccaacaaagcttcattttcatattcactcctcttgactagtcttagcacttcgtttaggtattgccaaatggagagcctacatactgagatcctcagctctttccaagatgatccaaactctatattttaagcagtaaaagaaaatatgattttaaaaactaagagcaaccagtaactgtcataataatgaaagactttgatttttctttttttcacaaacatatatgtgtttgtgaatttgaaggtggagttgggtggggatgtgtgaaagagaaagaagaatagagcttacttggaaatgggggcaagggaagaaataaaaggtaacaggaaagaaattctgcctcagtctgctacccacctttttggaggggagatagtaattattttaggctttgtgagccatatgggctctgttacaactattcaactttgctgttgtagcataaaagcaaccatagacaatatgtaaatgaatgagcatggctgtgttccaatttatgaatactgaaatttggatttcatatacttttcacatgtcatgaaatattatccttcctttgatttttttcaatcatttaaaaatgttaaaaccattctcagtttgcagaccatactaaaacaggaagcaggccagatttggcccatgggccatagtttaccaatccttgtaacataccagtaaagaccattatacaagtttcagctttagaattccacaatggttgcagtaagagtcttacatggtatcttacccagaatagatttttttaagtgttcaattctactaagaagaactgtgaatttttcgctctcaggatcagcagatgtctggaagtctaaataaatatatatctgaaataaatttcttcactactttcaaactttcaaaaattctctacttgcccattctttttatacattttctttcattctcattggcataaagaaaaagtagtctcttggtgatcatgggcattttcaagtatttactagtgtttattttggtattaataaaggctaatacaggtaccagtacctttcttttctctctccttttttaaataaaaatattaacatgtccccccaaataaatcagcatatctatcttaatagatttattttctgggaacgacaaatgcatgtcattttcaaagagaaaaacagttaggcacaaaaaaatacacaagagcagcacaaaatttataactgttaagtgtttgcaaatatttttaacagttctcactaaagggactacacatagataaagataccaggacataagctgatagagctaataaatatggtcttgctcttaaaaaatgtacagtctagttgtagaagcataaaagacatacaaaagagtaatataataactgcaaatacttcacataattcaacatatatgaaaatttataacaatataaaattctatattgacataataaaaataaaaacctacagaaattgtaattagaaatatgccataaaaagcaataatataatacaacatctccccacacacacacacacacaaataaacctatggatataaaagaataattattcaaaaagaaaaagaggacaatcatttaaaatatagtaaaatatgggaaataaataacaaaagacataagaaaaggataatatgggcataaaagaatgtccttgaggcatatatttggggacatatttttatgtgtaatgtcaactatgtattaaacaatttaagcttagaagaggtggagcaagatggccaaatagaatctttcactgattgtcctccacacaagaacactaaatttaacaactatctacccaaaaaaacaccttcataaaaaacaaaaataggctgggcgcagtggctcatgcctgcaatcccagcactttgggagactgaggtgggcagatcacctgaagtcaggaggttgggaccagcctgaccaacatggagaaaccctgtctctactaaaaatacaaaattagccaggcgtggtggtgcatgcctataatcccagctactcaggaggctgaggcaggagaatcacttgaaccagggaagcagaggttgaggtaagctgagattgggccattgcgctccagcctgggcaataagagcgaaactctgtctcaaaaaaaaaaaaaaaaaaaaaaaaaaggtgagcaatctaagtgtccatcaacagactaatggataaagaaaatgtggtacatacatacaatagagtactatttagccataaaaagaatgagatcctgtcatttgcaaaaacacaaatggaactggaggtcattaggtgaaataaaccaggaacagaaaaatgaactttgcatgttctcacttacttgtgcgaactaaaaattaaaacaaatgaattcatggagatagagagtagaatgatggttatcagaggctgggaatggcagttgttgggggtaagagagtcaggatagttaataaaaatttaaattttttttttatttaaaaaagtttaagctcacagggtttaaaattttacagaaaaatgggtgagggagacaacaataaagaattcaaggtaattaattatatgctggcaggtacacatgataattaatccaggaatccaaagaaggctgtggactagggtggtggtttacagaggaccatggtcctgcatagagctctgcagaaaagaaatccagatgttgagaggaagaggtggtgcatcagatctaggactccaactctagtgtcccatgtcccagatgacccagtatgcatccattgtaacacacctcccctacaccaagtcctcaagtgatgtgtgttcatttctgttactctctcaaaattttccaaaagttgcctttcaatatctgaatttataattttaggtttacttagaagactaaatgtagctggggtttgttttcatttgttttttatcagtatagcaggacagttaatacagtttctagcataagacaaatctatgcttaaattccagcactgccattattgattttatggctttaagtaacattttacctgtaaagtatgtagtagatgtcctggaatataataaaaactcaataaatgttagctattgttaaagaacatattcatcctctcccatattttcacctaagttgggcaatacagcatagtagttaagatggttaggagcacagactatggagcccttggctctgccaattactagctgtttgagcttgggcaaattacttactctctgtgtctcatgttccctatctgcaaatacatttgttgtgaggattaaatgagatattgtacataaagtacttttgctaataaaaataaattcataaggtaggagtttccatctactgagaagtattggggagataattttggttttttccccatggatgggaatgggacagtgactgcatatgactatagtaaggtcatggtggtggtgaggagagcagagagggcatagaggagggagaaatgggcatgcaaagcaactgccccaagtcttttatcaatttgcttccaaaatcgctatcaagaggttctgcttcaactggccagtaactcatactgcttatgagttagaatcctaaccaatattacatcctagggcagtgttctattttacaacgagattaaactatgcatagtgttctctatcttgatttctttatttgataactccctcacacaagtcttaccttgctttctagatttcagattggctaggaggtggatgccagtttctcctagtgtccctgctcctgtccaactccaggtgacagaatgtttaagaagaatttatattatttaatccatgctaggatagtaaactgcccacaactagttctcagttagacagaagaatgaaaggtaccattcttccaacattcttccagtcattcttcttattcacagacatttggtatccagtagccaaatcttcccattaaatattttgagagcattttaaatagctttttttttctgttgcatttttctctacttgccatctctctgttatctactgatacaaggcctaagagaccagtatcagcaccattaccttcaatcagagccaaaaccttatatctggaatcaagggaaccactgagatttcagccagtaatctgtccataggcacagccaatgatcagagccagaaatcatgaagtaagctaagttaatatctaagatgtgagccaagagccataaaacaacattggcagaggagaggtgaggaagggaaatgggtgtcaaatgtaagccaaagaagttacaaacacctcatataaccagaaccacccagagaccattgcaaaactaaactattagtcctgctttaggcacactctccttaaacactgttaaccaatggctggtccctgagaagcagttagtctgaaagaaaacaaggatagtactaaagccttctttgttctgtggctcccattcacctattttctactttcccttgtcatggtgtgcatttctagtgtgagcctagatgtgagcccttccttctggaacaagtcactgaagccctatgaacctcagttagttcatctacatgatgatgatagtaattcttaccttcataagtttgttttaggagttatatgagaatatatgtgaaaatcttaaagatttgacaaaataaaaataaattttttggaagaaaagttaaaaaagataaacataagactgaagaaaatatttatgacaagtatttaacaaaatgttagtaccccaataatccaaaaatgctcccaaatcaatatgaaaaatacaaacaacacacacacagaaaaaaaaaacagcaaggatatacataggcaatttgcagaagaaatgccagaggctccatctcattaggtataaggaaattgcaaacaggaagataccacttttcagcttggcaagaattaaaaagatcggtaatacccatgttggcaatggtgtggagaaaaaggatactcacattcacagttgaaaagagtgtaaaccatttaggtgggcaatttccctgtactgtttaaaatgtgaataacctttagtctatcaattctacttctagtaaattgtcaatcagaaatattatcacaagttcataaaaatacacataaaaggatgcagattaaaataactaaattaatggtaaataaatgcctatacacagacattttatatttatgcatttgttacatatgtttatataaatgtgcttatatgtgcatagaaatataaatatatgttcatatgtgcatataaaaaggtctggaaggccgggcgcagtggcttacacctgtaatcccagcactttgggagattgagccatgtggatcacctgaggtcaggagattgagatcatcctggccaacacggtgaaaccccatctctactaaaaatacaaaaattatctgggcatggtggcacgtgcctgtaatcccagctactcaggaagctgaggcaggagaattgcttgaaccagggagtcggaggttgcagtgagctgagatcgcgccactgcactccagcctggtgacagagtgagactccgtctcaaaaaacaaaaacaaaaaatagaaaaaggtccggaagtttatacagctgctaatgatatctattccagggaaacagggttagataacaagagttggggtaggaggaacttgtactttatgtattttatttaaatatataaactgccatgtacctcctagccaatctgaaatctaacaaagaagtaacatttgtgtgagggagtaatcatcaaataaagaaagcaagatacagaacactatgcatagtttaatcctcttataaaataaaacactaccttataatgtaatattggttaggattctaactcataagcagtgtaagttactggccagttgaagcagaaacctcttgatagggattttggaagcaaactaataaaagacttggcgcagttgctttccatgcccatttctccctcctctatgccctctctccttaccaccaccatgaccttactatagttatatgcaatcgctgtcccattctcaattatggggaaaatatttacttaaatatatatatatatatatatctcccgtaattttccccaaccaacatgaacttccttcttaacatttaaaagttttgccaattattaaaaaaaagcataatattattctaaaatacaccttatcaaccaaaaaaaaaaaattaaggtgatacacagtatgaagtgttactatttcttgtcagaatttcttatttaaaattatttgagtcaaggaaaattttttaaaagttgtttcaagcttcctatgcttgacataaggaaatgtggtaattctagatttaaaatacagaattataacactgtttagaaacaatacaatcagaaaaaattcctgtaaattttttcctcctctactattattctcatgtttaaagcttattacagacattaatattattcctagaacatgaagctttccgtgacctacttgtcttctaaaataattacaccaaacttaaatttccttctttttatatcttcccattttctcagtttgtcacataattttaaatttgaacatatttctctctggtacaagaccaccagctcaattttgtgatattctttccattttcagggaagacaatataaacatgttatgatgttatccaaaaatatgaatcatgaaaaactgtgttaagctcagaggcaaatggagcagcagtatccaaaactattgggtcagtgcagtctgcctttggtgtgcccattttccttctgcacccagtttgcctttggtgctgctttccaagatatccatctccctcccaacaaagcctactttctggaaaggatgtgaaaaacaaatttacattgattagtaaaaaacaaaacaaaacaaaggaatatagctataactgctaaattttaaaaatcaattatttttattcaacatgaagcccccacattcccaggtatttgatatgagttgaaccaaactgatgggccctgtcctcagagaacatggaaaacagataaacaggcataaaattacataaaattgtaataatcactatgatagagttaagacagagtgttatgaaagaggaggtctaatgaagtacaaacactcagagaattctagaagaaatatctaagccaaggcttgaagagtgagtaggcattaaccagacaaaagtgggtgggaggaaggaagtatgaaaaatgatttattgatacctctgaaatcacatcacccattttatccaaaatacatgtctgaccctgataagcaatgatgttgggaacaaaatccaacccttctaacttccagtttctttcatcatttggaatactatttccctcccttcttcacctctcttcagctttaagggatcatggaaaacaactgaacaagtaaaatgataagtcacagaaatccataagtacaaggcagaaagtgaataagtacaggcaggcagctgggaaaattgttttctaaaactttctctagaggactaatgtttgggacaaaacagaattcccagaaacagtgtatatgcccctaaagattatagctttggcagggcagtaaatactcaaccccaatatccaaacagaacaaatatctggatagtctctgccaaaccaagattacaaactgttactacatcttctgaagtaaaaataatcagcaataaatttatccattttcaattaagcaatacttagagggacatttatagttttaaatggctctattagaaaaggaaaaagatctctcaaataagtgacctaagtttctaccttaagaacctagaaaaggaagagtaaactcaacccgaagcaaagaaaagagaggaaaaaaaataaagattagagttgtattagtctgttctcatgatgctaataaaaacatatccgagactgggtaactccaactcacagtaccacatggctggggtggcctcacaatcatggcagaaggcaaatgaggagcaaagtcatgttttacatggtggcaggcaagataacttgttcaggggaactcccatttataaaaccattagatctcgtcagacttattcactaccatgagaacagtatgggggaaactgcccgcatgattccattatctccacctggtcccacccttgacacacggggattatcacaattcaaggtaagatttgggtggggtcacagctaaaccatatcattctgcctctgccccccactcccccgcaaatctcatgtcctcacatttcaaaaccaatcatgccttcccaacagtcctccaaagtcttaactcatttcagcattaacttaaaagtccacagtccaaagtctcaactgagacaaggtaagtcctttccacctatgagcctgtaaaatcaaaagcaagttagttacttcctagatacaatgagggtacaggcattgggtaaatacactcattccaaatgggagaaactggccaaaacgaaggagctatagaccctatgcaaatccaaaatccaatggggcagtcaaatattaaagctccaaaatgatctcctttgactccatgtctcacatacaggtcatgctgattcgagaggtgggctcccacagccttgggcagctctgtccttgtggctttgcatggtacaccccacctcctggctactttcacaggctggcgctgagtgtctgtggcttttccaggtgcatggtgcaatctgtcagtggatctaccattctggggtctggaggatggtggccctcttctcacagctgccctatgcagtgcccctctggagactctgtgtgggggctctgaccccacatttcccttccatactgctctagcagaggttctccatgacggttccacccctgaagcaaaattctgcctggacatccaggcctttccatacatcctctgaaatctaggtggaggttcccaaacctcaattcttgacttctctgcacctgtgggcccaatgtcatgtggaagctgccaaagcttagggcttgtaacctctgaagtaatagtctgagctgtatgttggctccttttaaccacagctggagcagctaggacacagggcaccaagttccaaggctgcacacagcaaaacatgccctgggcctagtccacaaaaccatttttccctcctaggcctctgggcctttgatgggaggggctgctgtgaaggtctctgatttgtcctggagacattttccccattgtcttagtgaataacatttggcttcttgttaattatgcaaatttctgcagcaggcttgaatttctcctcagaaaatgggtttttcttttctattgcattgtcaggctacaaattttccaaacttttatgttctgcttcctcttgaatacttttagaaatttcttttgccagataccctaaatcataactcttaagttcaaagttccacagatctctaaggcagggggaaaatgccaccagtctctttgcatagcaaaagtgacctttactccagttcccaacaagttcctcatctccatctgagaccacctcagcctgaaccttcttgcccatatcactatcagcattttgctcaaagccattcaacaagtttctaggaagttccaaacttgcccgcatcttcctgtcttctgagtactctaaactgttccagtctctgcctgttacccagttccaaagtcacttccacattttcaggtatttttacagcagcgccccactactcggtaccaatttactgtctaagtctgttctcatgttgctaataaagacatatggtaatttgcaaaggaaggaggtttaattgacacagttccacgtggctggggagactcacaatcatggcagaaggcaaatgaggagcaaagtcacatcttacatggcagcaggtaagagagcttgtacgggagaagttccatttataaagccatcagatcttgtgagacttattcactaccatgagaacagtgtggaagaaactgcccccatgattcaattatctccacctggccccacatgtggattattacaattcaaggtcagatttgtgtagggatacagctgaaccatatcgagagtgcaaatcaattaaatggacaatagaaaagcaacagaaaaacaaaacattaaaagcttctctaaaatgttcaaaaaattgtcaaacttttaacaagatccactatgaaaagaaagagaggaaagatcatcaaaatcatgaatgaaagagggcacatcaccactgatcctacagaaattttttaaaatgtaaatgagtattatgaacaaatttatgccaataaattagacaacttgggtgaaatgaacaaattcctagaaagaaaaattaccaaaacaggctcaaggaaacagaaaaattgaacagacctataatgagtaaagattaaattagtaattaaaaatcttcactcaaagaaaagccaagtcccagctgtctttactggtgaattctattaaacatttaggaagaaataatgccaatccttcacaaactcttccagtaactgaagatgcagggaatacttcccaactcattctataagttcagtacttccctgcgagtacttctaaacccagttgaaacaaaacccagaagagtagaactcagctggttctcataagtctgagtttcttaaggctatctgggaagctagaaattttgtccaactacaggttaagaaagctctagaaccaacctgaatctcagaagtccttgaaatatttaaggccattatcatggggaaattgagaatagctaccttcaaagtccataaggtaacatagtaggacgttttggcttgcagtgcaatgctggaatcaaatcatgagagctagacctcgcagttcttaaattactgtatagattttggatgtgcttatttgtttaggtcatatctcatatttcaggttattacatctatggaaaagaagtgattttccaatttaaataaaatattaaagaatataatacaaaaatactttttcttccctctctccttccctcttatgtatttacatttgttacacgctcactacagttagagctatacagtactaatactcaatcttcttcacagttgtgagtgatgttacgaaaagtatttagctaaaaatcagcataaaattgcaatgataatagtcacatctagtatttacttagtactcagtgttttcatgtatcatctcatctaatgctcacattgttcgtgtttgttcttatctaaagagggttacacagacaaccactgtaagagtagcagcttctcatatggtaacatgaaaaaaaactatacttacttgaacaaataaaattgggataatttgtccataacaaggagagggaaagtgggatatgggcagtgaaacaaaaagagtctgcgtatctaggcattgaggaaatttgaggaaagagtaaagcaaggtttttcagcactgttgtccagagcaatttagagagaggtgtctaaaagctttttaaaaaggttttctgtgcattaagaatgtaataacaccaaaagcattatccacaaaagaaaaaaactgataaactagacttcatcgaaattaagaactgctgctgcttgaaggacattcacagaatgaaaagacaagccacactaggagaaattatttgcaaatcacatatctgacaaatgacttggatctacaatatgaagaactctcaaaactcaataattagtaaacaaccaaattttttaaatggacaatatatttgaacatacacttctgcaaagaagatatactgatggcaaataaaacatgatatgatgctcaacactgttattcattagtaaaatgcaaattaaaactgcagtgagatactactacctatgatctaaaaagggtaaaaattaaaatacttgtaaaatactttgactattgagataaaagataattcttttttattgtagtaagaacatttagcatggcatctaccattttaaaaaatcaagtatataattcagtattgttaactacaggtacaatgttgtacagcagatgcctagaacttattcatcttgtataactgaaattttatacccattggatagcagatccccatttaccaccccaggcccccagcctttggcagccacaattctattttctgattccattggtttggctattttagataatttgtacatgtggaataatacagtattcgtctttctgtgactggtttatttgacttagcataatgtcctccagtttcatccatgttgctgcatatttcaagatttccttattttgtaaggctaaataatatttcgttgtacatgtttactacatattctttgtccattcatctacccatcaatggacatttagagtgtttccacatctgttgttgtgaataatgctgcaacaaacgtgggagtgaaaatatctcttcaatatcctgttctcaattattttgtataggtatgcagaagtgggattgctagataatatggtatttctatttttaattctttttttttttttttttgagatggagtctcactcttgtcacccaggctgaagtgcagaggcatgatctcggctcactgcaacctctgcctcccaggttcaagcgattctcctgactcagcctcctgagtatctgggattacaggcacccaccaccacgcccagctaatttttgtacttttagtagagatggggtttcgccatgttggccaggctgttctcaaactcctgacctcaggtgatccacccacctcagcctcccaaactgctgggattataggcataagccgccgtgcctggcctatttttaattttttgaggaaatgtcatatctttcatagtgactgcaactatttcacattcccaccagctgagtacaagggttccaatttctacacattctcgccagaatttgttaatcttttgtttgttttataatggccatcctaacagatatgaagtgatttctatctcattgtagtttgacatgcatttcccttataagtaatgtttttaagcatctttacactttgttgtctgtgcttttggtgtcatatccaagaaaccatcgctaatgccaatgacatgaaggtttcctcctatgttttatcctagtggttatgcagttttaaatcttatgtttaaatctttaatctactttgcattaatttttgtccacgtgtaagaaaagggtccaatttcattgttttgcatgtgaatatccagttttcccaacactatttattgaagagactatctttccctcattgcctattcttggcacagttgttgaagataggttgactgtaaatgggtcaactgggtttatttctgagctctcaattctgttccattggtatatgtctgtctgtatgccagtaccatactgatttaattccagtagctttgtaataatatattttgaattcaggaagtggattgcctctaactttgtttgtttttttttttttaattgttttggttatttagggtcctttgtggttacatatggatttaagaattgttttgtctatttctgtaaataaaaaattccactgagattttgatagagatagaattgaatgtagagactgcattgggtagtatggacattttaataacatgaagtcttccaaaaatctacgcaataccattcaggacatacacgccagcaaagatttcatgacaaaatcaccaaaaacaatttgcaactaaagcaaaaattgacaaatcggatctaattaaactaaagagcttttgcacagcaaaagaaactatcatcagagcaaacaggcaacctacagaatgggagaaaaattttccaatctatctatctgacaaaggtctaatatctagaatcaacaagaaacttaaacaaatttacatgaaaaagaacaaccaaccccattaaaaagtgggcaagagacatgaacagacacttctcaaaagaagacattcatgcagctgacaaacatatgaaaaaaagctcaacatcactgatcattagagaaatgcaaatcaaaaccataatgagataccatctcatgccagtcagaatggcaattataaaaaagtcagccgggcatggcggctcatgcctataatcccagcactttgggaggccaaggcgggtggataacagggtcaagagatagagatcatcctggccaacatggtgaaaccctgtctctactaaaaatacaaaataaaaattagctgggcgtggtggtgcacgcctatagtcctagctacttgtgaggcagaggcaggagaattgcttgaacctgggaggtggaggttgcagtgagctgagattgcgccactgcactccagcctggtgacagagccaggctccgtctcaaaaaaaaaaaaaaaaaaaaaaaaaaaaaaaaaaaagacaagaaacaacagatgctggagaggttgcagaggaacaggaatgcttttacactgttggtgggaatgtaaattagttcaaccattgttgaagacgatgtggcaattcctcaaagatctagaaccagaaataccatttgccccagcagtcccattactgggtatatacccaaaggaatattaatcattctattacaaagatgaaggcacgtgtatgttcattgcagcactattcacaatagtaaagacatggaaccattcaaaatgcccatcaatgatagactggacaaagaaaatgtggtagagatacacaatggaatactatgcagccataaaaaggaacaagatcatgtcctttgcagggacatggatggagctggaagccattatcctcagcaaactaacacaggaacagaaaaccaagcaccacatgttctcacttacaggtgggagttgaacaatgagaacacatggacacagggaggagaacaacatacactggggcctgttgggggtggggtgggggaagaagagcattaggcaacatagctaatgcatgctgggcttaatacataggtgatgggttgataggtgcggcaaaccaccatcgcacacgtttacctatataacaaacctgcacaatctgcacatgaaccctggaacttaaaatacaaaataaggttaaaaaaataataataatattcagtcttccaatctataaacacgagctgtctctccatgtatgtgtgtcaaatttgtgcaatcaatgttttgtcattttctgtgtacaagtttttcacctccttagtcaagtttattactatgtattttattctttttgatgctatcataagtaggattgttttcttaatacctttttggatagttcattgttagtgtatggaaacaaaagtgacttttatatgttgattttgaatcctaaaactttactcaatccatttattagttccaaaagttttttttttttttttttggtggaatccttctaattttctacatgtaagataatgtcatctgccaacagaaataatttttacttcttcctttctgatttggttgacttttctttttcttgcctatttgctctggctaggacttccagtataattttgaacagaagcgatgtgagttggcattatgccttgttcccaatcctacagggaaaattttcagtttttcaccattaaatataatgttaaatgtgggcttttcatatatggccattatgttgaggtaatgtccttcttttcccagttaatatattgagtttttatcataaaagcgtgttgaattttgtcaaattttttttctgcatctattgagataattatgagatttttattcttcattctgtttatggggtatattgcattaactgacttttgtaagctgaatcatccttgcatctcagggaaaaatcccatctaatcatggtgtattttcctattaatgtgctctttcattcagtttgctagtattttgttaaggatttttgcatctatgtttatctgggatattggccagtagttttcttttcttgtagtgtctttgtatagctctggtatcagggtaatgctagcctcataaatggacttggaagtgttccctcctcttcaatgtttttggacgagtttgagaaggatcagtattagttcttctttaaatgtttggtagaattcatcagtgaagctacctagcactaggctttttgttgggaggtttttgattactgattcaatctctttactcattattggcccgtccagattttctaatccttcatgagtgagtcttggtagactgatatatctaagaatatgcccatttcttctaggtttttcaatttgttggcatgtaattgttcatagtagtctcttatgattctttgtatttctgtggtatcaattgtaatgtctcctctatcatttataattttatttatttgaaccctctcccctttcttggttaatcttgctaaagatttgttgattttgttgctctttttaaacaaacccactattagttttgttggtctcttctattctctattacatttacttctgctctaatctttatttcttccctttctacctttgggcttagtttgttctttttctaattctttgaggtataaagttaggttacttgagatctctttcttttttaatacagacatttatcactatcaacttttctcttaggatcacttttgctgcatcttataggtttggtatgttgtgttttcattttcatttctctcaagatattttctaatttcccttatgatttcttctttgatccattagctcttcaggggtatgctgtttaatttcacatgtttgtgaattttccagtttcccatctactgtttatttctaatttccattccactgtgatcagaaaagatacttggtatgattttaacattcctaaatttgctaagacttgatttgtggctaaacatattatctagcctggagaatgtttggtacctttgagaaaaatatatattcctctgttgttgggttaaataattgatatatgtgtgttacgtccatttggtctatagtgtttttcaagtcagctgtttccttattgatttctatctggatgttctattgattattgaaagtgggatactgaagtgtcccactattataggattgtcatccacttctctcttcaattctgtcgatgtttgttttaaatatttaagtgctctcatgttgggtgcatatatatttataattcttatatcttcttggtgaatttactcttttattattatataacatcttttgtctcttgtaacagtttatgactaacagtctattttgtcttatatagccactctgctctcttttggttaccatttacatggaatatatttttctatcccttcacttttagcctatgtatgtgtttcaatttaaaatgagtttcttatagacaatacatatagttggatcttgttttttaattcattcagccacactataccttctgactgagtagttcaaaccacttacatgtaatgtaaccactgataggaaaggaccatttttttcataggtttttctcattgttttttcaattttttcattgctttctgtttgtcttgtaattcttttgtccctcttctcctctcttgctgtcttcccttgtttttcattgatttttttttgtattgatatactttggttctttttttcttttgtgtatcttctataggtgttttctttgtgaatgccatggagcttacataaaatatcttatagttacaataatctgttttaagctgataatgtaactttgattgcagaaaaacctgtacacttttacttctccctttacatctttttattttgtgtatcaattcacacatttttatatttatagttatttttcatattttctttttgatacatagttttgctttctcacccaggctggagagcagtggtgtgatctcagctcactacaacttctgccttctgtgctcaagcaattctggttcctcagcctccccagtagctgggaccacaggcatgagccaccacacctggctaacttttatatttttagtggagacgggcttttgtcacattggtcaggctggtcttgaattcctggtctcaggtgatctgtctgcctcggcttcccaaagtactgggattacaggtgtgagcctccatgcctgactctatttttcatacttttgtcttttagcttttacactagagttaaaagtgacttacctaccaccattacaatattgcattattctgtatttatctatatatttacctttactagcaaattttacattttcctatgcttttgtattactgttaggtgtccttttgttttcacttaaagaactccctttaataagtcttttaaggcaggtctgggtcgcaaagaactctctcagcttttgtttacctgagaaagtctttatctccatcattattgaaggacaattttgccaggtatacgattcttggttggcctttttgtttccttcagcactttgaatatatcatcccttttccttctggcctgcagggtttctgctgagaaatacactgtagtcttatgagggttttcttgtatatgacaaattgttcttctcttactgctttcaaaaggttctctttctctttgatttttgacaatttgactacattgtgtcttggtgtggatgtctttggattcattttatttgaggtctgttagggctcctggatctggatgtcaagtttctttaccagatttgaaaagttttcagccattacttctttgaataagctttcttccccctttctccacctcttctccatcaggaacattcataatatgtctcttggtctgctttcatggagttccataagtctcttaagctttcttcattctttttcacttgtttttctttttgttcatctgactgaataatttctggtaatttgtcttcgagtttactgatcctttcttctgattgatctagtctgctattcaacctcccattgaattttttagttcaattattctattcttcagtttcaagatttgtttggggctgtgtgtgagtgtatgtgtgtgtatgtgtatatgtgtgtgtatcgacttcatatatatacacacatccatttcatatttagatccattaaatatatacaggtgtataaatatccatatatatccatttcagatatatgtgtatgtgtgtatatatatgtgtgtgtgtgtgtgtactacacacacacaaatttatctatgttgaaattttcactttgttaatacattgttctcctgatttcattgatcatgatatggtttggatgtttgtcacctccaaatctcatgttgaaatgaaatccccactgttggaggtggggcctggtagtaggtgtttgagtcatggaggtggatccctcacgagtggcttcatgccctactcacagtaatgagtgaattcttgctctcagttcacacaagatctggttatgtaaaagagtgtgacacttctccctctctctgtcttgctcccgttccatgtgatatgggcctgctcccctatcaccttccaccatgaatggaaaattcctgaggctctcaccagaagcagatactaacaccatgcttcctgtacagcccacaaaaccatgagccaaaataaaacatcttttctttataaattacccagtcagctattcctttatggtaacacaaatagaccaacacaatcatcattatgattattttgaattatctgtcagagaattcaggtaagtcatatacagtcatccctggattttccatcaggagttgattccaggaccttccacagataccaaaatccatggatgctcaagtctctaatataatatgggatggtatttgcatataatctatgcatattctcccatgtactttaaatcatctctagattacttataatacctatacaatgtaaatgctatgtagacagttgttatattatttagggaataataaccccaaaaaagtctgcatatgttcaatacagatgcatttttttttactttaaacatgcatatattgcatgatgctgagccttgggatataaatttttaaaaaatatttttgatctgtcattggttgaatccatggatgcaggacccacagatatggagggccaacactgtatctccaattcattacagttgttttcaggaaatttactttattcctttgtgtgggacatatatccttgtttttttattttccttgattatttgtgatggtatctgtgcattagagaacagttacctttcacagactggccttgtataggtaaaggccctcttcaatcagcctagctagaaattctggggacttttcaaacctgtgtcctggttcaacctgctttctttgctcttagccacccttaggcatcaagattatgctgggtccagtcagcattccaagataaacgagactgaatccagtctcttaggcagcctctggaaaagttggatctttggatgttctatccaactcgtttcctccccaagaaaaatctgggatgcaggattttttgcccatttgttccgtattgagtcatggaaagcggctatgagagtgtgctagttcaaaccacagtctttgtctgcactggtccccaggcagcaaagtatgctgggtcccttagttccccacaagaggcaagaaagaaatcattctttggcagcccacagagaagttggggcattggatgtgtgatccagctctttccctccccagagggaagctgggaactagggtatattcatctgcttgctctgtgtagagccaggggaaggagctatgacaaccgccaaacctccacctcggttctcactggccccaagtggctagagtatgccaggtcccatcagcactctgagcaggcaagacagatggtagtcctttgggcagtccacaagcaagttggggtattggacacatggtcaaactctatctcatccaagggagaagccgggatctggagttattcacctattcactctgtgctgagctgggattgggggttatggtaaacgccagcctaaaccaccacgtctgatctcactggttccaaggctgctataatatgccaggacctgtcagcatcccataacaggcaaaacaggatctagtctttagtgcacctccagagaagttgaggcattggatgtgtggtccaactcattttctcaccaggaaaagtttgggagctgggtttattcatccattcactttgtgctgagttgggggcatgggctatagtgacactcagtccaaactggtgcccaagcagctaaagtatgccaggtcctgtcagcactccaagacactcaagacatatagcagtcttctcagaagtccccaaaaaagttggagtattagatacgtggtccaactctttccattcccaaggagaagctgagaattaggaggtttctttctgattgtatggtactgtgccagggtagcaattcttgtgaaagggtatcctgaatttcaataccagttttaatgtggctggtttcacactcacccaggatataaaagcctctcaattagtttttggatgtctcaaaaaagaaacttgtccatgttttgctgttaaacagatgtgtttgtgcaggaaaggagagtctagagcttcctatccttcatccttgctcaataatgtcttatttaaaaaaattctgtttgagttttaagttgttggcctaatattccttgtggacactactttaatgagcctagtttgaattatcttagccaaaaaaaaccaataatagcaacaaaaagtgctctcattgcttcttaactatctagtaaacaatataaacaaggctatggcatgtgggggaaatggctttggagtcaaataccatggtacatttccttcttaaagccataggtcttatcagggtgagggcatctctggcattgacactggaatgcctcgaaccttgtagtcttaggtatgtgagaaaataatacttagaatttatcacattgttttacttggcattaccctgacactgctccttttgtaaatcttagggatgccaagtctacatgtttctgatttagttccacttagcaaatcaaagtgctgttttacaagtgctctttgagatttaagacaatactcaaatggtatcctttgaaataagaagactgagtcagaagccatcattcaagtggcagatgggttaaagatgctttatataaatcagctctatcagtttccactaaagccaatgctcttgccaaatgcattctcttagcatatacaatgaggttttttttcacttttataggccaaaattcctcttacagacacatgttggttcagtttatttggaataagtacctatctcttatataatgctgactgtagaatatttgaagctatgtttcttgaattctaaaattttaaattttgtatttttagtagagacggggtttcaccatgttggccaggctggtttcaaactcctgacctcgtgatccacccacctcggcctcccaaagtgctgggattacaggggtgaaccaccacacccggcctcaggccttccttattcatgagtaaaccaaaagtagagaatgttggtagagtgtgcaaacatccgaaggtaaagtaaaaaactgttaaatttgcacagcatttccattgttctggtaagaaagaaatacatatgcatgtatgaactataaaatcctgtggttccacatataagttaaatgctcttttgtttgtatttaaaacttgcattgcacaatataaagatggatagtagtccatcttctcccatgtaatgtttcaatcactttacaagattgccatttatcatttagcctatatgctgaattgagaactcacaaactctctaagtctcaggtgcctcatctgcaaaacaggaataatgatattttataggatgtgctaaagattaaaaataatgtctttaaagcccttagcagagtatctggatatactcggcactcactagtagctcaagaagctactagagtgctattctactactactaaagatgatgatgatgatgatgatgatgatgatgatgatgatgagataatataatttctttttatttttttttttaaagacggaatctcgctctgtcacccaggctggagtgcagtggcgtgatctcggctcactgcaacctccgcctcccgggttcacgccattctcctgcctcagcctcctgagtagctgggactacaggcccccgccaccatgcctggctaattttttgtatttttagtagagacagggtatcactgtgttagccaggaaggtctcaatctcctgaccacgtgatccgcccgcctgggcctcccaaagtgctggaattacaggcgtgagccaccccgcccagccgatgatgatacaatttcttaaagctaccaattcattttcagacagctttattgcaaaacccttctacacagtgaactaaaatgtgtttccttttaaattgtaccacggttaatccttctttcaaagctcttcagatgactaaaagcaatgacataatctgtcatttacagtctataaaagctgctgcacacgaatttataaaggggcagagatggcaaagaaagggtaggggcctgctacatgtggtcaccgcgtcaatgagaagaaaacttcaccctaaccctaaatctaaaccgatcagaaaaaacaaaattctaaaatacacatatactagaaagttgaagcacttgctgtacaatcagctggaaagttcccaaaagacctcaaagataattacaatggaataatgcatgagcacaatagcaaactgagacatggagtgaaaaagttgctgcacagactctttcatatctttgttaaggctgagcaccccagttaagcttctgaacgttggacaatctgtctgttgctactgctttcttagaagttcatggctaaggggtcattcattccatattacagctgagcaggtaccctactttcatctaccttatatacccagcctcagctacattgttagaccatataaatgtcaacagaaaaagtagaagaaagagaaatttttcactagaacgttggctccaggagagctgagattttatcatctttgttcactgctaaatttataatgcctagcacgtactagatacacattctgtgttgaatgaaagaaaaaataaattcacagggaatacaaacatctttaattttgctattatttctaccctattttcgaggagtcttggagttcatatttacccagaccctaagttaaggcttagagccttaacatgcaaaatacaaaaataactgaatttcgaaaataaattatgccatttagtagcaaaacaaataaagatgatttttatatgtagaaatacataaaagaagagaacagcaaagagatacaaattcattttacagcactgaggaagcctttgtttagagagctctactttgggcctctacaactaaaacaagatctggggaattgagaagatgtttagaggaataaagttttaggaaatagacactacatagaaattcaaaagcaaccagacatgtttcatttagagaagccaagccttcaagcatgtaaagggatattacagctatcctgtttccattgagaatgggacaaaggaacagccttacattactagcaggaggtctttagatcaaaaatcagaattcatgtctgaagggatgtgaaacactggcaaaggctgtcaaaagagatatggattctcctactctatagactttcatgaaaagagtatccatctttctaacatgatttaagtggatttctgcccaaaggaaaatgtgaactagataacctcaaggtcactattctacaaattttgtaatcaaaagcatctgtgaaaaatagggcatttccaagtacctgaagtaaatcacataataggtctaggaggtctcttttaaatcccttcttccattttttataagatcttacctttagatagcatttcacaatttacagtgggcttctaaatattttacttccttattttatatgacatggtaccccagatttactgcctcagcttgaaggattaaaaatcagggggcacggggagatgggtagagatcagaaatcttggttttaaatagaccaagttctctatcccttctcaactatcttttcatttatttttcttgggaagaggtatttgttgaaagggactcttgagtttcttttcctccaacaaatatgcttttggtgccaataacagaaaagaaaatgtcttgaaggaaaaagaacaaaagtcaaagaagacaatgtgaattttgcaaaagactggaaatacctgagccagaaggcattgttcatctgcaagtctggactaaaggcccaaaaaaaccatatgggaatgtgtgaaagccttttttttttttttttttttttttttaagtaactgcccagggttttttcccaagagtcatttcagactcagttatcccatttttgatctgaaacagaaaatatagctattggaaaagggctgtcattcacagccagcttagaagtccaagacttgtttgtcttgtgccctttgcagcaaggaccataaaactcaattcctccctatcctgaaataaatgctaggcagagtaacgcagaacgtcaacagaatgccacagagaagcatttgcttttcttggtaaccagtgcatttaagggcactgaagtccatactttcagttcttgagaactaagaacaaaatagctatttcaggttcttttttttcccctaagaaaagtgccagggggaaattaaaatgtaaagtggactttcttttttatgcaaatatgtgttggcccctttcactgacaaatcacaaggtgcacatttgttcccaggtaggtcaaagttcctaaaagaggaaagatccaaatgttctcagggtatgggttttcttttccttatactcagagagttatttttaaagttagagacttctgcaaacaacgccacagtgagtttccctggggaaccatttttgttgcacaggttggctccactggttagaaattgatttgcatgaggccatcaatttgaactttacctcttcaaggcacaaaactctaaaaggcaaaaacaaaaaaacaaaaacaaaattctagtaaagctaggcagagacagaacctcttgtaaatgcttgtctttggttgccagcaaacaatgcaattgtatttaaagaagtaaacagagtaaaatctgtaaaaataagccaatggaccaacttgcccctgttaccactgcctgacacacagaaggtacattaaaaagtaacaaactctgcagtgagaaagaacagctttgcctattttgtaattctccctctcctaaatttacatacgtcacacctccagctcaaatacacctttgactaccaactttcccttacctctagcacttctcgttctcttcacttctattacctttctcctccatcacccttcacgtggcctgtaggtgcaaagtcaagggagggaggagtgcaagccaggtgcaggaatctgcaagtgcatctagagtgagatgctagtgtgctttggcactgcccagcagcagcaaagacaaatccaagagggatctctcttactagatgcagccatgactgctcagtattgaatcatggaaaaggaagggaacctagaacttgtttagaccaacttctcattttcataataaagaaaatgaggtctagagaagtaatttgtccaagctcctgtatttgtagctaacaccaaggcccagtatgtcccagcaccatagtgtgccacgatggggctagctgcatgcctgtgctttaaatctacatcatctctaagcaaaagaagactcccctaagaagataagaactgaaagctgtttctgcttcttggtatctctttttctcacccaaagattttcacatcacttcttttcaccttgagtcccttctatgacatccatcatactgcttcataaacttgtttactcagcattaaaaccttcctgagtgggtaaggaatcatatttattaaaagtattgagagaaggttaaaaaaataaaaactgggtgtgtgtatgtgatattatgtctgagcctatttttaagcgaaatgaccagaattttatcctgttatggactgagattagacaaaaacagtaagaaatgtgtactttcagggcaaaagccgaattcctcagtttagcattcaaaggtcaaaggttggcctcaactattttatctccactatccctattcaatataacttatgttctaaacacatcagatgcctcactgctccctaaaatccacatcaagcacccatctaattctttgttcagggttatcactccacctagaatactgttcttattgccctgcccatacctctgtcacctgtcaaaatcatattcatttccaaagtacaccacagatgatcagtgctacttaaggcatttccaaaaataggcaaatttaagctctttcacccccacttcattctcttccagaattttgtttatatgcctattacagaacttaccatactctatcttctatatatagtatagtatgtctggccccttcagtgtatgctgagtagtagagagttaggactcagtgtttagcccagaatgctagccctcaaactaacataaaagagttacacaataaatgttactttaagtgaattgaagacttgaagaaaaggaattattattaaccagcattaaacagtctaaaggtggtaatacggaaaagtactttcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggccggaaaagtactttcatctgaagattttaaataattacctttctatatatttgaattggatctgttatagaaaacaaatcatcctaatctcatctttcatccaaaaagtaaatgtgttttcccattttgaagactaaatgccatttactattatgccaaataaaagcataaaactatttctctccttctgaggattgacaagagcttgacctccatccaactcccaaatcagataacacagagtattatcatcctatttgttcagtccaaaagatccctagcaattattaaactctagacaacttcattgtggaaaatgcatccaccaagggatgaaatgtagcactagcttgaagaatgtttgggtttctccatattattccaagctaaaattatagaatgaaagttattttaaaatcttaggggttagaattttaatttcactgcatttaaatgcatacagcaggcaacaaatgaaaacttcactggagccatctcttgcatgtttgaaaaatcatgtgtactttcaaaagcatatttgcagatcataatgtttgtaaacttaaatagtaatgggcggggcccatattttgcatccctgggtcatttaagtttgtcagtgttgacattaccacagaaaaacttccctttcatggttagtagcttgtcgctctcagtaaatctgtgatactttctggcgtcccacacagggaattatttaatttaatttctaaggaccagatcctgcccttggatacacgtaagcaataagtattgacgtcaatggaaattctgggtgcgcatctaaggccagactatggtcctctgcatattcctaacatgactgctgaaattctgtttgttaagactggcttgattttggctccttttctcttagatgtgcacacaataccagaaatgatgcatgaaggctgcgatcaagtgaaaagctacatgcgtaaccgggtgggatcctgtgtggccttttgacctaagcaaagaatgagatttcatgtcctgtaagtccctgggtccactattgtcctgacgactagcccacagcaaaatttttcatttctggatctaccccctatttaaagagaaaataaaactgagatttcaatgaatgctgataattttaaaaacaggaagttttatttcacggtctaaatatggcaatacagaagagtacttttatctgaagagttgaaattatgacttcttatagatttcaattgaatttctaactttagaattcccaggatcataagctatccatccattcccttccatcccttaattcctgaacccccccttctcattaattctctaaacatatttgcctactagattccccttgttcatccctctccagccacactgggctcctggaagtccctgaaacacagtcaacatgctcacggctcatggatttttacccatgatactcccatcagcttggaatactttccctattacctttatgacctgctccccaagtactttaggtctccctcaaatgccactttcccagtgacctctcccctcaatactttatttatttatttatttcaataggttttggggaaacaggtggtatttggctacatgaataagttctttagtggtgatttctgagatttttggtgcccccatcaaccaagcagtatacattgtagccaatgtgtagtcttttacccttcacctacctcctaccctttcccctgagtccccaaagtccattgtatcattcttatgcctttgcatctcatagcttagctcccacctgagtgagaacataacgtttggttttccattccttagttacttcacttagaataatggtctccaattccatccaggttgctgtaattgccattatttcattcctttttatggctgagtagtattctatggtgtatatataccacattttctttaaccactcatagattgatgggcatttgggcgggttccacatttttgcaactgtgaattgcactgctataaacatgcatgtgcaagtatctttttcgtataatgacttattttcctctgggtagatacccaggagtgggattgctggatcaaatggtagatctacttttagttctttaaggaatctccacactgttttctgtagtggttgtactagtttacattcccaccaacagtgtaaaagcattcccttttcaccacatccacaccaacatctatttttttttattatggccattcttgcaggagtaagatggtatcacatgcatttccctgataattaatgaggttgaacatttttcatgtttgttggccatttgtatatcttcttttgagaattgcttattcatgtccttagcccactttttatgaaattatttgcttttttccttgctgatttgtttgagttccttgtagattctggatattagtcctctgttggatgtatagattgcaaagattttctcccactctatgctgtttactctgctgattatttcttttgctgtgcagatgctttttagtttcataagtcccatccatttatttttgttttggttgcatttgcttttgggttcttggtcataaactctttgcataagccaatgtctagaagggtttttccgatgttatcttctagaatctttatggtttcaggtcttagatttaagcctttgattcatcttgagttgatttttgtataaggtgagagatgaggatccagtttcattcttctacatgtggcttgccagttatcacagcaccatttgttgaacagggtgtcctatccccactttgtttttgtttgctttgttgaagatcagttggccgttaagtatttggctttatttctgggttctctattctgttccattggtctatgtgcctatttttataccagtactgtgctgttttggtgactatggccttaaaatataatttgaagctaggtaatgtaatgcctccaagtttgttctttttgcttagtcttgctttagctatctgagctcttttttttggctccatatgaattataggtttgttttctctagttctgtgaagaatgatggtggtattttgataggaattgcattgaatttgtagattgcttttggcagtatggtgattttcacaataaagattctacccatccatgagcatgggatgtgtttccatttgtttgtgttatctctgatttctttcagcagtctttcatagttttccttgtagagttctttcacctccttggttaagtatattcttaagtattttatttttctgcagctattgtaaaaggggttaagctcttgatttaattctcagcttgattgctgttggtgtatagcagggctactgatttgtatacattaattttgtatcctaaaacttttctgaatccatttaccagtctaggagctttttggatgagtctttagggttttccatatacaatcatgtcatcagcaaacagtgacaattgggcttcctctttactgatctggatgccctttacttctttctcttgtttgattgctctggctagtactcagtatcctatttagaactgaatactccctagcccccctttcctgctgtaatttttctccatagcactcatcaccatctagcagaataaacattttgtttagcttattttctcttctcttctaaaatggtcattattatattctgcagtaattaaacagtgcctagtacatagtccatccccaataaatatgttctgaacgaaggaaggaacttttaagaagagcctagagcttttcagaagttctactgcaacaagaccttcccaaagcagtaaaccattaccagaatactttccttgtgaaaatataaatataaataaatttaagaatcaataagtgctaaataaaatttaagtatacatgcataaatgagaaatatttgaacaaataaataaatgagtaggataagaaaaacatttcaaggaatttattttgacacagtaatcaaatatgtgaaaatactaaatttcctaaaaaccattatttcatctgttataacattattatatcatctaccattatttaatgatagtttcacataggttgtacctcaattttttcaatttgtgatcaaagatctgtctacctcaaaatatctaaggtgcttattggttaaaaaaaaaggaatttcctgcttccactcaagagctctgaggttgcggcctattaatcttcatttttctaataagttcctcaggtaattcttatgcttatttacttttgaaaactactgttttagtttatcagtcctcaaaatccactgcagccaattctgtcctggcctgccttccacagggctctctccttgaatccagatcctcttttaatttcaacatttagattttaccttaactacacatttaaaaaaacaccaaacaaaagagccatatcttcttttgatgctaacaagccttcagacatattgaaagatcaacatttctacctatgacaaaaatattcttttaaactattagtccttagcagtttctggtaatagcatcccatcaaattaaaaatgaaacagaagctctaacatatcccaaccttcttttcgcactcaaagagacatagaactacaactaaacttattaaatgcctatgtagcacagagaagtgtacccactaccttattaaaactaaaccttgtgaaaaagagaataaataacactatgttatttgttcaaagccacttagttggtacctgcagagcaaaagctgaacccaggtctctagactctatgtccatgattacttctaaaatattcactgctacatcaatctattaacaaagtttttttaaaagcccagccactacttgctatgattttgaacccattctctgttttcttaaaaatggagttgctctgacttaaaatataagataacaaaaacaacaacaaaaaaaatgaaggcacaaagtctcctaaatatgctccatttggcattctgtgctccattccctattgtggtactttttgatagctatgctagcatattcttctgcccagctgcttttaatttactcttttatgggggcatgaatgtcattactatgtcccctatttcaaatgttcttgatgttgtagttctgccgtatcattttttctcatccttttaccacattctctctcattaaaggacatgtcacttccttcattaacttaaaattcactacggatttttaattatctgtgagctttcagaaattctttaactcaaaagttgctgtcatttttgttacatgcatgagctcaattgctgagaatcctttccaaacaaatccttttagagggtacttttgaaaatacattctttagatcattccagtctcaagacttgctgggaaagtggggagaaaacagggaggaaaagagttactgatcaaataaaattagggaaaaccacattctatattcatctcattgagattcacatatatatcagcatattaaaggcttggataagtcctataggaaaaactgttttaactcagtatttcccaaacctgcataaccatgcaacctcttcccaccacacaacatctaataaaatcccacagaattttactatatgataaacattagaaacacaataaacataatgcgtactaaataataagagtttactatgtgatagatattattgtcattagcattaataatcaggtcagtaagtattgtgactcaactaatctattactctaaaaatggtaaactgtggtctaatgtgttcagtccaaagcaagcaccttcactgacctttgaaaataatgtcaatttacaatctccaatagaaatttcacagagaagaatattctgaaaaccctcagaaacctaagtatttagcaacaatacttccaaaatgctactacttcaaaatatctgcaagcataatcaactgaagtttggatacagcatggtacagcatggtctgagggaaggtgcctaactgagttttggagtaaaacattcaaagccagcctaacattcaaagtcagccttgtcccttagcctttctgagccaccattttcttaatacataattgataatatcaccaccaatttttgcaaagttgttgtaacaattagaaacaacacacctaggacatagtagacatcaaaaaaataacgtaactgcttttgtggttccaatgagacttgttgacttccgagaatctaaaattatataatatttggtcatataaacagatgtacttcattttccaataaggacatttcttataaagtattgctggctgggcacagtggctcacgcctataatcacagcactttggaggtcgaagtgggcagatcacaaggtcaggagtttgagaccagcctggccaacatagtgaaaccgcatctctactaaaatacaaaaaattaaccgggcatggtggtgtgtgcctgtagtcccacctacttgggaggctgaggcaggggaatcacttgaacccaggaggcagaggttgcagtgagctgagatcgtgccactgtacctccagcctggtgacagagcaaggctccatttcaaaaaaaaaagtatcgccctttctaccactcaggaattcccctctcagctctgttaactagctatcaatcataactgtcttgttaaaatttttgcatgagaatattttcctgaaaaaaaaaactagtaacattgactttataaatttaaaattttgaataaatttttacattcacgtggtttacgcagcaaaacatcataaagaggcattgtctgagactgttttgcactcccatgacagaataccagactgagtaatttatgaagggaaatttagtagctcgtagttctgggggttgagaagtctaaggttgaggcacccgcaggttcagtaactggtgaggccatcttcttccaagatggtgccttgcatgctgcatcatcacatagcagaaggtggaatgtcaagtgcaagagcccactcccaaaagcacttttatagcagcattgatacattcataaggatggaactctcatgaactaatcacctcccattaagcatcacttcccaacattgttgcatcgggattaagtttccaacacatgaattttggaggatacattcaaactatagcaggcatgtagagaaaaaaactgcctcttaatctatttttatttatcccataccctgcctgtgtccatctctagataatcacttttatttgcttcttatatttctctcttgaatttctttccacaaacacatactatgtgtatagatatatattttcaatttttcaactttttaaattaagtgctcaatacattgatttttttactctttctttattgataattatctgtgactccaaattttcctaggaccactgttttagctctatttcacagtttctaatattttgctaccattattttccagaaattttataatttaaagttgcttatattttccatttgacccatgaattacttaaaagagagtttgggggcttttatttttgttttttaatttccacattggagcagggtttgtcgtcgttcacgttattaatttctagctttattgaggcacatatggtttaatctttgggactgtattgaaacgttctctatgaattgtgaacattttacagtcaagtgcagaaaatactccatggagtacttaaaaaggtttatcttctttatttcaaagtaaaagtatgtgtatacacacatatacatttctatatccaattcatacttttgatgtctacttgctctatgttgaactgagaagtcatgatgtcatgaatattaacatttcagttattctctcttttttatcattcatatatatatatatatatatatatattttttttttttttttttttttttttttttttctgagacagagtctttctctgtggcccaggctggagtgcagtggtgccatcttggctctctgcaacctctacctcccaagctcaagcgattctcctgcctcagcctctggagtagctgagattataggcacatgtcaccacacctggctaatttttgtatttttagtagaggcagggtttcaccgtgttggccaggctagtctcaaactactaacctctagtggtccgcccacctcagcctcccaaagtgctgggattacaggcatgagcctccacaccaggccaaataccttatttttttatctcttaaatttccgctttagaaaagtttggagctggtcacagtggctcacacctataatcccagcactttgggaggccaaggtgggaggatcgcttgaggtcaggagttccaaaccagcctgggcaacaaagtgagactccatctctacaaaaaatttaaaaattagctgagtgtggtggtgtgtgcctgtagtcccatcttagggaggctgaggcaggagtatcacctgagcccaggagttcaaggctgcagtgagctatgattacaccactgcactttaggtggataacagacctgagactttgtcttttggaagaaaaaaaaaagaaaagaaaagaatatgagaaaagttgttttggtacatagatattcacaactatcattgcatattgtatctattagtattcagcatggtaaagttagtttcatctcatttaatgctttttagtttaacattcactttcactgatatttctattgtgactccttttttgtatttacctggtgacatttttaaacagcttcagtgggatggaattctgctatacttcaaccatttaaactgtagaattcaatagtttttagtatatttatagttgtgcaaccatcaccacattcaattttagaacattttcatcacccacaaaaagaaacgctattagcaggcactccccatgtccttcaaagcctccagttctagttaactactaacctactttctgtctctataggtttgactatgccagacatctcatataaatggaatcacacaataatgtaaccatttgtgagtggcatagcacaatgttttccaggttcatccatgttgtagcatgtatcaatatttcatttcttcttattgctaagtaatattccattgtatggatatatcacattttgtttatccattcatcagtaatttctactttttagcaattatgactaatgctgttataaatatttgtatacaagtttttgtgtggacatcctggtatacttttcacactttttattttcagttcttctgaattgcattttaaagtactttctttgcttgtatacaatggacggtggtcttaccttatggtgaaatctgaaactattattttactggatgcataaagaccatatgcaaaaacataaaagaaaattaataccacccataatggtatactcaggtataaactgtctttgatatatcttcttcaaatcttcataaagttcatatattccttttcaaaacgaaattgagatcattcagcagatgggttttgtacatgtttttctcttaacattatccacaaatatttttcctcttcattaaaaataaatctataaatttaatagctgcataacattccactgaataattatacaatagcacataattttaaaatgtggttgttttcttatctagcattctcctagattttgtaaacaatgaaaataacagtattacttaaatttattcaataccatgtactgggcacttatctaagtgcttcacttatttaatcctaacaacaatcctatggggtagacattttgttgcctattttagagataagaaaactgaggtccaaggttgtcgaacaatgttcccaaagttaaaaataagaatgtcctaaatatgtagttcccctctactttattaaaacatccctctatattgtctatattttatacacttctcagtgtacctcttctggattgactgattaaacttttccatttagggataatccatatcattggacattaaaatgtttcccaggaatggtattttctctaacttgtggaaattgagctaaattgttgtgtttttttttttcctattttcccacagcgggggaaaagcatccttgagtaaacccaaaggtttccgcatacccctgaggaaagaatgagaaggtaactgttcttacagcaatcatgatatgggactttctatgttcaggagcaaaggggaatccatagaaaagggcacaagaggcagctggctggctcagagctatccacactgcatggcagagacttgagacaaatgcagcattggtgggagccaaggtaaagccatgccagacagggtggaccactaggtcctgacaaaactgcatctaaggttccatcaggagttatatcatttgcagactttaggagcatatgcaaatatgctgcctaggaatgaagtccactaaatccggctcactagttatcagccagtatatacccaaggacaagaccagcacaaggccagggtctaagtctcactctacaaacatacttgaacactaattcagaaaaaagcaacaccactatttgcatctgtgcttcaaataggggacagagacagttcactgcccttacatctactataaggtaacaaagaaaaaataagttcaaagaaaaggcatctatcttttggtttaagaacttttatatttcctaagtccctacaaagctaaaaagcaaagcctcttttacatcttaagagacatttgatcatttgaataatattaaaaaattttatgtatttaatgtgttttagggtttctctaatattctggaaaataactgacctggcccaattagttctaaagctttcttttcgcagtaaactctagcattctctttttaaaatttaagcatctctgttaactaaatttttaaaaggttaataaaattttattttacatggttgcaaacttattttaatagtgataacttcacaatagtaatcttttaaaattattttcttaaacacaatatagttaacacctaggaatatccctatgttgtaacactactgcaaaattcagcaagattttacaatttttaaagtacttctaatgtaacttatttcacttaatctaaactataatcctacgaactagatagaaattatctcgttttatagataagacaatgggtttacagaaattgaataatatgtccaaaatgaaactggtagtaaatggaagaaccaggactgaatcccagatcttccgctttcaaaaaacaaagcagacaggaaaagtcactgtctcctcatgaagttgtcaagactctgatgtggctagggcttctatggctataacttatttttgaaggttctatacttcccgctgagggtctatcttttccatttccaagtgtaatccaacctcagccctttgtcattcaattctgacacaaatattactaacatttcatattttaagaaagtctatacagttagtcctacatatctatgggttccacagatttcaatccatgaattcaatcaaccatgtgttggaaataaataactgaaaagtaacaatacaacaataaaaataatataaatttaaaaaccaatacagcaaaacaactatttacatagaatttacactgtattatgtattaaaagtaatctagaaatgatgtaaatctagatgtgtgtaggttatatgaaaatattaacccattttatatcaaggagttgggcaccctcagattttggtatcaataagggtcctggaataaatccccaacaaatgctgagagatgactgtatattttgcaaataggctattttcaattccattgcttttagccttcttgaattttacagagcttaagtctctcttagtatttctttggtatgatataataaaccctagatgagtacttcttatgtgccacttttattcttaactccatcttacctgaatcattaaaatgcaaaaatcatctgttccatttaggtatgtagaaaacgttggttcttaaaaatctcttaaaatattgctactttatttattacacatagaaaatatgttctgaaatttccataagaaaaaagtcacagaatcagcttcacttatgataattattttattgacatagactttaacagggtttgggttcaatttacatacgatgttaataatattttatcagtaatacttcaccaacaatttttgaacctgcataggctgactaaagtgctacggttctcataaactagtacataaagagcaggtctgattttaatataagagaaaaacaatgttaacattaaatatgcattattatattttaaacatctcctttttttcaaagctttggttatataatattaataatagcattctcgttccaagatggccaaataggaacagctccagtctacagctcccagcgtgagtgatgcagaagatgggtgatttctgcatttccaactgaggtactgggttcatctcactggggcttgtcagacagtgggtgcaggacagtgggtgcagcccaccgagtgtgagctgaagcagcgcgaggcatcgcctcacccagcaagtgcaaggggtcagggaattccctttcctagccaagggaagctgtgacagacggcacctggaaaatcaggtcactcccactctaatactgcgcttttccaacagtcttagcaaatggcacaccaggagattatatcccgcacatggctcacagggacccatgcccgtggagtctcgctcattgctagcacagtagtctgagatcaaactgcaaggcagcagcgaggctgggggaggggtgaccgccattgctgaggcttgggtaggtaaacaaagcaggctggaagcttgaactgggtggaacccaccacagctaaaggaagcctgcctgcctctgtaggctccaaccctgggggcagggcatagctgaacaaaaggcagcagaaacctctgcagatttaaatgtccctgtctgacagctttgaagagagtagtggttctccaagcacagagtttgagacctaagaacagacagactgcctcctcaagtgggtccctgatccccgagtagcctaactgggaggcaccccctagtaggggcagagtgacacctcacacggctgggtatccctctgagacgaagcttccagagaaacaatgaggcagctacatttcctgttcagcaatattcaccgttctgcagcctccactgctgatacccaggcaaacagggtctggagtggacctccagcaaactccagcagaactgcagctgagggtcctgactattagaatgaaaactaacaaacagaaaggacatttacaccaaaaccccatctgtatgtcaccatcatcaaagactaaaggcagataaaaccacaaagatggggaaaaaacagagcagaaaagctgaaaattctaaaaatcagagcacctctactcctccaaaggaacgcagctccttgtcagcaatggaacaaagctgggtggagaatgactttgacaagttgagagaagaaggcttcagacaatcaaacttctccgagctaaagaaggaagttcgaatccatcgcaaagaagctaaaaaccttgaaaaaagattagatgaatggcttactagaataaccagcatagagaagtccttaaatgacctgatggagctaaaaaccatggcacaagaactacatgacaaatacataagcttcagtacccaactcgatcaactggaagaaagggtatcagtgactgaagatcaaatgaatgaaatgaagtgagaagagaagtttagagaaaaaagagtaaaaagaaacaaataaaacctccaagaaataggggactatgtgaaaagaccaaatctacatctgactggtgtacctgaaagtgacggggagaacggaaccaagttggaaaacactctgcaggatattagccaggagaactttcccaatctagcaaggcagaccaacattcaaattcaggaaatacagataacgccacaaagatactcctcaaaaacagcaactccaagacacataattgtcagattcaccaaagttgaaatgaaggaaaaaatgttaagggcagccagagagaaaggtcgggttaccctcaaagggaagcccatcagactaacagcagatctctcgtcagaaactctacaagccagaagagagtaggggccaatattcaacattcttaaagaaaagaattttcaacccagaatttcatatccagccaaactaagcttcataagtgaaggagaaataaaatactttacacacaagcaaaggctgattttgtcaccaccaggcctgccctaaaagagctcctgaaggaagcactaaacatggaaaggaacaaccggtaccagccactgcaaaaacatgccaaattgtaaagaccatcgaggctaggaagcaactgcatcaactaacgagcaaaataaccagctaacatcataatgacaggataaaattcatacattacaatattaaccttaaatataaatgggctaaatgctccaattaaaagacacagactggcaaactgtataaagagtcaagacccatcagtgtgctgtattcaggaaacccatctcacatgcaaagacacacataggctcaaaataaagggatggaggaagatctaccaagcaaatggaaaacaaaaaaaggcaggggttgcaatcctagtctctcataaaacagactttaaaccaacaaagatcaaaagagacaaagaaggacattacataatggtaaagggatcaattcaacaagatgggctaactatcctaaatatatatgcacccaatacaggagcacccagattcacaaagcaagtccttagagacctacaaagagacttagactcccacacaataataatgggaaactttaacaccccactgtcaacattagatcaacaagacagaagttaacaaggatatccaggaattgaactcaactctgcaccaagtggacctaatagacatctacagaactctccaccccaaatcaacagaatatacattcttctcagcaccacatctcacttattccaaaactgaccacatagttggaagtaaagcactcctcagcaaatgtaaaagaacagaaattatgacaaactctctctcagaccacagtgcaatcaaactaggactcaggattaagaaactcacttaaaactgctcaactacatggaaactgaacaacctgctcctgaatgactactgggtacataacgaaaagaaggcagaaatgaagatgttctttgaaaccaatgagaacaaagacacaacataccagaatctctgggacacatttaatgcagtgtgtagaggtaaatttatagcactaaatgcccacaagagaaagcaggaaagatctaaaattgacatcctaacatcacaattagaactagagaagcaagagcaaacacattcaaaagctagcagaaggcaagaaataactaagatcagagcagaactaaaggaaatagagacacaaaaaacccttcaaaaaattaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaacgagaaaatctagaagaaatggataaattcctggacacatacaccctcccaagactaaaccaggaagaagttgaatccctgaatagaccaataacaggctctgaaattgaggcaataattaataccctaccaaccaaaaaaaggccaggaccagatggattcacagccgaattctaccagcggtacaaggaggagctggtaccattctttctgaaactattccaatcaatagaaaaagagggaatcctccctaactcattttatgacgccagcatcatcctgataccaaagcctggcagagacacaacaaaaaaagagaattttagaccaatatccctgatgaacaacgatgcaaaaatcctcaataaaatactggcaaaccgaatccagcagcacatcaaaaagcttacccaccatgatcaagtgggcttcaaccctgggatacaaggctggttcaacatatgcaaatcaataaatgtaatccatcatataaacagaaccaaagacaaaaaccacatgattatctcaacagatgcagaaaaggcctgtgacaaaattcaacaacccttcatgctaaaaactctcaatacattaggtactgatgggacgtatctcaaaataataagagctatttatgacaaacccacagccaatatcatactgaatgggcaaaaactggaagcattccctttgaaaaccggcataagacagggatgccctttctcacccctcctagtcaacatagtgttggaagttctggccagggcaattaggcaggagaaggaaataaagggtattcaattaggaaaagaggaagtcaaattgtccctgtttgcagatgacatgattgtatatctagaaaaccccattgtctcagccaaaaatctccttaagctgataagcaacttcagcaaagtctcaggatacaaaatcaatgtacaaaaatcacaagcattcttatacaccaataacagacaaacagagagccacatcatcagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcgatatcgtgaaaatggccatactgcccaaggtcatttatagattcaatgccatccccatcaagctaccaatgactttcttcgcagaattggaaaaaactactttaaagttcatatggaaccaaaagagagcccgcattgccaagacaatcctaagccaaaagaacaaaactggaggcatcatactacctgacttcaaactatactacaaggctacagtaaccaaaacagcatggtaccggtaccaaaacagagatatagaccaatggaacagaacagaggcctcagaaataacaccacacatctacaaccatctgatcattgacaaacctgacaagaacaagaaatggggaaagggttccctatttaatcaatggtgctaggaaaactggctagccatatggagaaagctgcaactggatcccttccttacaccttatacaaaaattaattcaagatggattaaagacttacatgttagacctaaaaccataaaaaccccaggagaaaacttaggcaataccattcaggacataggcatggacaaggactttatgtctaaaacaccaaaagcaatggtaacaaaagccaaaattgacaaatgggatctaattaaactcaagagcttctgcacagcaaaagaaactaccatcagagtgaacaggcaacctacagaatgggagaaaaattttgcaatctactcatctggcaaagggctaatatccaggttctacaaagaactcaaacaaatttacaagaaaaaaacaaacaaccccatcaacaagtgggtgaaggatatgaatagaaatgcaaatcaaaaaccacaatgagacaccatctcacaccagttagaatggtgatcattaaaaagtcaggaaacagcaggtgctggagaggatgtggagaaataggaacacttttacactgttggtgggactgtaaactagttcaaccattgtggaagacagtgtggcaattcctcaacaatctagaactagaaataccatttgactcagccatcccattattgggtatatacccaaaggattataaatcatgctgctataaagacacatgcatatgtttgtttattgcggcactcttcacaacagcaaagacttggaaccaacccaaatgtccatcaatgatagactgaattaagaaaatatggcacatatacaccatggaatactatgcagccataaaaaaggatgagttcatgtgctttgtaaggacatggctgaaggtggaaaccatcattctcagcaaactattgcaaggacaaaaaaccaaacaccacatgttctcactcataggtgggaattgaacaatgagaacacatggacacaggaaggggaacatcacacaccggggcctgtcgtggggtcgggggagaggggagggatagcattaggagatataactaacgtaaatgacgagttaatgggtgcagcacaccaacatggcacatgtatacatatgtaacaaacctgcatattgtgcacatgtaccctagaacttaaaatataataaaaaaaaaaaaaaagaaaagctaggagtcaaaacatcatagaaacatcatagtctagtgaggggtatccagcctgtctattgctacagtttttcatccatggcctttttatgtctaactaaaccctatttagatttccctggtagtaactgtaacagatagtatttatgtgtctgtcttttccaaccagactataatcttctcaagagagattctagtggatgtgcactgatatcatattgtgcttttaatttcaactttcctgttggttaatgatgttaagcatcttttcatgtgcttattagccatttgaatatcttctttggaaaaatgtctaatcatgtccttttcccattttttaatcaggttattttttttttctctgtgagtgttttctgtctctttttaattgggtttttttttataatcgagttgtaagagttttttttttctattctggatagaagacctttaccagatatataatatgcaattttttgtccagcttgtgacttgtctttttattttcttaatagtgtcttttgaagtacaaaagtttttaattttaatgaggttaaatttatcatttttctcatggccctagctgttatggttatgtctaagaactctttgcccacaccaagaacatgagaactttctcctatcttttattgtagaagatttatagttttacctggtacattatgtctatggtccattttgagctaaacttcgtgtgtggtctgaggtaatgatctaaatttattttttttaatccgaatatccacttgtcccagtactacttgttgaaaagactagcttttcactcttatattgttttaatacctttgtcaaaaatcataagcgattattgcaaactcttaattctgttccatttatctgtatacctatctttatacaaataccacactgtctccattattatagtattacaaaatgttttgatattgagtagtaaaaattttctaaatttgttcttcctttttcaaaattattttggttattctagatcctttgcatttctttataaattttaggagaaacctgtcaatttctacacaaaagcctactgggattttgataaagattgtgttaaatctgcagattaatttgaggaaaactgtcatcttaacaatattgagttctccaatccatgatcataggctgtctctctattttaaattttctttatttcaagaatggtttataaaatgcaatgtacaattatcatacttttgttaaattgttggtagatgccctttatcagaatgaagtttcttctagtttgctgagaatttttattataaatgttgggttttatcaaatgttttttctgcatctttgagatgatgtatttttgtccttcattctattaatatgatatatacattgcactactgattttcaaatataaagacaatcttgcatttctgaaataaatccaactgggtcatgatatatataatcttttttataagttttacatgttgttgaattgactttgttagtaagttattaaagaactttgtatctaaaaataataataataataatattaataatggctgccacttacctaagggcttactataagatagatactgtgctaaacctaaacatacaaactacttaatcttcataataaccttatgaagtagataatattatccccatttatagctaataaagttggggcttaaagtggttattttccaaagtttcactattaaagttaaagttagcattctagtcctgctgactcattctaggcctttctgactcttaagtttgtttttgttgttttttgagatggcatctcactctatcacccaggctggagtgcagtggtgtgatttcagctcgctgcaacctctgcctcctggatgcaagcgattctcctgcctcagcctccccagtagttaggactacaggtgtgcaccaccatgcctggttaatttttgtatttttagtagagatggggtttcatcatgttggctgggctggtcttaaactcctgacctcaggggatccacccgccttggcctcccagagtgctgggattacaggtgtgagccaccacatctggcctctgactcttaagttttaagaatttactacttttcactaatttttctatatccttttctctgatattaatctgataatagtttagacatcttttgaaacagagtatttaaaccttcccttaaagaaactttcctttagttatgaaagattaaccaaccatacttttaagtaccaatcagtttctattctgatactgcaattttttgaaatttctaccattggtttttctagccctttatcatgtcttagcaattatctccctatttcccatctaatttggaaaatgggttagtactttccatcaaaccatgccgtcttctacctcaagcaacactaagcataaatttaattttacatgtgcctattaagattgtaattctaaattatatttttattttgcatttatttttagatcaatatttaacactttgtttagtgagctaccctggaaatcaagaacatatattcaacttattgttctccatggcaccattatacctatatacacatttaattttcagttaataaatgactgactgataaaagactactcaaaataccaatagcacattattggaaattttatggaagtttctgaacttctagatgaacattcaacaagtacctcccaggtacacgctcatttagtatatttggttttcttggaatgaagaaagagaagaaaatgaacactaagtatttcctggattcattattctaaaagagcatcctattatccttctgcaaatattaatattccactgagaagcaagattgaactatttgtaaggagaccttttaacagcttaaatctgttttgctttttcaattaggatataaaaatatagacctaactcctataaattaaacagactattcctctctagatgaaggaattaaaaatggctgaagcagatagtgacattccatgcctcctctttgaaagatagttcagagcgcctggaaagcaaagatactgttattttgagctactacatagcaaacagctaagaatgaaaaaaagagacaggtaactaggcagttggaaaagtgacttgtgccagaggatttgagagtctgttgaaagcctattatactctgagagattagaagaaaagtactaagcaagtattttataactttggactaacagacataagctaaaaagaggccatactgaaagaaacctgtagcaactagtgtggtaagtctgagagaagacactgtttagaaaaaaaaaaaaaatcagttcattttagtaacacagtataccccttatgtttagatatctgtttcttccaatttcactgtatatatttcatggctaacttattttatcacataaacaatcataattctattaaaaacacaagcatgtgatagagggatattgtttttctccattatccctgcctaaagtttattcattactctataacgagaccatattagcaactaccaatagccatcaaaaataaaagtgaaagacttatagaaaatttagaagtccctcctaggtttatactgtagccttagtccttttagcatgaagtggtttcttaaattagatgctcttgtaagtgacacctttactacagggacttaaaagtctcagtaggccataaaaggttaagtatatggcacattttcaataaaatttaactatatcctctcatgcattttacaattcatattcttccttcaagactcaggtaagacatccacatagtgaagcccctccctattccccaggcaagttagtctgagttccacaacactttatccttatctctaagagtacagcacttatcctccatgtgttgtcatgaatctcggtcaggaaggctcacccagggttgaaacactaatgtacttatggcaaccattttgtgagtgacaacctctgcattcaacaaagcagcctctcaataaaaattgtggagtacatatacaaatcaagtctttaattgtataactgttttccaattgggcaaaatgttacttcatttccaggaaagaaagcattttacaatgtaatgggaagaacaatgaactcaaaatccaaagtttagattttagtcccacctacataactgtgtgaccttgaaaaaacagcctcagtttatctacctacaatgtatcagggtaaaacttgatttctaataacactttcaaattaaattttatttaatttggaaacttttttatctggttaactttttatgagttgcttggaattattgcctagagtactaaatgctaaaatgatgacttcagccaagcaaacaaaagagtcattcccaactagcacagggtggaatagattatttcgcagctgaaactggtcaactccgagaaaggaatgataatgctaaccaggaaggtcttgtgctatatggggttgtctctttactgcctcttcatctcaagagaagtgttctcaagaataaaactggcagcattcaatacccaccaacactccagaatgcgctttggctacaaaatcaatgtgggccctgtgtttctcttccattctcctcttctacaaagaggttaaagatgacatgaagaaaaattttccatacactaggttgggtattgctagttcataagaaaagatattatggagttatcacagataacaattaagttggaagaaataaaagtagtaaacaaaaatgtttaatatgagtcgggttgtggaggtcccatgaaaatcaagttctgtgaatctactcatatgaaggatcaagaaataaaggcctggagtcagtgatgtgaggtgggtgagggaggaaataaaaattatttaaggaaggcagaccaacttgttctccagaaattatacgatagcaaaaatttgtatcacaagcaaacatctcttaaacatcataaagagaattatctgattcaaagacataaggatattagttcgttggtttttcctcctaaaagaatataatcttgaaactattttaaaagaaaaagacatgctctatagcactagtttactgcagtgttttctgcttagtatatactcttcttttaggctaggtaggcccacttgaaaaagagactgcattagcagctggagagcctagttggctcttcagccgtaaatcctctcttaagagagtggtgcagcagccacagaataaacgtagaaactgctcctcagggtatgtgcaaaagctccacccttgaaaggcatactatgtcctacttgccctatgagaagagaataatgagtattctccgtcctttcaacacagattatgacttgaatgcactggaaaggagaagactttggagaagtaagactcaattatacaaggatatataaaatcccattttccacaaaagaagttgaaaagtagtaatcctgggaaaatatgttcagagtaaatagaaattggccattaaaaataatgattttatggataaaataaatattatacttaaatcctaacgacagaagaaaaataccacttttattaatctctcctttactaatatattagaaagcacaaaaattctattgaaattacccaaaaaaattgcaaaagcatcagtcaaatcatcattattttgtgtcaaattattctcctgcctttgttgttttatcaaaagactcatggacagatccaagttcatctacattttctcctatgttgtcatctatattttctcctatgttatcttctaaaagctttacagtttatcattttacacttaggtctatgatccattttaagtgatccattaaaatggtttattaatccatttttaatccatgatccatgagttaatttttatgaaagatataaagtctgttttcagactcattttttttgtgtatctagatagccagttgttctggtgccatgtgtcaaaaagactatccttcctccattgaattacccttcctcctttgtcaaagatcagtttactatatatatgggggtctatttctgcgctctctattctgtcccattgatctatttgtctattctttcaccaataccacgtggtcttgattattgtcattttatagtaagtattgagttgggacttgtcagccctctgactttgttcttcctctttagtattgtgttggctattctagttcttttgtctttccatatacacttttataagtgaattcataattttgtattctttttcttaaagagagcctctgtaattctgtaagctacagactccacaaaattaggacccacctctgcatagttcaagttatgattatagattaaaatctagagggagaaggcagagggctgagaccctgctgtatatccttatataaggagaagagagaaatgaagaaaaagaacaagaaggaagaaagactgcgttcctttcaaattgttcaacaattcgaattccaaaccacatatctacaggtgcctaaatatagtacctctaatctcagtatacaaaaaagatatgttacttacctataaaccagtttgtttatttgaaagcatcagatactaccaacaactttgaagaaaactgtgctgctatgcctatgccttttagttttcaaacagttcttaatttccaaaacagatgctaaccagaattttagtgtaagagtaggaaacttttagtaccacttcctttatgaaaagccctttaattcccctaggccaactcagactcctattcctccaatatagccccaatgctagagatctgtaattgtttgtacatatttcaaatattaaatattgtacatattgaagtataacttcagtgagggcagggattgggtcaagtcttatcatctacatatccctagtgagtagcacagtgctagcacatgccagcacattctaggtgctcaaatatgggttgagtgaatattaacaaaaggcaaatactctaattccaagtttatgaatgaggaagctgagggttgccccagaatacatgcgaagcaaatggcaaagctaaaatccaggtctctcaactctgaaaatttctccctaatacagtaacaataatatattttataacataagccataggagaacaaaatgactatttaatttttcttttttgagacagagtctcgctctgtcacccaggctggagtacagtggcacaatcttggctcactgcaagctccacctcctgggttcacaccattctcctgcctcagcctcccgagtagctaggactacaggcgcctgccaccatgcccggcttttttttgttgtgttttgttttgttttgttttgttttgttttgttttgttttgtttttgtatttttagtagagacggggtttcaccatgtgagccaggatggtcttgatctcctgacctcgtgatccgtttgcctcggcctcccaaagtgctgggattacaggcgtgagccaccgtgcccggccaaaaatgactatttcaaatgaagataaagttatttttccctgctggctaagtacaatttatcatttcctactcccaccatacttccaccctcacccagattatatgtgaactttattttcagatttgtaaattttcttcatactaagaaaaatgaacaggtaacatataatagctgaagccattactttctaatgaaacagacagaacactaaagaattggtaggatggttgcatttctcttcttcagaactgtaacagagaccagatctgctctgggaaagtagtgtggcaagtatgttcaattgcccacacccacgcaatctctataataaactatgtttcttttaaggcctagactcatacacacacacacatatacacatgcatggaaaattttagttctgacaaccatgaaacttaaggacttacttcttttggactccatttagctcattttcactttgcattgtgattgtatctgagacatgagcttatttatggaagtttttgtaaaggataggcaaccctctattagtaacaatataacaatgacaacaatagcaaccattcattgagtgcatggcttcttattaagcattcaataatattagctaatctaatcctcatgatcttatattgctttccctactatataaatgggagtgagatcaagtagtttgcacaagctccataaaactagtacatggtaaatacagaatccaaacctacgtctgtttaaccccaaagttcctgctcataaccattcttctatgttgcttttaggaataaaggacttcacaggttggtggtctctaaatatttttattgtatatacttattgataaaacatttttgaacatatatcattcatatatacatacgtatatacacacatgtatattacatatgcacctactgcggtaatatataattacattataaaacagatcaaacagaattttaaattaatcagctgaaaattaagtaatatttttaaaatttgttttactttgataatggttcaaaaaccattttgctccatttaaagaacagtattaataattatgttctgggcattatataaactttcaataagattcatgaaatataacaaatgtaaatccaagtttcaaatagttttttaataacagacttttttaactctttaaaattttttagttttataaaattagaggtacaagtgcagttgtgttacatgaatatactgtgtattagtgaagtaatttaggttttttttttggctcaacttcttttcggactatttttacctcattacatggctgaccaagagttcatattaaagacaaaccattagctttgcaattttcttgttgttcctatgtgctgacattattagtactatatttaatccaatttattttcaaaaatccctttactttaagtccacttagctagggacatgtgaactgcaacacgttgaaatacactggaaataaactaatcaattaggaaaaatttccactccaatctcagaataaaccagaattgtacaaaacaagtcatcttcttacaggttattagcaaaacttccccacccaggggatttccttgcatatcttctgaagtgcctctacaccctctctggcccacacctgaccttggacagcacttaactaaatactctaaaattcacccatattcaaccaaatctggaaagagctgtctgcatttaagtcaccgtccaaaaaaaattcctttttattcaatgagttttgatgtgatgtcatcaaactaaatgaaggaacctctaagaaactgcttctcatactgagaaaacaggagagctaaagttaaaatgaattcaaaggacttcttcctacatcatctttaacaaaggaagatgaaaaacaagaagtaatcatcatctcttcagatctcttaacacaaagacttctacaaacatggaggaagttcattctgaaattcataaagacaaagtttcaacaacttaggatataaataaatcaatgttcccaagtctaatcctgagaaaagaagaatggctgggtgcggtggctcatgcctgtaatcccagcactttggggggctgagacgggtggatcacgaggtcaggacatcgagaccatcctggctaacatggtgaaatcccgtctccactaaaaatacaaaaaattggctgggcgtggtggtaggcacctgtggtaccagctactcgggaggctgaggcaggagaatggcgtgaacccgggaggcagagcttgcagtgagccaagatggcgccactgcactccagcctgagactccgtctcaaaaaaaaaaaaaaaaaagaagaagaagaagaagaacatgaccactttaaaaatatatatcctttagttttttttgtttgcttgtttgttttgttttattgagacagggttgctctgtcacccaggttggagtgcagtggcaggaacatagttggccgttaacatccaactcctcagcttcaagggatcctcctgcctgagccaacggggaagctgggactatacacatgcaccacctcgcccagctaaatgtgtttttttttttttttgagacggagtctcgctctgtcacccaggctggagtgcagtggcgccatctcggctcactgcaagctcttgcttcccgggttcaccccattctcctgcctcagcctcccaagtagctgggactgcaggcgcccgccaacacacccagctaattttttggtatttttagtagagacggggtttcaccgtgttagccaggatggtctcgatctcctgacctcgtgatccgcccgccttggcctcccaaagtgctgggattacaggtgtgagccaccacgcttggccaatttttttttttttattttttgtagagacagggctttgctatgttgcccaggctgttcttgaactcctggcttcaagcaattttctcatcttggcctcccaaagaatctggattacaggagtgagccactacacctggcctcctttagtgattctctgtattaactgccaatgcaatgcttttactgtacaatacgtacagtttttgtaattataacctttttcccatattgtttttttctgatcatatgtataaaatacaattttatgaaggttgaatctaatgaaaaattgagctggtaaaaaaaagtattcacttatgtgatggtttgtaagaggacttctaagcaacagagagcatatctttgtacttaaaatttgacttaaaacagttggagaaaaggggaacttctagtcatgtgccttttaatctcatgaccacatttgtgcatggccattgacttttacacagacattccattgtgttgataacagcattaggctcattctaaaaatgtaaaatgccatctaatttttgttcagctcaacttcattttagggtaatcagaaagaattctaataccaacaaatgttcatctagttagcatcatgccttaaaagaacccaaaatgtttagctaaaatatgacaatgcttcccaagacacattttcagacctttatttcccaggggactgagtgattctttgcattttatttcactaatccttacgtacatcctagattaccaagaaacactgatctagattcaaactctaacagtctaaattccaaacctcacattgtgaatcaatatactatgtggaattaaagttgtccaaccacttgcacatttctgcaccaagggcccattatgattccttcatctataaaaagatgtagatttcttggcatttatatttttacagtctatcttattattcaaatacaaaaaaaccccagaaaattattagtccagttttgacaccctcgaagacaatgattcctaaaataaccccaagatcaaagcaatgcaaatattactacccacctatcaatgacgaggatgccaagatttctaacactgacaattatacagttgaaaagtcacagctaagagaggccttccctgactgccatatataagtagtccctactccgaacctgccaacctcatctctgtcaaagtggcagccagttgttgaacttctaagagagaatgcagatgaaaaagtgccctgtgagacacggagaacaaaagccagactccctaattagaacacaaaaagaaaaaagtactgcttgcctgctaccagaggcaacagttgatgggaagtggcagggagaagggaaggtaggggctgcaggagaggataaacgcattgccttgccacctagaatgcaggcaggttatatggctcaggaactgaaagtacaatacccccaaatatcaccaaagagcaggagcccccaaacagattctggtctgagaacactaaagacagaatagcgacaatccctaaactgctaacctggtaggggtgagaacaaaaaaagaaagaaagcgaaaagaaaaacgaaaagaaagactactaagcaatacatacaacacaaactttaaaagccagagaatacctttttttgcaatatacatgacaaaagatttctatccttaataaagagattttataattcaagaaaaccaataccccaatttaaaagtcatgtaaataaacaattctaaattaattaattaataaattaaattaatcctaaataagtagataattcacagaataaataacaaaaaacctcacatcacaactaagagaaccagagaaccaagagaaaaccaactctaaagctagcagaagacaagaaataaccaaactcggagctgaactaaaggagactgagacataaaaaaccattcaaaagatcagcaaatccaagagttgtttttttgaaaaaaaaaaaaaaaaaaaaaaaaaaaaaaaactaataaaatagatagaactctagctagacaaataaagaagagagaagacccaaataaacatcgtcagaaacaacaaagagggtattaccactgaccccacagaaatataaataatcataagcaattattataaacatctctatgcacataaactagaaaatacagaagaaatgaataaatttctgtacacatacaccctcccaagacagagccagtaagaaatggaattcatgaacagaccaataatgagctctgaaattgaaacagtaataaatagcctaacaccccaaaaaagcccaggaacaaacagattcacagtcgaattctaccagttataaaaagaaaagctggtactgttcctactgaaactattccaaaaaattgaggatgagggacccttccctaactcattctaggaggccaggatcatcctgatgccaaaacatagcagagacacaatttaaaaaaagaaaaattcaggccaatatccttgatgaacatcgatgcaaaaatcctaagcaaaatactggtaaactgaatccagcagcatatcaaaaatcttatccaccacatcaaaaagcttattcatcacaatcaagtaagctttatttctgggatgcaaggttggttcaacatatgcaaatcaatagatgtgatccatcacataaacagaattaaagacaaaaaaaaacactattatctcaatagacgcaggaaaagctttccataaaattcaacaccccttcatgttaaaaactctcaataaactaagtattgaaagaacctacctcagctgggtgtggtagctcacgtctataatcccagcactttgggaggccaaggtgggtggatcacaaggtcaggagatcgagaccatcctggctaacatggtgaaaccctgtctctactaaaaatacaaaaaattagccaggtgtgttggcaggcgcctgtagtcccagctactcaggaggctgaggcaggagaatggcatgaacccaggaggcagagtttgcagtgagctgagatcacgccactgcactccagcctgagcaacagagcaagactccttctccaaaaaaaaaaaaaaaaaaccatacctcaaaataataagagccatctatgacaaacccacagtgaatatcatactgaatgggcaaaagctggaagcactacccttgaaaaccagcacaagacaaggatagcctctctcaccactccattcaatatagtattggaagtcctggccagagaaacaggcaagagaaagaaataaagggcatcccgggccgagtgtggtggctcacgcctgtaatctcagcactttgggaggctgaggtggtcagaccacttgaggtcaggagttcaagaccagcctggccaacatgatgaaaccctgtctctacgaaaaatacaaaaattagctgggcgtggtggtaggcacctgtattcccagctacttgggagatgaggcaggagactcactggaacctgggaggtggaggttgaagtgagccaagagtgtgccactgcactccagcctggatgacagaacaaaatgaaaagaaagaaagaaaggaaaagaaagaaagaaaagaaaagaaagaaagaaagagagagaaagaaagaaagagaaagaaagagagagagagggagggagggagggagggagggaaggaaggctgaaataggaagagaggaagccaaactatacctgtttacagttgacatgattctgtatctagaaaaacccatagtctcatctaaaagctccttaaactgataaataacttcagcaaagtctcaagataaaaaatcaatgtacaaaaatcactagcattgctacaccaacagtcaacctgagggctaaatcaggaatgcaatcccattcacaactgccacaaaaagaataaaatacctaggaatacagctaatgagagaggtaaaaaatctctataagcaaaactacaaaatactgctcaaagaaatcaaagatgatgcaatcaaatggaaaacattacatgctcatggacaggaagaatcaattttgttaaaatggtcatactgcccaaagcaatttatagattcaatactattcctttaaactaccaatggcattcttcacagaactagaaaaagctattttaatattcatatggaagcaaaaaagagcccaaatatccaagacaatcctaagcaaaaagaacaaagctggaggcattacatcatactacctgacttcaaactatgctacagaactacagtcaccaaaacatcatggcactggtacaaaaacagacacatagactaatggaacagaatagcgggcccagaaataaggctgcacatctaaaaccatctgatctttgacaaagctgacaaaaacaagcaatggggaaatgacttcctattcaaaaaatggtgctggactaactggctagccatatgcagatgattgaagctggaccccttccttacaccatatacaaaaatcaaccaagatgaattaaagatttaaatgtaaaacacaaaacttaaaaaccctggaagataacctaggcagtaccatcctggacataggaacaggcaaagatttcatgacaaagacgccaaaagcaatcacgacaaaagcaaaaattggcaaacaggatctaattaaactaaagagcttttgcaccacagaagaaactattaacagagtaaacagacaacctacagaatggaagaaaatatttgcaaactatgcatccgacaaaggtttaatatccagcatctataaggaacttaaacaaatttacgatttaaaaaaaccattaaaaagtgggcaaaggacatgaaaagacactttttgaaagacatatatgtggccaataatcctatgaaaaaaagctcaacatcactgatcattagagaaatgcaaatcaaaaccacaataagataccatttcaaagataataacagtcagcatctgttctccatatcctctcctgcatctattatgttttgactttttaataatagccattctaatttttttttttttgagacagagtttcactcttgttgcccaggctggactgcaatcgtgcgatcttggctcactgcaacctccacctcccaggttcaagtgattctcctacctcagcctcctgagtagctgggattacaggcatgtgccaccacgcccagctaatttttgtatttttagtaaagatagggtttcaccatgttggccaggatggtctcaatctcttgacctcatgatccacctgcctcagcctctcaaagttctgggattacaggcatgagccaccatgctcggccaaccattctaacttttattaaaaagtcaaaacataacagatgctggcaaggatgcagagaaaaaggaatgcttatacaccatgggtgagagtgtaaattagttcaaccattgaggaaaacagtgtggtaatttctcaaagagctaaaaacagaactaccattcaacccagcaatcccattactggttatatacccaaaagaatgtaaatcattgtatcacagacacatacatgcgtatgttcattgcagcactatttacaatagcaaaaacataaaatcaacctaaatgcccatcaatggtagacagaataaagaaaatgtaccacagaatactatgcagtcataaaaagtaagagcatgatctttgcagggacatggatggagctggaggccatcatctttagcaaactaacacagaagcagaaaaccaaatactgcatgctctcacttacaagtgggagctaaacaatgaaaacaaatggacacatagaggggcacaacagatactggggcctatcagagggtggagggtgggaggagggagaggatcaggaaaaataactaatgggtactaggtttaatacctcggtgatcaaataatctgtagaacaaacccccatgacacaaatttacctatctaacaaacctgcacatgtaccactgaacttaaaaaatatattaaataaaagcttacaaaaagaaacaagtttaaaaaaagtgtttaacttaaaagaaaatatttttaaaagataattcccagaaaaaataaaaataaagaatgtaaaaagacagttaccttcactcgcagtcaatgaaataaaattacaaacaacaatgccatatcaattattgtctattacactgacaaagataaaagaatggaaaataatcaggattaatatgagacaagatttatgagctctcctgtgtagtgttgggataagtataaactggcaggacatttataaaagtccctttactaaatacattaaaattttaaatatgcgggaagcaatcacacttctaggaattgtgcaaaaatatatctacaatgatgttcatcatgacatcatttataatcatgaaaaattagagacaaccatgagagctatcaacagaagatcaattaaataattatgatacatccatacaatgtaattctaaggtagccattaaaaataatatgatcctatacttattgctatagacagaaagaagtccacaaaattttaaggtggtaacaagataacaggcacatactgtattactggatttatataaaattatgtatatgtatgtgcttctatgtttatgacttacatttgcatgtgtgcgagaatgcatagagatgattagaagaaaaccaatcaaaatatttttgtctgtattataatcagaaataataacagaagttatcctacttttaaatatatataaacttatttttacctcaaatgtactggcttcagtgggaaaatattcagatagttatgtacattaaataataaagttatttgcatttaaatcatgtgaaaagcagctatcaccactatttttcaatcttcttttggggattttgataaattaaaaggaaaataatcggtaaaaatttagaaaaaagacaaatatacctttgtccttgataagactgtatacctatgaaacacaaaacactctatgaataagctactagaattaagaaaatttggtaaaaggaatgaatacaagtttaaaataattaaagtatgcattttctctttacaccagaaaaaaacttacaagtggaaaaaaattcactctcaataaaactataaaatatcttaaaataaatttaataagaatagaaagaaaattctaaatattgtcaagttaccaagtgacacaaaataactgaacaaatggagatatatactattttcttaagtggaagacaatactgaaaaatatcaatccttcccaaattggacaataatttgaatgtaattccaaatggaatccagtgatgaattttcttgaactggagaaaatgaaaagttcattttgaaaagtaattatatgggaatagtcaagtaaatctttaaaaagaaaaatgagagagtagttaataagccttaccagaaatcaaaacagtataccattggcacagaaataaagaataggaaaatgacagaaaacagaattcagaaataggtacaaatacatgtgggagtataatataatatataacatctatggtatttcaatacagtggcaaaaaatgttttaaaaacagtgtagacaaagctggctagtcatttggaagaaaatgttatatacttatacacatcacactacatgtaaacataaattccagtcacagtaaaagagtaaagctctaaattaaaaacagtcaaaaaatagattatatccagagtgaaaaatggtttgcaatacatatgacaaaggattaacatttctattcacaaagagcaattacaaactattaagaaaaagatcaacacccaatttaaaaaggcatagaatatgaaaaggtaattcaccaaagaggataggcaaatcaccaataaacaggttaaaatatacaaaccccaattatagtcagaaaactgcaacaattagatgttttttagctgctagactgaaaaaaactttaaaagaacactaaaggctttgcctgctagactaaaaaagattaaaaacagcactaaaggcagagcgtggtttcagctcttctctccttatcgcttctctccttcttgttgcccacaacaaggcaagtgggggcgtgtttcagcactgtttgtgttacagctctttcagtcccaccattgagttcttgtcctgtgtccaggaataatgaggtacatggaaaactaggggtgagcaaggcaaagagttgctttattgagtgactatacagctctcaggagatccaaggtgggtagctcctttctacaggcaggtggttctgatgagtacagctgtcagtggcaaggagacccatagtgagcagtcctagtcacaggcaagtgatcctgtcaagtttgcagccctcagtgaagaggagaccttcagtgggtagctcatatccacaggcaggtcgtcctgacaattgtgcagctctcagtggagaggagacccagagtgggtagctcctatctgcagacaagtcatcctgatgagtgtgcagttctcagcagagaggagacccagagtgggtagctcctatccgtaggcaggttgtcctgacgtctgtgcagccttcagcaaaaaggggacatggagtgggtagctcctatccaatttcagagcaaagttgaggctgcgcctgggcactgaggcaggttgtcccattgattctgcagtcctcagtggagaggagacctggagtgggtggctcatacctgcaggcaggtcatcctgatttctgcctgagtctgactgagtccagggtttttacgggcttagaagggagaaagtgtgtactgatttggtccatgggtggctatgggtgggcccggaaaaaggaccgtaagttctcactctggtcctcagactccagccagaactcacagcctggcccccatgcttcaggcaattcctggcttgaaggtggggcttcaccagatacccaccactttctgcccagaagcctgtctgcctcctgccaccattaatcatgtccacaactcccaggctgttagtgccaagaggtgcctgcaggcctgtgctgagccaccctcagcccctccctcaggctccctcctgtgtttgttggcacccaaagtccagagggggccaaggcagcaggggactggtgtgtcagcactgccccaagcacatgccaacccagccaggttgcaacagtacccaggcttggcctcaactttgctccaaaattggtgcaggcaccagaagcatggcaaggccagacagcaggagtaggcacttccgagcctgctggggcagaggagcttccctggcatttgagagtgcagagatccctgggtccgcagccatcactgggcagcttcagctttgtctggaaagatggggctcccactgtgccaactcaaaatggagtggggctcctgccagctccatggagtgtgcagccctggctgtgcctcccaaactgcagctggcatcttcacagcagccactccatatgggctgccactgccatcaatagcataagggaagtctaataatggagtgtcccaaaagatgacatagtacagtattgtgagtagcagcagaagatagtggtatacagtaagcactcagcaaatgctgttgaaagttgaatcggggtattttgattacccatgcccccaatcaggcagaaaatagctataaaacctcttcattacacacacacaaaaacttcctctcctgatccctaataaggaaagctttacgctcccaaacctaagaatcactgctctggataaaaatcctgaaaattcatgtattttaaaccatacttcaaaatgaactctgctacactacctggagagtgaatcatgcagagactgtgtctacgattggtccttccatgataaaaatttaattttgaacttttctttatggcatgggagaggccactgctcagactctatctaatcccctggctcctagactataatattaggaagctgagatagctaaggaagacggcagattggatactgggttaatacacagttcccactggcatggacagaacagcatgtggagattcacactgtgaacttttgctccaagaaccaccatgggaacgtactaggaaaactgaaagaattcactgatcctttgaaagaagtggcatgccactgcaaattctccatcacaggcaaaaaactgtgagttcccaaagcgtgagagggggaaaacatgcctctgaacacacatccccaatggggaatctgaaaatccagatcacaggagaaagatttaaccttacctatagttgaaatggatttagggaaccatgcaaaatacagaagtagaaccaacagtgggaagagccttgtaggcactcctagtctttagctcgagcccaaggaagtcatccctaacttatctctcaagggtccctagagaaggcagcaagtagaattagggaggggctacagggtgaaagaagcttccaactgaaatctgtaataattttgactgggagtgaattttcatgagcagaatccaggaggcgaatggggactgctgcagataacgagcacaggagctggtgatgacagtgtgagcagatgggaggggcagggcctgaaatctgtgcttgctttctcagcagggaagcttacgacctggtgcaaggtctgagtgaggcactgcaggaacaagaccagccttaccaactgtgtgggagctgagtgaggccttttgctaccagctatgcccccacttccctggtgaactatgtgacacagcagaggcagccataatcccctctggaatataaccccattggcctgagaaccacaaccaatcccccacagtggccgcagcaagccttgcccaagtctgagcccagactcacctaaccctgccccaacctgatggtatttcactacctgccctagtagctgaacagaaaagacagctcatccaagctttatggccccacccatcgcctgggaaaccagaatagttaccctggccaatgtatggcaagcgtagatctccttactactgttgcagctggtgctctcttgaaagtgccaccttctggctggaggtcaaccaactcaggccattacaacaactcatgacagaataaccctgctcccccaagaataaggaaacaacaggtaattctactgcctgcaacatcctggctaaccagaggttctgagtctctacacatgacaactttactgctagcataatccatcattcaagaaagccagcacactaaacatagctacaactaaggaccctgacacagtctagtttactcccctgccacctccaccacagcagacactagtatccatggctgagacctgaagatggatcacatcataggactctttgcagacattccccagaaccagcttggagcctgggagccccacttgatagcgagacccagaagggcaataatgatcattgcagtctggctcccagaaagccccatccctaggggaaggggaagagcaccacatgaagggatcacaccatgggacaaaagaaactgaacagcagctcttgagtcccagatcttccctctgacatagtctacccaaatgagaaggaaccagaaaaacaattctggtaatatgataaaacagggctctataataccctgaaaagatcacactagctccccagcaatggatccaaaccaagaagaattctgaattgcctgataagcaattcaggggattgattattaagctactcaaggagataccagagaaatgagagaactaacttaaagaaatgaaaagaacaatatggaatatggattaaaaatgcttcagagaaatagatatcataaagaaaaacaatcacaacttctggaaatgaaagacacacttagagaaatacaaaatgcactggaaagtttcaacaatcgactagaacaagtagaagaaagaacttcagagctcaaagaggctttcgaattaacccaatcggacaaagactaagaaaaaagaatttgagaaaaatgaacaaagcttccaagaaatttgaaattatgtcaaacagacaaacctaagaataactggtgttcctaaggaagaagagaaatctaaaagtttggaaaacttatttgagggactaattggagaaaacttccctggccttgctagagatctagacaactaaatactagaagctcaaagaacatctgaggaattcattgcaaaaagatcatcacctaggcacatagtcatcaagttatctataatcaagacacaggaaagaatcttaagacctgtgagacaaaagcatcaggtaaactatacagaaaaacctataagattaacagaattctcagcagaaaccctacaagccagaagggattggagtattatctttagcctcctgaaacaaaataattgtcagccaacaattttgtatccaacaaaactaagcttcttaaatgaaggacagataaagtctttttcagacaaatgctgagagaattcaccactaccaagccagcactacaagaaatgcgaaaaggagttctaaatcttgaaacaaaaccttaaaatacaccaaaatagaacttccttaaagcataaatctcatagggtctataaaacaataacacaatggggaaaaaaacacaaggtattcaggcaacaattagaatacagaacagaacaatacctcatatctcaatactaatgttgaatgtaaatggcctaaatgctccacttaaaagatatagaatggcagaatggataaaaatccaccaaactgggaatgtaagttagttcaaccatagcggaagatgatgtggcaattccttaaagacctagaaccagaaataccatttgactcaacaatcccattacagggtatatacccaaaggaatataaattattatattacaaagatatatgtatgcatatgttcattccagcactattcacaatagcaaagacatggaatcaaccaaaatacccatcaatgatagactgaataaagaaaatgtggtacagaagatacaccatggaatacgatgcagccataaaaaggaatgagatcatgtcctttgtagggacatggatgaacctggaagccattatcctcagcaaactaacaaaggaatagaaaaccaaacaccatatgttctcacttataagtgggacctaaacagtgagaacacctggaacagggagggaaacaacacatactggggcctgctgggggatgtggcaaggggaagaaaagcattaggaaaaatagctaatgcatgctgggcttaatacctaggtgatgggttgataggcgcagcaaaccaccatagcacatgtttacctatgtaacaaatattcatatcctgcacatgtatcccagaacttaaaataaaatttaatttcattttttaaaaaaaaatccaccaaccaagtatctgctgtcttcaagagactcacctaacacataacaactcacatcaacttaaggtaaaagagtgaaaaaaagatatcccatgcaaacggacaccaaaagtgaacaggagtagctactcttatatcggaaaaaacagacttaaaagcaacaacagtttaaaaagacaaagagggacattacacaaagctaaaaggatcagtccaacaggaaaatatcacaatcttaaatatatatgaacctaacactggagctcccaaatttataaaacaatgaaatgagatacacagcaacacaataatggtgggggacttcaatatttcactgacagcactagacaggtcatcaatacagaaagacaacaaagaaacaagggacttaaactataacctagaacaaatggacttagcagatatttacagaacattctactcaacatctgtagaatatacattcttttcatcagcacatagaatatgcaccaagatagaccatatatgtcacaaaacaagtctcaatacattttttaaaaattgaaattatatcaagtatcctctcagaacacagtgaataaaactagaaattaactccaaaagaaaccctcagaactatacaaatacatggaaattaaataatctgctcttgaatgatctttgggtcaacaatgaaatcaagacggaaatttttttaattctttgaactgaatcataaccgtgattcaacttctcaaaacctccgggatacagctaaagcaatgctaagaggaaagttcatagcatcaaatgcctacatgaaaaagtctgaaagagtacaaataaacaatctaagatcatacttcaaggaactagagaaacaagaacaaaccaaacccaaaccaagcagaagaaaagaaatcaagatcagagaagaattacatgaaattgaaaccaaaaaaaaaaaaagataaaagaaacaaaaagctggttctttgaagagataaacaaaattgatacatcattagtgagattaaccaagaaaagaagagagaagatcctaataagctcaattagaaatgggatgggagatattacagccaataccacagaaatgcaaaagataattcaaggctaccaggaacacctttacgtgcacaaactagaaaatttacaggacatggataaattcctggaagtctacaaccctcctagattaaatcagaaagaaacagaaactctaaacagaccaataacaagtagtgagattgaaatggtaatttaaaaattgccaacaaaaaaaaaagtccaggagaagatggattctcagctgaattctattgaacattgaaataattggtagcaatcctactgacactattccacaagataaagaaagaggttcccttccttaatcattctatgaagccagtatcaccttcataccaaaaccaagaaaggacataacaaaaacaaaaaactgcagaccaatatccctgatgaacatagatccaaaaatcctcaaaaaaaatactagctaaccaaatacaacagcatatcaaaaatataatacactatgatcaagtgggtttcacaccagagatgcagagatggtttaacatacacaagttgttgtacctgagcaagttagaaaaaggccacactttgagatgaattaagagtcctttattagccagcaaccaagagacggctaacgctcaaaattctcttggccccaaggaaggggcttgattaacttttataccttggtttaggaaggggaggggggcgtctagttaaaacaattttacagaagtaaagtagtcaaaaagttaaaaggataaatggttacaggaaagtaaacagttccaggtgcaggggccttaagactattacaaggtgacagacccggggctttgggagttatcaatcggacaaattcctggaaactgtggatatagcttgccacagtatcttatcagctaattgcattcttggatgtgctgggagtcagcttgcacaagttaagtccttgaggaaggggctgccagtgaaagagccaagatggagtctgtctggctctcttagctaagggagagtcaattcaggtggaaacaaggctaggtgattaaaggaaaagggagagtctaaaaacagagttagtaaaaaccaggttgggcattacaaagtcaataaatgtgatgcatcacataaacagaattaaaaacaaaaatcatatgatcatctcaatagatacagaaaaagcagctgaggaaatccagcatccctttatgattaaaacaccctcagcaaaatcaacatagaaggcacatacctcaatgtaataaaagccatctatgacaaactcacagtgaacatcatactgaacagggaaaacacaaccactatggaaaacagtatgaagattccttaaagaactaaaagcagaactaccatttgatccagcaatcccactattgggtatctacccagaggaaaggaagtcattatttgaaaaacacacttgcacatgcattttatagcagcacaatttgcaattgcaaaaatacagaactagactaaacgctcaacaaccaacaagtagataaagaaaatgtgatatatatttatatatgtgtatatatatatatgtatatacacatatacagaaacaaacacacatgcacaccatggaatactactcagccataaaaaggaaagaaataagaccatttgcagcaacttggatggaactggagaccattattgtaagtgaagtaactcagggattggaaaaccaaacattgtatgttctcactcataagttggaactaagttatgaggatgcaaaggcataagaatgatacaatggactttggagactcagagttggagagggataaaagatgacacactgattacagtgtacactgcttgggtgatgagtgcaccaaaatctcagaaatcacaactaaaggccgggtacagtggctcatgtctgtattcccagcactttgggaggccgaggcaggaggatcacctgagggcaggagttcaagactagcctggccaacatgatgaaaccccatctctactaaaaatttaaaaattagccagatgtggtggcacatgcttgtaatcccagctactcaggaggctgaagcaagagaatcacttgaacctgggaggcagaggttgcagagagccaagattgtgccattgcactccagcctgggcaacaacagggaaattccgtcttaaaaaagaaaagaaagaaaggaaagaaagaaaggaagaaagaaagaaagaaagaaagaaagaaagaaagaaagaaagaaagagagagagagagagagagagagagagagagagagagagagagagagagagaaagaaagaaagaaagaaagaaagaaagaaagaaaagaaattaccagtaaagaatttatgcatgtaaccaaaaaccacctgttcccgaaaaactattgaagtaaaattaataaaatgtaaaaaatgaactctttgatattgattcaagaagcctgaaatccagaatcacaagaatcatttaaaagaggctgaatgggggattgctggcaagatggccgaataggagaagctccagtctgcatctcccagcgagatcgatgcagaaggcaggtgatttctgcatttccaactgaggtacctggttcatcgcattgggtctggttggatagtaggtgcagcccatggagagcaagacgaaggagggtggggtgtcgcctcacccaggaagcacaaggggtcagagaattttctcccccacccaagggaagctgtgagggactgagcctgaggaactcaggcacagacactgcatttgtcccacggttttcaacacccgcaaaccaggagattccctccggtccctaccccaccagtgccctaagtttcaagcacaaaactgggtggccatttgggcagataacgaattaggtgcaggagttatttttttccataccccaatggtgcctgaaacgccagcgagacagaactgttcactcccctggaaaggggtgctgaagccagggagccaagtggtctggctcagagggtcccacccccacagagcccagcaaactaagatccactggcttgaaaatctcactgccagcacaccagcagtctgagattgacctgggatgcatgagcttggtgaggtgaggggcgtctaccattgttgaagcttgagtaggcggttttatgctcacaatgtaaacaaagcctctgaaaagttcaaactgggcggagcccactgcagctcagcatggttgctgtggccagactgccagatttcccttctctgggcagggcatgtctgaaaaaaaggcagcagccccagtcagggacttatagataaaacccccatctccctgggacagagcacctggggaaaggggcagctgtgggtgcagtttccgcaaacttaaatgtccctgcctgatggctctgaagagagcagcagacctcccagcacagcattcgagctctgctaagggtcagactgccgcctcaagtgggtccctgacctctatgtatcctgactgggagacacctcccagtaggggctaacggacacctcatacaggagagctctggttggcatttggcaggttcccctctgggaagaagcttccagaggaaagatcagacagcaatctttgctgttctgcagcctctgctggtgatacccaggcaaacacagtcaggagtgggcctccagcaaactccagcagaccagcagcagaggggcctgactgtcagaaagaacactaacaaatagaaaaaaatagcacatccactcaaagaccccatccaaaggtcaccaacatcaaagaccaaaggtagataaatccacaaagatggggagaaaccagtgcaaaaaggctgaaaattccaaaaaccagaatgctgcttctcctccaaaggatcacaactcctctccagcaagggaacaaaactagatggagaatgagtttgacagatcgacagaagtaggcttcagaaggtgggtaacagcaaactcctctgagctaaaggagcatgttctaaccccatgtaaggaagctaagaaccttgaaaaaaggttagacgaattgctaactagaataatcagctgagaaaagaacataaatgacctgatggagctgaaaaacacagcacaagaacttcgtgaagcatacacaagtttcaatagctgaatcgatcaagcgaaagaaagggtatcagtaattgaagatcaacttaatgaaatagagaagacaagattagagaaaaaagaataaaaaggaacagaaaaagcctccaagaaatatgggactatgtgaaaaagaccaaatctacatctaattggtgtacctgaaagcgatgaggagaatggagccaagttggaaaacactcttcgggatattatccaggagaacctccccaacctagcaagacagcacaacattcaaaatcaggaaatgcagagaacactacaaagatgctccttgagaagagcaaccccaagacacattatcgtcagattcaccaaggttgaaatgcaggaaaaaatgttaagcacagccagagagaaagttcgggttacccacaaagggaagcccatcagactaacagtggatctctctgcagaaaccctacaagccagaaaagaatggggccaatattcaacattcttaaagaaaagaattttcaacccagaatttcataaccaaccaaactaagtttcataagtgaaggagaaataaaatccattacagacaagtaaatgatgagagattttgtcaccaccaggcttgccttacaagagctcctgaaggaaacactaaatctggaaaggaacaactggtatcagccacggcaaaaacataccaaattgtaagagcatcaacactatgaagaaactgcatcaactaatgggcaaaacaaccagctagcatcatgacaggatcaaattcacacataacaatattaaccttaaatgtaaacagactaaatgccccaattaaaagacacagactggcaaattggataaagagtcaagatccatcagtgtgctgtattcaggagacccagcccacctgcaaagacacacatagtctcaaaataaacggatggaggaatatttaccaaggaaatggaaagcaaaaaaaaacaggagttgcgatcttaatctctgatgaaacagactttaaaccaacaaagatcaaaagagacaaggaagagcattatgtaatggtaaatggatcaatgcagcaagaagagttaactatcctaaatatatatgcacccaatacaagaacactcagcaagttcttagagacctacaaagagatgtagactcccacacaataacagtcgggagactttaacaccccactgtcaatattagacagatcaatgagacagaaaattaacaaagatattcaggacttgaattcagctctgggccaagaagacctaatagacatctccagaactctccaccccaaatcaacagaatatacatcattctcagcaccacatcacacttattctaaaattgaccacataattggaagtaaaacactcctcagcagatgcaaaagaacagaaatcataacaaacagtctctcagaccacagtgcaatcaaactagaactcaggattaagaaactcactcacaactacatggaaactaaacaacctgctcctgaatgactactgggtaaataactaaatgaaggcagaagtaaagacattctttgaaaccaatgagaacgaagacacaacataccagaatctctgggacacatttaaagcagtgtgtacagagaaatttataacactaaatgcccacaagagaaagcaggaaagataaaaaattaaaacaatttaaattcttttaatttaatatttaattcttttaattttaacatcaaaattaaaagaattagagaagcaacagcaaacaaattcaaaatttaagggaagacaagtaataaccaagaccagagcagaactgagggagatagagacatgaaaaacccttcaaaaaatcaatgaatccaggagctgttttttgaaaacatcaacaaaatacatagaccactagccaggctaatacagaaaaaaagagagaagaatcaaataggcacaataaaaaatgatataggtgatatcaccaccgatcccacagaaatacgaactaccatcagagaatattataaacacctctacgcaaataaactggaaaatctagaagaaatggataaattcctagacacatacaccctcccaagtctaaaccaggaagaagtcgaatctctgaaaaaaccaataataagttcggaaattgaagcagtaattaatagcctaccaaccaaaaaaacgttgaggaccagacagattcacagccgaattctaccagaggtacaaagaggaacaggtaccattccttctgaaactactccaaacaacagaaaaagagggaatcctccctaactcattttatgagcccagcatcatcctgataccaaagcctggcagagacacaacaaaaaaagaaaatttcaggccaatatccctgatgaacatcgatgcgaaaatcctcaataaaatactggcaaaccgaatccagcagcacatccaaaagcttatccaccacgatcaagtcggcttcatccctgggatgcaaggctggttcaacatacgcaaatcaataaacgtaatccaccacatgaacagaaccaatcacaaaaaccacatgattatctcaatagatgcagaaaaggcctttgacaaaattcaacaccccttcatgctaaaatctctcaataaactgggtattgatggaacatatctcaaaataataagagctacttatgacaaatccacaaccaatatcatactgaatgggcaaaaactagaagtattccctttgaaaaccagcgaaagacaaggaagccctctctaaccactcctactcaacatactattggaagttctggctaggacaatcaggcaaaagaaagaaataaagcgtattcaaataggaagagaggaagtcaaattgtctctgtttgcagatgacatgattgtatatttagaaaaccccatcttctcagcccaaaatctccttaagctgataagcaacttcagtaaggtctcaggatacaaaatcaatgtgcaaaaatcacaagcattcctatacaccaataatagacaaacagagagccaaatcatgaatgaactcccattcacaattgctactaagagaataaaatacctaggagtccaacttacaagggatgtgaagtacctcttcaaggagaactacaaaccactgctcagtgaaataaaagacgacacaaacaaatggaaaaacattccatgcttatggataggaagaatcaatatcgtgaaaatggccatactgcccaaagtaatttatagattcaatgctatatccccatcaagctaccactgactttcttcacagaattggaaaaaactactttaaactgcatatgaaaccaaaaaagagcccacagggctaagacaatcctgagcaacaagaacaaagctggaggcatcatgctacctgacttcaaattatactacaaggctacagtaaccaaaacagcatggtactggtaccaaaacagatatatagaccaatggaaaagaacagaggcctcagaaataacaccacacatctacaaccatctgatctttaacaaacctgacacaaacaagcaatggggaaaagattccctatttaataaatgttgggaaaactggctagccatatgcataaaactgaaactggaccccttacttacaccttatacaaaaatcaactcaagatggaacaaatacttaaatgtaagacctgggaccttaaaaatcctagaagaaaacctgggcaataccattcaggacgtaggcatgggcaaagacttcatgtctaaaacacgaaaagcactggcaacaaaaaccaaaattgacaaatgggatccaattaaactcaagagcttctgcacagcaaaagaaactattatcaaagtgaacaggcaacctacagaacgggagaaaatttttgcaatctatccatctgacaaagggctaacatccagaatctacaaagaacttaaacaaatttacaagaaaaaacaaacaaccccatcaaaaagtaggcaaagaatatgaacagacacttctcaaaagaagacatttatgcagctaacagacatatgaaaaaatgctcatcatcactggtcattggagaaatgcaaatcaaaaccacaatgggataccatctcacgccagttagaatggtgatcattgaaaagtcaggaaacaagaaatgctggagagaatatggagaaataggaatgcttttacactgttggtgggagtgtaaattagttcaaccattgtggaagacagtgtggcaattcctcaaggatctagaaccagaaacaccatttgacccagcaatcccattactgggtatatacccaaaggattataaatcattctactataaagacacatgcacacacatgtttattgtggcactatttacaataggaaagacttggaaccaacccaattgtccatccataatagactgtataaagaaaatgtggcacatatacaccatggaatactatgcagccataaaaaaaggatgagttcatgtcctttgcagggacatggatgaagctggaaaccatcattctcagaaaactatcacaagaacagaaaaccaaacaccgcatgttctcactcataagtgggagttgaacaatgacaacacatggacatagggatgggaacatcacacaccagggccttttgggcgatggggggctaggggagggataacattaggagaaatacctaatgtaggtgacaggttgatgggtggagcaagccgccatggcatgtgtatatctatgtaacaaaactgcatgttctgcacatgtaccccagaaattaatcatttttttaaaagaggctaaaggtatgcaatccaacaatctcactactgggtatctacctaaaggaaaagaagccactatatcaaaaagacaccttcacatatatgtttattgcagcacaatttacaattgtaaagatttggaaccaccctaagggcccatcaatcaataagtggataaagaaaatgggacatatataccatgaaatactactcagccataacaaagaataaaatgatgtctttttcagcaacttccagggagctggagtccattactctaagtgcagtaactcaggaatggaaaaccaaataatgtatattctcacttataagagagagctaagctatgggtttgcaaaggcatacagagtggtataatggacactggagactcagaagcagaagggggagaaaggagaaaaacaaaaaactagatattgggtagaatgtacactactcaagtgacgggtgcactaaaaactcagacttcatcactatacaattcatccataaaaccaaaaaccacttgtacccctaaagctgttgacattttaaataaataaataataaaaattaatgaataaacaaaactaaaactgaaaagagaggttaaatatatatatatatgtgtgttacttcaaaattacactataaatcccatcaagtgtgcttgaatagttatgatgtttactatatttattacttataaagcacgaacacaaggatttcatttatcagctagttgtaaaacatgtctttcaccattgcaggggctagtctataaatttttatatggaaaaatttccctagaaaatttaagatatatatatacatacatgtgatacaatctttagccctctagaagagtcacattttacattagtgtcaggagacaaggaaccatctacttcatttactttctgctttgtaggaaaatacatttgtgtatcaatatcaacccaggtgggtgtgactgaatgtacagcacaacccaaactcctggatcgcagactatttaataccaggttttatccccctggcatttgcttccaactttatcagacaaagtaaaataatggtgatataatccacatcactctatagtattttaataaacatgcaaataaatagcacacaatgctacataatcacttttcaaggtgtttttttaaacattattttactttgataaagtagcaatagtccccagataattatggtttgtgctaactgaaaaaacagtccttgtttcactgatttgcacactgttgctcaattgaagttaatagaatgggccacaactggaagtggaagtctcttttgcttaatttatttgccacagtaacactataaagccaaccattggaatctcagtccagtttggagtctaatgactgaatgaagaggtagaaaaccaaaaatggcagccaacacatgacaagaatcctcataaaggaatattagaaagtgtcttgtgtaatgccatccatctataattattggctacagtttcaagctgtctggatacagacagttgactagatgactttcacaacacaaataaatttttagaaatttgacctcatttcaggatcattcactatgctttacatgcaatccagaatgctgcacacatatgatattccttgccttctaggagtttatgttctaaacaaaatcctagaaatgttatttccccataaggttgacttaacttttatgtttttcatttgattacagcacaaggatctacctcaaaagttcaatttatacctcaaggggagggagcaaggttaagggagacaactgaattcgaacccataaaagttatttaatacacgtcaatattatacctaaaaagtagtcttctggctgggtgcggtggctcacgcctttaatcccagcactctgggaggccgaggtgggcggatcacaaggtcaggagtttgagaccaccctggccaatatggtgaaaccccatctctactaaaaatacaaaaattagccggatgtggtggcatttgcctgtggtcccagctactccggaggctgaggcagaagaatcgcttgaacccaggaggcggagcttgcagtgagccgagattgtgccactgcactccagcctgggtgacagagcaagactctgtctcagaaaaaaagtagtcttctaatgaattcattctttatgtacacagtagaacattttcaacaaatttatagagcattgttgtattaagaatcatgagagcacaaagaacacatctgattcctgttctttttttaaagtctcctacccaattctccctctcattagccactccttgagtgacatgcacaataacaacactctccagctcaagaaactgcaggacaaacatatacgcccccataggtgagtcagtgggaaaagtgcagtacatgactcatcaccatttaaaacagttccatcactgatgctctactggaattactccatcatctccctgtaaccttagagtttactttaaaaaccctctaggctaggtgaggctaacattatttccagtatcatataaaccattgacatgaaaacattaagacaagtttaaaactatgcaaaaatatattaaaagaatctacttttctacaaatacaatgtaataaggaatacttcaacgaagtatatatattaaattgtattagtttttattatttccattaactgggctatcactaacaattgtagagttgttttcttttattaaatggttaaaagaccttcaaagctagaatacaatttgcccttatctggagtaaataagtggctgtttaacagggatcattagctgtaatgcagaatatgaaggcatgcctctcccatcaacagctgacagtcacatcaggtaaaggtggaacatcaaagaatgaggacttgcttgtgaggtggaactcaacaactatcatttttaacatgcttttaaccatctgacacttgaatcacttaatttttgttactatactgatatcttagttgtcccatttttaaaataaagaatataccagtaactgaccagaaaacaattactatacacccatacacataaaattctataaataactggtgggtagaggagaaggatgtaaaaagtgatctctttctgagattgcagaggcccagtttcctcattgtgttcgcacataaatactttcattgcagatatttcaaggttatgccagacttatacagaaagaaatcctggactatgtgttctgaatgtgctggtaaagaaagtcacttcatttgagaggtccctgccccttcaacctcaccctccttaccaatatacattcatcactgaaaagggaaatatttacaaaagttagtttagttatgtttaaatattatgtttagctgtctggagaccatgttctcaagatttatacaagaaatcaaggattaaacttcataacaattagaaaaccacactgtgtaaaatcaaagacttagttaaaggaaattaaaatagttttaccattggtgctaaactgaaatggctccatctcttcccaacacctggaatcaaaaccttttgaactttcatgtaaataaatgaggacatgcagaatgctctgtctgcagcaaggtaccacctctgcacaggcatttgggtgaaaaatgtggaaaatgcctgaggactctttgaagcagcttaggagaagtgagagcaggaaagaggctcttctctagggtaagtttgtttagtagaaagtaagcaagttgtcagggtaaaagttgacaatgttgattccaacagtttgaactgcgaataaacatccaaagggattatgttactgagaattagaaaagattccactaaactcaatagaacacttgtgttttcaaagataatatgccttcaagccatactctggagcctcggtttagggttagaattaccctaagccctttctataccacattaaagaacacaaggtctgacccctcttataagtgcctaaaaatattagaataaagatggaataaaaatatttcatttccactcactgaattggaaaatattacacacacacacgcacgtatttatacacacacacacatgcacaaatacatatgaggttgactgaaaaaacctgaagaaacatctatgctcttcccaaacatctaaacttaaacccaatttcactaaccaatttagggaaatacatgcattggccataaatcacttttaagttttcccttcttaatgacctatcaaagagcaaaaaacagggcctatacttatgaaatccataatccccttttctgctcaccaaagccacatttaagtctggctttcatctcatgctgttgggtttttcaccaggtacaagatgaaaagctggaagagtcctgtgcttttctaaaagcaaaacaatttggttgccactcagcaattcctggtgacatgccaagaagtctgtaaaaaaaaaagttaaagttttcctaacttagagcttacaaaaataagtgtgagatgttcatagcctgtcagacaatccatctttttatttttttaatattcataaacaagggaaaacacatacttttgatttgttaaagtttatttggatcactataacgtaggtctgccttatgtggtctcaagaaaatggaggtaacttggactgctcttctgagttcatctcaaatccttaatgattctcacataagattctgctattataatcttttccaaagcctgacaaaaccatgcagctcatttgctcattaccagcaagtctgcaagcagccttgaaaaaagttgattctccttgtagctctgacacatattcactttcctcctagaatcaaggatataagggagcacggctcagtctcatagcctctttgctcttaagaagaaaatcaaattccccagatatttccaaactccaccaagaatagaacattctctgctctgcctgaagaccattatctcttttacatttcatctttatattcactgggttcatagaaagggcatacacagaaagaggaaaatagctgcttcttaaaagacaccaaatttagtaattctctcaaatctactggcatacatttagaaagtcgtatttttaaaggcttcaataggttttcatcagttctgtgttttgagaagaaaacacatgctgaatcacccataacttcaaaccaaaatatatctgcaaactacaaggaatatttgtaatagaaagacaagtcatcacaatttaaaaagtgatatagtgggtgtagacagacagatgtgtaccccaaaaaacaagttactaactgaatgctctaagatttcaaccaactccaatagccttacctgttaatatgagattactgtaagtattggagaattgctcctttagaagaaccagatgcatctgagctgccttctccctttggagctccagcataacatcagggtgctgggcaatcttgcagcctttctgtttatctaaggcaacatcacttcgaacaatgtctacaaaaagaaagaaagaaggcaggcagcaaaaactaaaacaaaacaaaaaataatacatcatcaaagtcttgtttcacccaaaatgacagaattaataagctaccagcattttcatcaacctaaagagatgcagaagtaatcagaaggctctccaactccatgacacatcctgaaagttcctctggtcatttccaaattctttggagatctatctgtttcttagctctttctgacatcatttaagattctcactcctcaattctccttcccagcccttcaggacttgtttacctcctggggccttttcttaacatatcttaccgttttccatgggaaaaagtattataatacaattttgaatactggtaattatgaaggtcattctctctacctcgtgctacaggaccaggtgatagctccagcatgtgtatttaggatacttggtctatttttaaattcacctgccagccagcctactcagctcaagttagagctgccgatctatggcttacctggtcatggttttttctgctatttttcatgtacctcgagtaaaatagtttaattctgacttaataatcattctttcaaaccaaaaatattttttgagtcactgaagagagcacaggaggtctagagtcatggaagatctgccttttccccaattattttcccatactgctttttatacttcggaatgattttcattcaaagcagatatagtctccagaaaacagcttcctcaaaaagaaaaattcatacagaatgcttcagccaggcgtggtggctcacgcctgtaatcccagcactttgggaggccaaggcgggcagatcacgatgtcaggagttcaagaccagtctgaccaatatggtgaaaccctgtatctactaaaaatacaaaaaaactagtcgggtgtggtggcacacacctgtagtcccagctatttgggaggctgaggcaggagaatcacttgaaccaggaggtggaggttgcagtgagccgagattgcaccactgcactccagcctgggcaatagagggagactctgtcttaaaaaaaaaaaaaaagaagaagaagaatgcttcccaattagcaggaagctcttatgccctaaagttatttattaattttttacaaattaaaatataattcaactgattctcataggtacaaatgataccatcagcagtaatctaggtggcaactctaaaaactttcaagttttgcataacaaaactgaagaattttaatagaaggcgctaaaaaataactgctttgccacttttgacaccaatgattttggaaagaataaaactaatgcccatgttaatggtactaaaagaaaagctatattcagtgacacttaagagaaaatagggcatatggtgaaaagggtgaaacactgttctggagaagtagtcttttctttcagatttctaaaagaaaagcccaggtataaatacaaacccatgactatgagagttaggatgtgtggcacacaaagataagccagatgtgaaaatggtcctcactaattcttagattaaaacaggagagctgagtagaaattatgcagtatttatgcctaaacatgtatataccaatttcttgaatatgggtaataaaatgaactcatttaacaaataactagtctcacagattttctgagacttaaatacaaaaattgtataaataagttcaagaatatactagcttttaagacaatccaatagaagtcaagaggaataatgcagtttacatttatataaattacgttctataaaattttttggattacatcatctcattggatccttccaaaaatattatcaaagtaaatggcagacattgttgactggctgacccaaaccctaaacacaatcccttctcccttggcttcatctattatagagactgaaaaactacactatacaatttcccagctttccttgcagaaaagggtagttatgtaacatggttctggaaaatgagctgcaggccgacatcttaaagggggacttcccttgccagattaaaagagagagcctcactaagagaaactcagtttttccctttagtcctttagtccctcctattctctatgtctaaaatatagacatgaagcccagagttctagtagccactttgtaaccttgagttaagaagcaagagtaggggtcgggcacagtggctcacgcctgtaatcccagcactttgggaggctgaggcaggtggattacttgaggtcaggagttcaagaccagcctggcaacacggtgaaaccccacctctactaaaaatacaaaaattagctgggcgtggtggcacacgcctgtagttccagctactcaggaggctgaggcaggagaattacttgaacgcaggaagcggaggttgcagtgagccgagatcgtaccactgcactccagtctgggtgaaagagtgagactccatcaaaaaaaataaaaataaaaataagcaagagggtaaaggattacacactaaaagtgttgaacagaaaaatgtaaagagcttaagtccctaatgtctttattgacctaccatacctgtgctagactgcctatctcttaatttcttgtcatgagacaaatatactatttatgtaagtcattaatagttaactgtttttaaaattgtaacctgttgtataatcctaaatgataaagaacactattattgcctctatcttaaatacgacgaaactgaggtccacaaagcttgacttgcacaagttcacaaaacctggtcagtgctcaaatccagggatgttcaaagccaatttcagtgctctttccagagctcctatatgaaactcatgagcttaagagtagaattacattaaacaataaaaggaagaactaaaaagaaaaactgagttatactgttacaatggtattccatagactgttcgtgtggaaaagaaatatgaatgctttctcagaaaaaattataaaacttgtatcaaaacatactataaaaagtgaaggagagtttcaattaccctgatatcttctgacacaagtctaatttgaagagtagaacaccaactaaactccctatttcctatctaataaatatattgctcagaatgcagcagaagcaacaattacaactgatatcctcaacatcattccaacaagaaccttgaaataaagtaactacattacctttatattaataacagtcagaaaggaaaactatgaacatggccaaacgtatgccctaaactttagaaaagcagatttcaaaaatgtttagggaaaaaaatagatatgctgtatctaaagtaaaagtatgaattccttattcaactctaatctgcttgaaattgtatcaatgactagataaacacaaagcaaagatacttatcaaagaagcacatggtaatatatctggaggaagagttagtatcatgtatgacacactcaaaattcaaaattatcttggaaatctaaaaacttaggctgaaatcccaaaaatggaaggtaaagacatgaacacaaatcctacatttatactgaaaattaatgatgtaagatttaagatgggaaagccagaccaaacagaagctcatatacttaagatcttactaagatttgtaggctttagttgaataccagcttaatataagtcagtgctatgatattgctgccaaaatgattaatgcaatcttagtctaaattaacagaaccagaacatgcagaataaagaaggcaacacagctgtgctacattccttgcctcccaagtgcaacacagtgaagagtttggagttaagcagacctctgttcaaatcctggcttggtattcacttattagttacaaaagtggcagacaaaacacctttctaagattacatttctttagctactgttattgtacagatacacaaaaggcattgcactaagcatacaataagagcacaataaagagtacctataattatttttgttattagtatcctgcttgtggtattacatatttccagctataatagtctcagatgaatcctggtagtctagagtaagtccaaagaaaagtacaaatatggaaaataatgttgatcttttaaaatagctgaaactggccgggtgcagtagctcacgcctgtaatcccagcactttgggagcccaaggtgggcgcatcacctgaggtctggagtttgagaccagcctgcccaacctggtgaagccccgtctctactaaaaacacaaaattagccaggcatggtggcgcatgcctgtaatcccagctactcgggaggctgaggcagaagaatcacttgaaattgggaggcagaagctgcagtgagccaagatcgcgccattgcactccagcccgggcaaaaagagcgaaactccactcaatcaatcaatcaatcaatcaatcaatcaatcaataaaatagttgaaactatgattcaatggactttggggactcagagggaagggcaagaggcaggtgaggaatggaagactatacactgttggaacagtgtatactgcttgggtgatgggtgcaccaaaactccaaaatcaccactaaagaacttatgcatgtaaccaaacaccacctgttcccccaaaactattgaagtttaaaaaataaatatatatatttatacaaaaaaaaatagctgaaactgagcctggcaaagaaagagccaaagatgacttgctttctcatacagaagaaatagttgacttattctgtggaaatctaaaaagccaaacattatgggagtacccaagaaccaaacctgttcagttccacgtgagaaaacttttttaacaacagaagctgtcaaataaggaaaaggactacttcatgaaggagtaagtttcccatccctggagatattcaagcagagaatgggtgacccaggcataatgaagtaatttcaatacagatattaaaacctgccagatacaagattaggtattttcacctatattatgtgaagcaatacagcaggatggttaaaagcacaggtttcgaattcaaatatatacaagtttggatccctctagtacttactatcagagagctcttggacaaaccactaaatctctcaatgcatttcctaataaagaagggaatttccttttttagaaacatgaaaataccaatagcttaattgtaatgaacttatcacagtaatagagacatattaggaattcaacaagtgccagatgtttcagtggttgtcaataataacatcacattgtaatatcagaaagttattattggaggatagtattattcttttaggtcatttcaacacttttatggttccacaaaaatgtgtatttttcttatgtctttatcagacataatacaaagaataaagactcaaagccagaaaacttagatatacatttaactaatttaccaaataatcataaaactctaaacgaaaaattaaaaaccctatgcttgttttttttttttctcctggtacaccaaactggggagtttctggcctggatgatctctaaacctcttcattccccctgctagttcttccctcttacagatgttctttgttgttatgtaatcaaagtagagttccaaacttgggtccaaatatgaagctatccatactcctcttcccatctccccttatgatccttaccctagtatacaattcaaggatgccaaaatacccaatatataccctgacagatgcaacaaaggagcgggcatcttgcaccaaagttgatgcactagaatcaatttattgtctataattatttctggacatctaggtataaaagcatttgtatttttgttctttattctttcttccacaacttttccataaactaaccagttagtaacccacagcagtgctagcctaaggtggcagttctggttgagacaaatgacagactggcagaccagccaaaaaaattttttaagacagtgtcttactctgtcacccaggctggagtgtagtggcatagcccaccacagctcgaactcctaggctcaagcaatcctcccacctcagactcccaaacagtcaggactacagggacacaccaccatacctggctaaattttaaaaattttttgtagagatgaaatctcactatgttgcctaggctggtctcaaactccttgtctcaaacaatcctcccgcctcagcctcccaaagagctgggattacaggcatgagccaccaaatctggcctagctaaacattttaatagaaagactctggcacttcaggagacataaaatgagctacatatgctttccatgcaagcttggctgactagcaggctatatgcacatgcaagggagccccaacataggctaagttcttcacacataactggctaatggggaggctacgcacaaacatgggagagacccaagagatcagcaggaaaaaataaagtgaaaaagacctaaaaaatgccacaaaacttaatgtgtttatcaatccacagagaaatccatcagctgaacatgaaaacattaagggtccaaaatgttttaaacataatctctgaacagtcattggctgatcactaagctatgcagactcagaggcaaaccctaggaaaccaagctaaaaaataaaaataaaaatttttaaaactataaagaaatatcagtaacagcacaacaaaaagatataaagtccaaataacttacctaaaaacaaagaaaacataaaacaacaattgtcatggaaaaaaagaactactttgattacaaaacaacaaagatcagcaagaggggaatggtatagattggctataacctatctaaaatggccagtttccaataaaatattacaagccatgcaaaaaaaaaaaatcagagaacttaaagataggtgaatagaaatgacctaacctgaaaaacaaagataaaaaagaccaaggaaaaatgaccacagcctcagagaattatgggacaacatgaagcaatcaaacatatgcataacgggagtcctacaaggagaggaaaaataaagggcagaattgtttgaagacatgatgaccaaaaacattcaaaatttgataaaaatcattaatccacagattcaagaagtacaacaaacctcaagcacaagtacaacaaaactcagcacaaagagatccacatctagatacattataataaaaatgttaaaagcccaagataaaaagaaaatcttaaaagcacggaggaaaaaaactaatccataaagggaacaagtaatacaattaatggctgacttcctccaatttgaaacaatggagactagaaagcagtagaatgacatttacaaagggcgaaaagtaacagcaagactctgtctcttaaaaaaaaataaaggaaatatttagccaaacatgatggcatgcacttataatcccagctattcaggaagctgaaacaggaggactgcttgagctcaggagtttgaggttgcagttacctataactgcaccactgcactccaacctgggcaacagagctagaccctatctcataaataaatagcgctaaaagaaaacttctgacaaccaataattctatgttcagcaaaactatcattcaaaaatgcaggcaaaataaagtcatttccatatttaaaaaaaaaaagaggctgggcactgtggctcatgcctgtaattccagctttgggaggccgaggcgggcagatcacgaggtcaggagatcaagaccatcctggctaacacagtgaaaccccgtctctactaaaaatacaaaaaattagccaggcatggtggcaggcgcctgtagtcccagctacttgggaggctgagacaggagaatggtgtgaacctgggaggcagagcttgcagtgagccaagatcacaccactgcacttcggcctggacaacagagcgagactccacctcaaaaaaaaaaaaaaaaaaagactgagagaatttgttgctagcagacctgcaacacaagaaatattaaaggaagtgcttcaggttaaaaggcaatgatatcaagtaataactcagatacacaggaagaaatgaaatacactagaaattgtaaatatgtaaataaacaaaaatccttttctcttttacatgttttaaaaactcgtaagattatatatagaagaaaatatgttttagttataccatatatagatgtaatagtaatacacagaacaaaattaacacaatagaaaggataagaaaagaagctgtatttgagtaaagttgttgtaatttataaaaattaagttaacattaaccttaaattgactgtgctaaattaagatgcatagtaaatcccttgagcaactaagaaaacaactgaaaatgagggggaggagccaagatggccgaataggaacagctccagtctacagctcccagcgtgagtgacgcagaagacgggtgatttctgcatttccatctgaggtaccgggttcacctcactagggagtgccagacagtgggcgcgggtcagtgggtgcgcgcatcgtgcgcgagccgaagcagggcgaggcattgcctcacttgggaagcgcaaggggtcagggagttccctttccgagtcaaagaaaggggtgacagagggcacctggaaaatcgggtcaatcccatccaaatattgcgcatttcggaccggcttaaaaaactgcgcaccacgagattatatcccgcacatggctcggagggtcctacgcccacggagtctcgctgattgctagcacagcagtctgagatcaaactgcaaggcagcagcgaggctgggggaggggcgcccgccattgcccaggcttgcttaggtaaacaaagcagcctggaagctcgaactgggtggagcccaccacagctcaaggagacctgcctgcctctataggctccacctctgggggcagggcacagacaaacaaaaagacagcagtaaactctgcagacttaaatgtccctgtctgacagctttgaagagagcactggttctcccagcaggcaggtagagatctgagaacgggcagactgcctcctcaagtgggtccctgacccctgacccccgagcagcctaactgggaggcaccccccagcagggacacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaattctaaaaagcagagcgcctctcctcctccaaaggaacgcagttcctcaccagcaacagaacaaagctggacggagaatgactttgacgagctgagagaagaaggcttcagacgatcaaattactctgagctacgggaggacattcaaaccaaaggtaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgcgatcaaatggaagaaagggtatcagcaatggaagatgaaataaatgaaatgaagcgagaagggaagtttagagaaaaaagaataaaaagaaatgagcaaagcctccaagaaatatgagactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacatcattgtcagattcaccaaagttgaaatgaaggaaaaaatgttaagggcagccagagagaaaggtcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcgctaaacatggaaaggaacaaccggtaccagccgctgcaaaatcatgccaaaatataaagaccatcgaaactaggaagaaactgcataaactaacgagcaaaatcaccagctaacatcataatgacaggatcaaattcacacataacaatattaactttaaatgtaaagggactaaatgctccaattaaaagacacagactggcaaattggataaagagtcaagacccatcagtgtgctgtattcaggaaacccaactcacgtgcagagacacacataggctcaaaataaagggatggaggaagatctaccaagcaaatggaaaacaaaaaaaggcaggggttgcaatcctagtctctcataaaacagacttaaaaccaacaaagatcaaaagagacaaagaaggacattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagagattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaacgcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagaagaatcaaatagacacaataaaaaatgataaaggggatatcaccaccgatcccacagaaatacaaactaccatcagagaatactataaacacctctacgcaaataaactagaaaatctagaagaaatggataaattcctggacacatacactctcccaagactaaaccaggaagaagttgaatctctgaatagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgacgcaaaaatcctcaacaaaattctggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaatacattaggtattgatgggacgtatttcaaaataataagagctatctatgacaaacccacagcgaatatcatactgaatgggcaaaaactggaagcattccctttgaaaactggcacaagacagggatgccctctctcaccactcctattcaacatagtgttgaaagttctggccagggcaattaggcaggagaaggaaataaagggtattcaattaggaaaagaggaagtcaaattgtccctgtttgcagatgacatgattgtatatctagaaaaccccattgtctcagcccgaaatctccttaagctgataagcaacttcagcaaagtctcaggatacaaaatcaatgtacaaaagtcacaagcattcttatacaccaataacagacaaacagagaggcaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttataccttatacaaaaatcaattcaagatggattaaagacttaaacattagacctaaaaccataaaaaccctagaagaaaatctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacgtgaacagacacttctcaaaagaagacatttatgcagccaaaaaacacatgaaaaaatgctcatcatctctggccatcaaagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaagtgtccaacaatgatagactggattaagaaaatgtggcacatatacaccatggaatactatgcagccataaaaaatgatgagttcaggtcctttgtagggacatggatgaaattggaaatcatcattctcagtaaactatcgcaagaacaaaaaaccaaacaccgcatattctcactaataggtgggaattgaacaatgagatcacatggacacaggaaggggactatcacactctggggactgtggtggggtggggggagggatagcattgggagatatacctaatgttagatgacaagttagtgggtgcagcgcaccagcatggcacatgtatacatatgtaactaacctgcacaatgtgcacatgtaccctaaaacttaaagtataattaaaaaaaaaaagaaaacaactgaaaataacatagtgtaaaaatcaacagagtaattaactgactagtctttttaagaatcttaataatccatttaacaaaaagaaggcagttaacaaaagaaatatagaaaatatcaaagtgaaagacataaattcaatcatattaataattgcactaaatttgaatggactaaacagtcaatcaaaagagagactgtcagattgagtttcaaaagattcatgagacacagtttaaacagtgcttagagagaaatttttatctttacacatctatattctaaaaaaggaacgttctcacatcaataatcaatcaataatctaagttcgcacttacaaactagaaaaataagaaaattttaaacacgaagcaagcaaaaaaaagaaaaaaaggatcagaatggaaatcaatgaactagaaaacaaaaagataagtcaataaaacaaaatattgattatttgaaaagattaatacaactgaaaaaccttgagctaggatgacaaagaaagaagacacaaattaccaaaattgatagggagggaggcattttcaaaaggtttcaaacattttcaaaatgagaaaattataatgatacagaacagattataaagaggttgtatgaggtagttgcttttgcgtggtgaaacagttatgcattctgattgttatattggttatacgaattcatatatgtaataaaatttcattgaactatacatgcacacacatagaagaaatgattgtatgtaaaactggtgaaatatgaataaagtctgtagcttacttaacttttctgtacaacttctgcaagtttttgtaagtctaaagttatttcaaaatattttttaaagaatttagacccttaccttacatcatatacaaaagaaaagcctcaaaatcaatcacagacctaaatataagatctaaagctataaattttctagacaaaaatataagaaaaaatatttgtatccttaggttaagtacagatttcttagttatgacaccaaaagtataattcaaaatagaaaaataataataaatcgaacttcatcaagagtaaaagtgttcgctctttaaaagatactattaggccaggcatggtggctcacatctgtaatgccagcattttgtcaggctgaggtgggcggatcacttgaagccaggggctcaagaccagcctggccaacatggtgaaaccctatctctactaaaaatataaaagttagccaggcatggtggcacatgcctttaatcccagcgactcgggaggctgaagcacaagaatcacttgaacctgggaggcgaaggttgcagtcagccaagaatgcaccactgcactctagactctgacaaaaaaaaaaaaagatataattaagctaaggaaaagataagccaccaactgagaaaatattttaaaattacatatatgataaaatatatataaagaatgttttacaccttgataaaaagacaacccaatttttaaaatggacaaaagatctgaatagacatttcaccaaagacatacaaatggctaatagcacataaaattatatataatatcattattcattagagaaatgcaaactaaaaccacaatgagatactactacacacccactagaatagttataacccagaaaaccgacaataccaagtgctgccaagaatgtggagaaacaagagccctcacacattgctggtgggaatgtaaaacgctacagcctctttggaaaacacattggtagtttcttaacaaaataaacttgctgtacaacctaacaaactcactcctgagagcctacctgacagaaatgaaagcatatgtccacataaagatttctacatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacacagcgagactccgtctcaaaaaaaaaaaaaaaaaaaaaagatttctacatgaggtcgggcacagtggctcatgcttataatcctatcactctgagtggccagggtgggaagatggcttgaggccagaagtttgacaccacaccagcctgggcaacataaggagtccccatctgtacaaaaaatttaaaaattagccagacgtggtggcatgtgcctgtagtcccagctactcaggaagctgaggcaggaagacagcttgagcctaggagtttgaggcgatagtgagccatggtcccatcactgcactcccgcctcggtaacagagtgagactctgttaaaaaaaaaaaaaaaggacttgtacatgaatatttatagtagcattatgcataacagccaaaactggcaacagcccaaatgtccagaaactagtaaatggataaacaaaatgtggcaaatccataaaatgaaatgccattcagaaataaaaagaaactaattactaataaattctagacctggataacctcaacaacattagactagattttgtgtctggtgaaagaagccagacacaaaaagaccacgtattatgacttcatttatgtgaaatttctggagaacgcatatcaattgacagaaagcatatcagtggttttctaaggctgggatgggagaagggcttgattgtaaacaagcataagaatgttctaaggatgaagataattgttggaagcctttatacatttcatagaaataattaaactacatacttgtaatgggtgaattttatgaaaatatgtaaattatagctccaaaaaaagctatcaaaaagtcacaaaaataatacatccatgttcacagcagcactatttacagtagccaaaaggtagaagtaacttaagtgtctatcaatagacaaagggataaacaaaatgtgataaagacataaagaagaatattattcagccttaaaagaaaggaaatcctgtcatatgctacaatgtggatgaaccttgaggacatgataccaaatgaaataacccaggcacaaaaagataaatactgtatgattccatttatatgaggtacctggggtagtcaaatttatagagacagtagaatggtggttgacagaggctgaggagaatgggtatgaagagttattttttaataggtacagagtttagttttgcaatatgatgagttctggagatggatggtggcaatggtttgtaaaacaactatcaatgtacttaataacactgaatcatacactcaaatggtaaattctgttataatggtaaattctgttctgtgtatttaaccatagtttttaaaaactctaacagaaataaaaataaataaaaagaaacagagctacagagttttctctgtagtttaaaatgaaccatcttaaaaccttgggacttcaaatgccattgttacatcatgtatattctgcttctctgcagattatatgagattgcatattaaaacttggatagaattttgtatgctgctgttacagtgctgggtccagaagatcaggtgcagacctgaaagaatgctttggcttccctcacacacagggacagggctaaaactagtgccactcccttccctcctgtcttcaatgcagccactacaacagcagcaagaaaaggaagatgctgactcttcctcagatccttgaaacaggttcacagactttagaagagcttctgtgctgagatcctaatattcccaagccaaagtactcattatctaccctattctccctccaaataacttgtcctttaatttccctagtcttctagtctctgaccctcagtcatcttttatttctttttccctgccccttcagtttaccaagtttatccactttggtttcaaaatgtctcagtgttgtccccttcttttctattccaattaatactatctacttcttatctggataactaaaacagtccaaaacaacatccataaatccagattcatagatctccgaggcattcagcataccatctttggaaaataggcttcatggccaggcgcggtggctcacacctataatcccagcactttgggaggccaaggcaggcagatcacgaggtcaggagattgagatcatcctggctaacacggtgaaactctgtctctactaaaattaccaaaaaagttagccaggcatggtggcagacgcctgtagtcccagctactagggaggctgaggcaggagaatggcatgaacccaggaggccgagcttgcagtgagccaagatctcgccactgcactccagcatgggtgacagggcaagactccatctcaaaaaaaaaaaaaatagccttcattttaacattgttttcataataaaatattttttagtgtacaaaaaatgcccatccacatccatgcaccctcacattctattctttgataacattttgccatatttccttcagatttatttaaagaaataaaatagttcaaaaatacgtaaagtcctcagtttaccactctgcgatgacattctccttcctctttccacctcctcagaaagataaccaccatcataaatcctgaaagtaatattcttatatgtatgtacacgtgtgtacatgtatgggctttcatcatatgaataaaaaacatacattggtttatatttttattgcattttatacaaccaagggaaattatcaaaactaagaaaccaatgtttacataaatttaattaggtgcatactttatttagatttcaccagtttttctactagaactattttctattccaggaccaaaaccagaatcccatattgcattagtttccatgtctccttagtcttctctgaactgtgataatttcttggtctttccttgtctccattatcttggtggttttgaagagtactggtcaggtactcatcagttttaggtagaatatccctcaatttgggctgacagaagtttctttataattgaaataagttacagattttgtggaacgataccacaaaggtatgtttagctcttattaatggtgacattaataaacttgttcccttggttaaaattagttctggtgggtttctccatacaacgttactattttgcctttgtaattaatgaatattttgtaggagatattttaaggctatgcaatagcacattattctgtaaacttttgcccactaattttagcaatcctcaatggatctcacctacaccaataattactctggtgttccaattcttattttctcaatccctctacatttattaattggaattcttctataaggaagagagttgtctcttctccactcatttatttattcaagcattatatatatatatatatatatatatatatatatatatatatatatatatatatatgaacttatgaatgttattttattaagccacatttctttattttgttggacaaactgttccagctttggctaatgagagctttttcagctgagcttctataattttttgacatatcctcaatctatttttttttaagcacttccttactttctggcaccacaaatgtcccagtctcatcttgtatttttccctcccatcctagaatcatccactcctctaacaaaacctggttccttttgttggagaataatatttagaaaccaagatttaggcaccacatgtgttcattgctactggggtatcactacttctagaccctctcaagtagaaagagctcagagaggtatataggcttactaactgatgtacacatataatatctatatttatttcactatcttaaaaggaaaagaaggacactctagtccaactccaatccaacactaaagaattcattttaggccaggcgcagtggcgcatgcctgtattcccagcactttgggaggccaaggtgggcagatcacgaggtcaggtggctcacgcctgtaatcccagcactttgggaggccgacgtgggcggatcacgaggtcaggagattgagaccatcctggctaacatggtgaaaccccgtctctactaaaaataaaaaattagctgggcatggtggcgcacgcctgcggtcccagctactcgggatcctgaggcaggagaaccacttgaacccaggaggcgaaggttgcagtgagccaagatcgcgccactacactccagtctggcaacagagcaagactcggtctcaaaaaaaaaaaaaaaaaaaaaaaagaattcattttagcattctcattttatccgtaatttctttctctgacagtaagaagcctggttttcataaactatatttgcttatttgctcaacactaatatacatacaaagtagtttcagaattgctaacccatactcctttaagaaacatatttaccaaccacagtacagtgctgcatacttcttttttctttagccttacagtgtctattcaaaataaagttattcagcttctttcttctccaagtttccagtatgattgtgccattcatcacaatacacttaaatttatttgccagatctgtagtctgccttacgttcccccaatatcctggttgtttcttaaaatgtgaagacagtaaaattcactatttgttgcatacagtcctgtgggttttgttttgttctgttcatttatttacgtatttatttatttatttatttatttatttatttttgagatggagtctcgctctgtcacccaggccggagtgcagtggtgtgatctcggctcactgcaacctccacctcctgggttcaagtgattctcctgcctcagcttcctgagtagctgggattacagatgcgtgtcaccatgccccgctaatttttgtatttttagtagagacggggtttcaccatgctggtcaggctggtctcgaactcctgacctgatctgcccacctcagcctcccaaagtgctgggattacaggcatgagccaccacacccagccagtcctgtgggttttgacaagtgcacagaatcaagtaaccactagcccattaccatacaaaataatatgatcaccctaaaaaactccctcatgctaccttccattatcaacccctccattcatcctcattgtggccaacactttgttgttttttggttttgtttatctgtttctatagctttctcttttacagaatgtcataacaatggaattatacaatatgtagcctttgggatatggcttctttcactttgcaaaatgcatttagaattcacccaagttgttgtgaatcaatagttaattcttttattgctgaataatattccattgaatggctgtactatagtttgtttaaccattcacccactgaaggaaatccaggttgtttctagttttcgagaatgaatatatagtttcaagaaacattcatatacaagttttcctgtgaacattagttttcagttgacttgagtaaattcataaaagcaaaactacagggtcatatggtaattacacatttagctttataggaaactgtcaaacttttttccagaatggctgtattattttgcattctcaccagcattgtataagagttccaggtgctccatactctcaacaataattggtattttcagttttgtttgttagacttctaatacagttataggggtatctcattgtggtattttcagttatctttgttcaacttctaatagatttgtagtggtatctagttgtggttttaatttccatttccctaatgacaatgatgttgagcacattttcatatacttattttccattcatttatcttctttggtaaactgttcatatctcttgcccactttttatttggttattttctaattttttaaattttaagagttctttatatgttctgggcacaaatcctttatcagatttgtgattttaaaatattccttccaagccgagattgcactcactgcactccagcctggtgacagagtgagactccatctcaaagaaaaaaaaaaaaaaatcactcctagtctgtggcttcactttttcattaaagggtctttcacagaccaaaattttttaaatgttgacaaaggccaatttatctatttttctttttatggatcatactttctttttttcttttttctttcctttttgtttgtttgtttgtttgtttgtttgagacagagtcttgctctgttgcccaggctggagtactgtggcgtaatcttgacccactgcagcctctgcctcccggattcaagcaattctcctgtctcagcctccctagtagatgggattacaagcgtgtgccaccacacctggctaatttttgtatttttagcagagacggagtttcaccatgttggccaggctggtctcaaactcccagcctcaagtaatccacccacctgcctcccaaagtgctgggattacaagcatgagccaccgtgcccggcccatactttcaatattgtatctaaaaactttttgctaattccaaggtcacacagatttctcccttttcttctagaagttttataagtgttgtgttttacatttaggtatatgattgttttagttattttttgcataaagtatgaggaatgtagcaaggtttatcttttcacataagaacttccaatttttctagtctcatttgttgaaaagactctcctttttgcactgagttgcctttgcatctttgtcaaaaatcagttgacattattttgtgggtctatttctaagctctctattctgctccactgatttatgtgtttattcttctatgaataccatactcccttgattataatggctctatattgtcttgtcttacttttataaaactgttttacttattctagttagtgtgtgtgtgtgtattcatgtccatatattcatacacacacaaacacacgtatacagaaaagttttctatggtttttggggattgagtttaatctataggtcacatcgagaagaactgatatcttaataatactgagtcttctaatccatgaacacattttgtctctctctctctctctctcatttgatttctttcaccactttttgtagttttcagctctatacacataaatatattcgttatacattttattagattagttagggaagttccttactcttccagtttgctgagagtttttatcatgaatggataccgaattttatcaaatgctttctctgcatctattgaggtgatcagcctatttacacacacacacacacacacacacacacacacacacacacggctttgtaggagtttgaattgcattgaatttatacattaatttggagacaatttcaagatatttcatcttcctatccatgatatgacatatctccatgtaggtcttcatgtttttcaataaaattttataatttcctctattaaaatttggtataacatttgtcagattattcataggtactttgagttctgctgccctgataaatggtatcattttaatagtatgttctaaatttttgcccctctataaaaatgcaactggttttggtatatggagcttcaattcagaaactttggtgagttctcccattatttctatttttatctagagatgttcatgaattcactatggaaatatcatctgctaataataacaattttgtttcttctgtctcaactcttacatttttatttactttacctttcttatttgtagtaagacataaaactcttgagtttctgcactctggtaggctatctttcttagcttgcaggtagactcacaaaggggaaggaatatttaggagggagttatcagaatatcagaatttcaggcaattagcttagcttagcttgcaggtagggtgaaacctcagtcccctcacagttcttggcattattgtgctggttagaatctctggtataatctgtaagcatcattggtttcttcctgattttaaagggaatgctgtaatatttcaccattaaacataaaaaatgatttcatttcaaggtagataccctttttcaggttaaggagagtggttaaaaaatgtcctgacctggccgggcatggtggcttgcgcctgtaatcccagcactttgggaggccaaggcgggtggatcacaaggtcaggagatcgagaccatcctgtgaatggtgaaaccccatctcaactaaaaaaatacaaaaaattagccaggcgtggtggtgggcgcctgtagtcccagctactcgggaggctgaggtgggagaatggcgtgaacccaggaggcggagcttgtagtgagccgagattgcgccactgcactccagcctaggcgacagagcaagactccgtctcaaaaaaaaaaaaaaaaaaaagtcctgagccaggctgggcacggtggctcacgcctttaatcccagcactttaggagaccgaggcaggcggatcacgaagtcaggagatcgagaccatcctggctaacgtggtgaaaccccgtctctactaaaaatagaaaaaattagccgggcgtggtggcatgcgcctgtggtcccagctactcaggaaggtgaggcaggagaattccttgaacccgggaggtggaggttgcagtgagccaagatggcaccactgcactccagcctgggtgacagagcaagactccgtctcaaaaaaaaaaaaaaaaaaaaaaaaaaaaaaaaaaaaaaaaaaaaagtcctgacccatttaacttgtaaaattgcatagtaaatatagctttcaaagtggctgttctctttcacaaaggagaaggaatatttaagagggagttatcagaatagcagaatttcaggcaagacagtgcttcattgtgtcctgccctgcaggacagttgacattcttggccttaccaaccagataccagtagcatccccagtctcttgggggaaaagtccccctaatttttcaaatgttctctagagcaggggttagcacactttttctataaagagccaaacagaaagtattttaggttttgtgggtcatacaatctcttgcaactactcaactctgtggctgggctgcaactctctatgggaaataaagatcttctttctaaattaaaaaaacaaaatatgactctgataccaaatacaagagcagccatatgcaatacataaatgaataggcatggctgtgtgccaataaaactatacaaaaacaggtggtggcagaatttggtctgcagactgtactttgctgactcctgcttgagaggaatgggtagagtagaatatcctttcacagatatgaaaactggggctagggatgaagtgatttgcctgaggtttcacagccattttgtaccaaggaaagattagactccaagcctcctgactgctaatgctcttctcactgtatcacccagcagaacaaacgacactctggcaggaactgcctcagcaagtatttttagccacttctaaatgtatgcaaatatatatggatacttggcagatatccatgaatattcaagtctgctccagctccctcctctctggcctgcattgtttctctagctttacatcattcccagatgaagacactatagtttaatctccagaatgttcatgaaaacatgcaatacaattgggttggaggctgaacccagcagcagccacaacaaatcagcataaatcattcatatgctaaatatttctaaggccctcctcatagtattgaccacagccatgatttttcatcggtacactagaactcatatccaattgatgtgaagggtattttcaagtgaaaatccctgcagaactggatctaatactaatctatacaaagtatcagaatgtatcaaatctatttcatttctttcacctgcaatttctgtgattccaaccacactgatattttgtttggcttggctgattcttcacaaaagtgctaaataaaaggactgagtacagtccgccctctgtatccatgagttttgtgtctgttgattcaaccaaccactgatcgaaaacattttttaattgtgtctatacaggtacagactttttcttgtcattattctctaaacaatagtgtaacaaatatttacatagtatttacattgtattaagtattaaaattaatctagagattatttgaagtatacaggaggatatgtacagattatatgcaaatactaccttttatatcgggtacttgagcatctacagattttggtacccactggaggaactgcaaccaatcccccacaaataccaagggacaaatataatcataaaaaacagtcagcagtgatatacctagcttgaagaaagtattcattcttacaagaggactgcgtttagataaaaacagctacataactagcctaggccaaaaccaagacatgtgctaattcactcagtgtatctggggccattttaaaccacacttggtggaattcacacattgggtagaatatcgcactacattaactaaagttattctaactctaagatgcagttattccgaatttaggaaaaagaaactactacagtctggagaagccctcatggaagatgaactcagccataaagacagaatttagatgtgggaaaaaaaaagacagaggtgcatgaagagatggatgtagctctgaatgttcctctcttactcctcaccctaaacagaagctctaggattatcccaatatcaagaggaccctaaaaaaacaaccttataagaaaattagttagaattgactacaccaaagcagcattcatgagtgccaattagagccaataccctgacatatttgaccattgagcagtaataatcagagatggcaatttctgttggaatctggtatatgaacatcctttggaagttaattgaataatgggcaaagacacttgatacatcctttttgatgaagaagcagataagtatttaggccttggattatggcatcaatagcctttgccttcattctgtgactaaaaaaaaaaacttaacctctttgagaattgactttcccctagagtgtctaggattgaaatgtttatattcctgacttattatcatttaggaataacttcaccaaagggattgccctttggtgtaatccaaagctgctaaatgccacatcaaccagaaaacaaaacagaattctaaaaattaaaataaagatttaggtatcataactttttataatttcaacttttattttagattcagggaatgtacatgtgcaggtttgttacatggatatattgtgtgatgctgaggtttaggatacgaatgatcccatcatccagatagtgagcctagtatccaagagttagtttttcaagccttgcctccctccttctctcacccattagtccccagcgtgtactgctgccatcttgaaaacatctgaattttttttataagaatttgtcaagcatcatcagtttcttgcctaacctggaagcaaaccaaaattcctcatgtggatggctttggagcctcctagtggcagcctcaggggacctacagagctaggagccttgtgaagaaccaggctttcaaaagagagtataatttatgtatgctggtgatcaattcaaacgaacacatcaattcctacaatacgccctatattggactatattggacactatattggacactaggaatataaagatgaataaatattggtcctatctaccctcaaggagctcacagcctactgtggaaacatgtaagaacagaaataactctgaaacaatatagtaagtacttataatctgtataaattaagaaagggctttgggaggccagggtggggggatcacctgaggtcagaagttccagaccagcctggccaacgcggtgaaaacctgtctctactaaaaatacaaaaattagccaggtgtggtggcgcatgcttgtaatcccatctacttgggaggctgtggcaggagcatcgcttgaacctgagaggcggaggttacagtgagccaagattgcgccactgcactccagcctaagcaagagtgaaactctgtctcaaaaaaagaagaagaagaaaaagaagaaagggaatgaagtcagagaatgtgtaatcaaggggatgacattttcaccaagccttaaagagtaagtacaagtctatctaatggaggatataagtacattacacattttcatgccttcttgtttagaatacccccttttccacttgctgtcatactcagaatactaagcctggagtatagtagggtgggaagaaagctagaaagccaggctagaagcaaatttgtaagtgcccttgtggtttgagctttatactgcaggttctggagagatgtcagaggccctcagaaaagtggtctactgaagtctgttcactagaataacatcccgtcatagtatactgctatgctctaatagcagtataaggaagatattaggagagctgggaagcaaagaggtccattaatctgccacaatagattaagaaagaggtaagaaaggttaatatagaagtaggaatagctatacctagtagccaaatgaatatggagattagacccaggaaagagtcaaaaatacttcaaagttttccttaagacccaaggtagacagtgatgcccttatccaaagtagggaacacaggagaagccaagagaagtgataatgaggaactttagtaaattttatttgaggaactttagtaaattttatttgtgatacaaattagatctgaaaagtgtttaataaatactggaaagggtctgtaaaacttataactctgaaaaaaattatattataaccatctcgaaataactgcaagaggccaggcgcggtggctcaagcctgtaatctcagcactttgggaggctaaggcaggcagatcacctgaggtcaggagttcgagaccagcctggccaacatggcgaaacccgtctctactaaaagtacaaaaattagccaggcatggtggcacacaccagtggtcccagctactcaggaggctgaggcaggagaatagcttgaactcgtgaggcagaggttgcagtgagccaagatcacgccactacactccagcctgagcaacaagagcgagactctgtctcaaaaaaaaaaaaaaaaaaaaaaaaaagaactacaagagttataaccacaattacaatattaattattgtcatcccttagtgataaggagcaattatatccattttcacaaataacaccctgaaattgacccagtcacagaagacaaaactctcgttagacaatgaaatttttctaacaaaagtgaacattttattccctttattttgtcctctttggcttatccaaaaatatccaatcttcaaggaacatcttgagttccatctttgtcacaaacccttatcttatttcttcagaccttattagttctgacatctgaactctcatagcacttggcataaataatattcattgtcctttatgatttgctggagttttaagaaaattttgtcatatttctccaactatatttaagttccttaaaaactaacacagggtctacttctgtagcttctatagctcctatcatagagctaaccatataggagatgtatcgtcaacaatgatcttactatgggagcaagcctccctgttatggtgatgaccattattctgtgccctatcctgcaaagttaataaaggtatcaatacttgagatcagccacttcaaatcctagattggtaacatgtctaaccacagaaattcaggcatttgtagtgaataattaggtacctgtccagtttgtacttatggaactactagctgttacaggatgcattgtatccacctaaaattcatacgttgaagccctaacccccggtacctgagaacatgattgtatttggagacagggcctttaaagagctaattaaattaaaaagaagccattagggtatgccctaagccaatctgactggtttatttaaaagaagagggagagaagatgaccgaatagaaacagctccagtctgtagctcccagtgacatcaacgcagaaggcaggtgatttctgcatttccaaccgaggtatccggttcatctcactgggactggttagacagtgggtgcagcccatggaaggcgagcagaagcagggtggagtgttgcctcacccagaaaccgcaagggggtggtgaactccctcccctagccaagggaagctgtgagggactgtgccgtgaggaacagtgcattccggcccagatactatgcttttcccgtggtcttcacaacccacagaccaggaggtaccctcaggtgcctataccaccagggccctgggtttcaggcacaaaactgggtggccatttgggcagacaccaagctagctgcaggagtttttttgtttttttcatactccagtggttcctggaccaccagcgagacaaaactgtttactcccccagaaagggggctgaaaccagggagccaagtggtctagctcagtggatcccacccccacagagcccagcaagctaagatccactggcttgaaattctcgctgccagcacagcagtctgaagtcgacctgggaagctcgaccttgttgggagaggggtgtccaccactactgaggcttgagtaggtggttttcccctcacagtgtaaacaaagcagctaggaagttccaactgggcggagcccaccacagctcagcaaggctgctgtagccatattgcctctctagattcctcttctctgggtagggaatctctgaaagaaaggcagcagccccagtcaggggcttatagataaaactcccatctccctgtgacagagcacctgggagaaggggcagctgcaggcgcagcttcagcagacttaaacgttcctgcctgctggctctgaatagaggagcagatctcccagcacagggttcgagttatgctaaggtacagactgcctcctcaagtgggtccctgacccccatgcctcctgactgggagacacctttcagcaggggtcaacagacacctcatacaggagagatccagctggcatctggcaggtgtccccctggaatgaagcttccagaggaagaaacaggcagcaatctttgctgttctgcagcctctgctgtgacacccaggcaaatggcctggagtggacctccagcaaactccagcagacctgcagcagaagggcctcactgttagaaggaaaactaacaaacagaaaggaatagcatcaacatcaacaaaaaggacatccacacaaaaaccccatcagaaggtcaccaacatcaaagagcaaaggtagataaatccatgaaggtgaggaaaaaccagcacaaaaagcctgaaaattccaaaaaccagaatggctcttgccctccaaagcatcacaactcctctccagcaaggaaacaaaactggatggagaatgagtttgacaaactgacagaagtaagcttcagaaggtgggtaataataaagtcctccaagttaaaggagcatgttctaacccaatgcaaggaagctaggaaccttgaaaaaaggttagacgaattgctaactagaataaccagtttagaaaaggacataaatgacctggtggagctgaaaaacacaacacaagaacttcgtgaagcatacccaactatcaacagccaaatcaatcaagtggaagaaaggatatcagagattgaagagcaacttaatgaaataaagtgtgaaggcaagattacagaaaaaataatgaaaagaaaaaaacaaagcctccaagaaatatgggactatgtgtaaagaccaaacctaagtttgattggtgtacctgaaagtgacagggagaatggagccaagttggaaaaaactcttcaggatattatccagaacttcctcaacctagcaagacaggacaacattcaaattgaggaaatacagagaacaccataaagatactccttgaggagagcaacccccaagacacataatgatcagattcaccaaggttgaaatgaaggaaaaaatgtaaagggcagccagagaaaaaggtcggattatccacaaagggaagcccatcagactaacagggtatctctctgcagaaaccctacaagtcagaagaaagtggggaccaatattcaacattctaaaagaaaagaattttcaacccagaattacatatacagccaaactaagctgcagaagtgaagaagaaataaaatcctttacaaacaagcaaatgcgcagagattttcacaccaccaggtttgccttacgagagctcctgaaggaagcactaaatatggaaaggaaaaaacggtatcagccactgcaaaaacataccaaattgtaaagaccatcatctctatgaagtaactacatcaactaatgggaaaaaaaaaacagctaacatcataatgacaggatcaaattcacacataacaatattaaccttaaatgtaaatgagctgaataccccagttaaaagacacagactggcaaactgcatggagtcaagacccatcagtgtgctgtattcaggagacccagctcacgtgcaaagacacacacagactcaaaataaatggatggagaaatatttaccaagcaaatggaaagcaaaaaaaaagcaggggttgcaatcctagtatctcatataacagactttaaaccaaaaaacatcaaaaaagacaaagaagggcattatataatggtaaagggatcaatgcaacaagaacagctaattatcctaaatgtatatgcacccaatacaggagcacccagattcataaagcaagttcttagagacctgtaaagagacttggactcccacatgataatagtgggagactttaacaccccactgtcaatattagacagatcaatgagacagaaaattaacaaggatattcaggacttgaactcagctctggaccaagcgacctgatagacatctacagaactctccgccccaaatcgacagattatacattcttctcagcaccacatcgcacttattctaaaattgaccacataattggaagtaaaacattcctcagcagatgcaaaagaacaaaaatcataacaaactgtctctcagaccacggtgcaatcaaattagaactcaggattaagaactcactgaaaaccatacaactacatggaaaatgaacaacctgctcctgaatgactactgggtaaataactaaatgaaggcagatataaataagttctttgaaaccaatgagaacagacacaaagtaccagaatctctgggacacagctaaagcagtgtttaggaggaaatttatagcactaaatgcccacaggagaaagtgggaaagatctaaaatcaacactgtaacatcacaattaaaagaactagagaaacaacagcaaacaaattgaaaagcaagcagaagacaagaaataactaacatcacagcagaactgaaggagatagagacacgaaaaatgcttcaaaaaaatcaatgagtccaggagctggttttttgaaaagattaacaaaatagataggccactagccagactaataaagaagaaaagagagaagaatcaaatagacacaacaaaaagtgataaaggggagatcaccactgatcccacagaaatacaaactaccatcagagaatactataaacacctctacgcaaataaactagaaaatctaggaaaaccggataaattcctggacacatacaccctccaaacattaaaccaggaagaagtcaaatccctgaatagactaataacaagttctgaaattgaggtaatagttactagcctaccaaccaaaaaaagtccaggaccagacaaattcatagccaaattctacagaggtacaaagaggagctggtaccattccttctgaaactattccaaacaacagaaaaagagggaatcctccctaactcattttatgagcccaacatcattctgataccaaaacctggcagagacacaacaaaaaaagaaaatttcaggccaatatccctgatgaacatcgatgcgaaaatcctcaataaaataccggcaaaccgaatccagcagcacatccaaaaacttatccaccacgatcaagttggcttcatccctgggatgcaaagctggttcaacatacacaaatcaataaacgtaatccatcacataaacagaaccaaagacaaaaaccacataattatctcaatagatgcagaaaaagccttcgacaaaattcaacaccccttcatgctaaaatctctcaataaactgggtattgatcgaatgcatctcaaaataataagacctacttatgacaaactcacaaccaatatcatactgaatgggcaaaaactagaagtattccctttgaaaaccagcaaaagacaaggatgccctctctaaccattgctattcaacatactattggaagttttcgctagggcaatcaggcaaaagaaagaaatcaagggtattcaaataggaaaagaggaagtcaaattgtccctgtttgcagatgacatgattgtatatttagaaaaccccatcgcaaaatttccttaagctgataagcaacttcagcaaggtctcggatacaaaatcaatgtgcaaaaatcacaagcattcctatacaccaataacagacaaacagagagccaaatcatgagtgaacttccattcacaattgctactaagagaataaaatacctaggaatccaacttacaagggatgtgaaggacctcttcaagaactacaaaccacggctcaaggaaataagagaggacacaaacaaatggaaaaacattccatgcttatggataggaagaatcaatatcgtgaaaatgaccatactgcccaaagtaatttatagattcattgctatccccatcaagctaccactgactttcttcacagaatgagaaaaaaaaaaaactttaaacttcatatgaaaccaaaaaggagcccacatagccaagacaatcctaagcaaaaagaacaaagctggaggcatcacactacttgacttcaaactatactgaaagccacagtaaccaaaacagcatggtactgatatcaaaacagatatatataccaatgaaacagaacagaggcctcagaaataatgccacacatctacaaccatctgatctttgacaaacctgacaaaaacaagaaatggggaaaggatgtcctatttaataaatggtgttgggaaaactggctagccatatgcagaaagctgaaactggaccccttccttataccttatacaaaaattaactcaagatggattaaagactcaaatgtaagacctaaaatcataaaaaccctagaagaaaacctgggcaataccattcaggacataggcatgggcaaagacttcatgactgaaacactgaaagcaatggcaacagaagccaaaattgacaaatgggatctaattaaagagcttctgcacagcaaaagaaactaattatcagagtgaacaggcaacctacagcatgagagaaaatttttgcaatctatccatctgacaaagggctaatttccagaatctacaagcaacttaaacaaatttacaagaaaaaaacaaccccatcaaacagtgggtgaaggatatgaacagacacttctcaaaagaagacatttatgcagccaacaaacatatgaaaaaaagctcctatcactggtcattagagaaatgcaaatcaaaaccacaatgagataccatctcaggccagttagaatggcgatcattaaaaagtcaagaaactggctaggcacggtggctcatgcctgtaatcctagccctatgggaggctgaggtgggtggattgcctgagctcaggagttcgagaccagcctgggcaacatggtgaaatcccgtctctactaaaatacacacaaaaaaattagccaggcgtggtgataggcatctgtagttccagctactcaggaggctgaggcaggagaatggcttgaatccgggagccagaagttgcagtgagccaagactgagccactgcactccagcctgggcaacaaggcaagactccatctcaaaaaaaaaaaaaaaaaaaaaaaaaaaaacacagatgctggagaggatgtggagaaataggaacacttttacactgttggtgggagtgtatattagttcaaccattgtggaagacagtgtgacgattcttcaaggatctagaaccagaaataccatttaacccagcaattctaatactggatatatacccaaaggattataaatcattctactataaagacacacgcggccgggcgcggtggctcacgcctgtaatcccagcactttgggaggccgaggcgggcggatcacgaggtcaggagattgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagacacacgcacatgtatgtttatggcactgtccacaatagcaaagacttggaaccaaccaaaacgcccatcaatgatagactggataaagaaaatgtggcacatatacagcatggaatactatgcagccataaaaaaggatgagttcatgtcctttgcagggaatggatgaagctggaaaccatcattctcagcaaacacacacaggaacagaaaaccaaacactgcatgttctcactcataagtgggagttgaacaatgagaacacatggacacagggaggggaacatcacacactgggacctgtgggggtggggagctaggagaggtatagcgttaggagaaagacctaatgtagatgacaggttgatgggtgcagcaaaccaccattgcacgtgtatacctatgtaacaaacctgcacattctgcacatgtatcccagaacttaaagtataatttaaaaaaaaaagaagagggagattaggatatacaaagagatgcaccagggacacttgctcacagaggaaagaccacgtaagaccacaatgaaaaggcagagccatctgcaagccaaggagagagccctcagaagaaactaaacctcctgacaccttaatcttagtcttctatcttccaaaactgggaggaataactttctgttgtgattaataaatgtttgatgtttaagccaccaagtctgtggtattttgttatggtagccctagcaaattaatgtactaagcttaaggataattttaaaagagacctctttacttcttctcttttagcgattttcctcaactcctccaaatcctctaattccaggcttctacattctgccaatgtacacaaggtcagaggccaactaatcacctagtttatcccccttattttacaagtgataaaactgggcccaaaaaagtcaaataacttagccagatcacaccttgtttgcggtagatccaagactaaaagccaggtatccagacttccagttctataacatttctatgcctttagatgccttacaaatatttagcaagctgcttgtactgttatgcttcctttcccatgggacacttttgtatgctaagcagatattcaaatataaaaagatccaaagtaatgattattttatgatggaattataagcaccctgaaaggcagtccaggagatatctggggacagggagacattctgagaaacttaaaatcataatatgatttttggtatccagtaattatggaataacaggaaccagattaaccatcctatcttggaaacctaaaaaacaggccaggcacagtggctcacacctgtaaatccagcactttgggaggctgagggggcagatcatgaggtcaggagatcgagaccatcctggccaacatggtgaaaccctgtctctactaaaaatacaaaacattagccaggtgtggtggcaggcgcctgtagtcccagctactcgggaggctgaggcaggagaatggcgtgaacccgggaggctgagcttgcagtgagcagagatcacgccaccacacacacacacaaaaaaaactaaaaaacaaatcaaaatacataaaacaacagtttcagatataggtaaacagaaagtgcaggacagtgatccctgaggaaggaaaaacaaataaggtgagccctatgagtacccccacctcaatgcctacagacagttttcagactgtagtacaggcaggaggattccaaacagagctcagtagtcttactgagtcaaggaaacacaattcagagttaagagtggccaaggcaactagaatttataggacagagtataggagacggattttcacaaagagcaaaagctccagagacccacagagaggttccctgatggtatttaggtaatgacctatgcatatatgtaaggatactactgaggcaaggaaagtaacataaatggccccaatagtccctgtacacagttgtttttggataaacatggaaactgacctttctgctgttaaagctggaaacttgtatttgttttatcctcaagaaaggatcttcaggcctctcaaaaaagtatcaaagaacagaaactcacaagatcaccacactacatgcctccttggccctccctaattcctgttttcttacacattgttacatttcttccctgctatataaacccctaattttagtcaatcagggtgatggatttgatgctgagctcccatctcctcaactgcagcacccaattaaagccttcttcctggacaatacttgtcatctcagtcattggccttctgtgcggcaagcagcaggacctagaccaaacccctggtgtttctataacagaaccaccaggaagaagtaagtgaagcaatcaccatagttcacataggaccagaatagttcactttggacagccagactgaaaagacttcataacacgtaaggcactgagtaagaagggtatgaatacagaagggtactgacagcctcagaaagcctcagtagagaagccaaattagcatagactaagaactgttttttaccactctaacaaattttgaagaaagccttaaaaaacaaaaaaactgactccaaggaacttaacttcatcccagaaaaaaacaaaaaaaatatttaaaggaatatcaaatcaactagcacccaacaacataaaacccaaaatgtctgacatccaattaaaaattaccaggcatatgaagaagcaggaaaatatgatccataaagaggagaaaaatcaataaacataaacagatatcaaaatgacacagatggtagaaagagtaagcaaagataagaaaaaagcagccgggcatggtggctcacacctgtaatctcagcactttgggaggccaagacaggcagatcatttgaggtcaggagtttgagaccagcctgaccaacatggtgaaaccctgtctctactaaaaacataaaaattagccaggcttggtggtgcatgcctatgggcccagctattcgggaggctgaggcagtggaatcgcttgaacccaggaggtggaggttgcagtgagttgagatcatgccattgcactccagcctgggcaacagagcgagactgtctcaaaaaaaaaaaaaaaaaaaaaaaaaaaaaaaaaaaaagctaagaggaaggccattaagaaatatattacatatgttcaagaaggtagaggaaaacaggagagtaataatgagaactataaaatgtataaaagacacaagttgagtttctaaaaataaatatatagcagaaatgaaaaaatattagattggattaacagtaacttaaacattgctgaagaaaagaccaatggagttgaagatgtggcaacagaactatccaaaattatatatatatatatatatatatatatatatatagagagagagagagagagagagagagagagagagagagagagagacagaaacactgaaaaaatgatgtaacagaggatcactgagctaacagcttatattaactggcctaacatacaagtaattggtacctccaaaaaaatgaagggagaagacaggaaaaaagtatttgaaaccttaatggtcaaaacttctaaattggctgggtgcagtgcttcacacctgtaatcccagcactttgggaggctaaggctggcagatcacctaaggtcaggagttcaagaccagcctggcctacatggtgaagccctgtctcgactaaatatacaaaaaaaaattagccaggtgtgatgacgtacacttgtaatcccagctactagggaggctgaggcaggagaatcacttgaacccaggaggcagagggtgcaatgagccaagttcataccactgcactccagcctgggtgacagagcaaagactctgtctcaaaaaaataaaaaataacacaaacttctaaactaaatgaaaactataaacccagagaacacccaagaagaagagataagaagaaaacaataccataatcatcataaccgaattgccaaaaactggagatgaaaagaaattagccaaatgaaaaaggcacatacaggtactgaaaaatagaagtggggctgccaggtgcagtggctcatgcctgtaattccagcattttgggaggctgaggtgggcagatcacgaggtcaggagattgagaccatcctggataacacagtgaaaccccatctctactaaaaatacaaaaaattagccgggcgtagtggcgggtgtctttagtcccagctactcgggaggctgaggcaggagaatggcgtgaacccgggaggcggagcttgcagtaagccgagattgcaccactgcattccagcctgggcgacagagtgagactccatctcaaaaaaaaagaaaaagaaaaagaaaagaaaaatagaggtggggcagggaggaatgatggcggatgttttgtcagaaacaatacaagcaagagaagatagatcaatagaaattatctaaatgaaatgcaaagaggaaaaaagagtgaaaaaaacggaatagagaattcaagagcagagaaacttggtatatgcataattggaatcctaaaaggcaaagagagaaagaacagggccaaagaaataatggctgagaaatttccaaaattagtgacagacaataaaccatggccagatccaataaacactgataacactaagcaggataaataaccacacacacacacacacacacacacacacacacacacacacacacacacaaggcatatcataattaaactgctaaaaaccacagacaaagagaaaatcttgaaagcagccaaaggaaaaagatacattgcctataaaggaataagaataagaattgcagaccgggcatggtggctcacacctgtaattccagcactttgagaggccaaggcaggcagatcacaaggtcaggagttcgagaccagcctggccaatatggtgaaaccctgtctctactaaaaatacaaaaattagtcaggcgtggtgtcaggtgcctgtagtccgagctactcaggaggctgaggtagaagaatcgtttgaacccgagaggcggaggttacagtgagccaagattacgccagtgtactccagcctaggtgacagagtgagactccatctcaaaaaaaaaaaaaaaaaaaaaaaaaaaaaaagatttacagcagacttgtcatcagaaactatggaagaaaatggactgacatctttaaagtgctggaagaaaaaaatgttaactcaaattccatactatgcaaaaaatccttcaaaaatgaagaaaacaaacttaaattcctggaggcatgcttattctttaaaaaatattaaagaaaaggccttcagacagaaggaatatatgtcaaaaacatttttttgtgagacagggtctcattctgctgtccaggctggagtgcagtaacacagtcacggctcactgcagcctcagcctcaacctccctggctcaagctatcctcccacttcagtctccctagtagctggaactataagcacacactcccatgcccagctagttttttgtattttttgtagagatggagttttgtcatgctgcccaggctggtctcgaactcctggactcaagcaatccccaaacctcagcctcccaaagtgctgggattataggcatgagctaccccacccagcctcaaaaacttgaatataaaagaaaattgaataatatcagaaaagaaagaaacaaagataaaatcaaaatcactttttttcttattgttaatcatcctaataggtaacaatgtttcaagcaaagatgggaacaaaaaatttcatgtatggaatatgttggagtgaaattatgacatcaacagcaagaggtaagacagagaagtgtacttatactttgcatgaagcagtataatttttgaaagaagactggttattttaaaatgtattttataaactctaggacataaaaagcacaaattactttttaaattatgaattgcatttcatcaaaatttaaaacttttactcttcaaaagacactttaagaaaatgaaaaggcaaaccagatacaaggaaaaatatttacaaaacaaatatctgacaaaagactggtattctgaatatataaaaacacagttcaataataggaccaacaactcaatttaaagataaagaaaggatgtgaacaggaatttcaccaaagtatacaaatgccaaataagcacataaaacaatgttcattatcattagtcattagggaaatgcaaatgaaaacgtagtaagatactactgaatactcactagaactgctaaaattaaaaagactgactataataagctttgataaggatgtggaacaactttaactttcacacattgctggtgggaatgcaaaaatggtccaagcacttggggaaaaagtttggcaatttcttaaaaagttaaacatatacctactacacaatccatgaaaaccactcctaggtatttgctccaaagagatagaaacacatgtccatgaaaagatataaatcttcatagcagttttattcataatacccaaaactggaaacaacctaaatttccatcaggtggtaaatggataagcaaattgtatagtaagcaaattcatatccatggtttctgcaaggccaactacaggacatgagcatccatggattttgatacccacgatgggtcctccaatcccctatggatattgagggacaagtgtatatatacattcaacataataatacttacaataaaaagaaacaaactatgcaacaacattgatgaatccccaaaacattacactaagtgaaagtagcccaactataatgacagaaagcagatcagtagttcctagggtgagtggggtgaagggttgactgtaaagcggcaagaagaaactttttgaggaataggaatgttatatcagtatggtagtagctaatgaatgaacatatttatcaaaactcaccaaattatatacttaaaaattggcaaattttacctaataatgttgaccaatttaaaggtgatagggaagaggaggagaaggaacaggaattcttttaaaatcatttgcaaaggttatctcttgttttacccattcacagggtaattcctcgcctaaatctaattgagatatctactaaatatactggaaacaacagcaaatcatacaacatattggaaaaaagcatggctatcatctcctagttctttagaacttcaaagaggaggcttaatcttaaagccactgtaataagagaatgtttgggagtaaaagtaggactcaaataggacttggaaggcaggataaatgtgagacagaaaaagagcttttggacaagtgaaataatttgtttaaatatttttataacatcgaaatgtaaattcatttgcagagatgagaagctatccttggaaaaactccctgagctcctcatggactagtctgtgtgctcatgacttctcagtcctgaggaaaattggaaattctacactcccttctctgcaagagtcctgttcctccacatgactttttcctcttttaacacaagagacatctaattaacttttctgccacatgcagctggcaccaaggcaaaccaaactgtggagtggctgacccagaattactgatgaatgttgaaaataaacatgctttcagccaatctggaatggtatatttctaagaagacagagaactcttaaaattaattaactcatccagacaaactgtccatccaatgcaagtttttcagtaatgaatatcagaccacagatcttcctgcagctgagcttgtttatcatacaaggaggctgcttctgcatgtctcatggataacttcatgatttttatttttaccggcttctggcttcttgtatttatataaacaggccaagaaagcaaaacaatatgagagtaagtttaaatggaagataccacatttccccaaaagacagaaacacctaactttctctccttttccacatgtcagagtagacaattaaggagaaaaagaccctgaccttgggaggagaggagagggcctcaataaaaagcatgaacttacttaagcggttctgtcattgtgttgaaattctaataaagtgctctctactgcaaagtttgtgtatatgggagccatgcacaaaataacaccagaaccacatgaaaactgtagcttaaccctaaattaggaagttccaaagttggtgtcccgaaagaatgcatttggctgcagggtacagataaccaatgccataccaagcaaggatttttctgttgttttgtttgcctgtttgcttggttttattcatgtagaatataatcttctgaatgggctctgactgtgggtctaaagggaacagtgcatctcttatgcgtccattttgagacagaagtaaacccttgaaaatttctaaaatgtcttcccttccttggaatgaattgaccacactgtctgataccaagttgttgctgttctttagtcagagagggcccaagggctgctttggccagctttggaagcagagacagggcctccaaccctctgcgaactagcctaggtggatacctctgttaatgaatctccactgtctttctctctatgggctttttctaacatctttcagtactgagtcctttctgtcacaaatcactttatggggcaaccatgtagtgacttatctaaatgaacagagtaactaccatttgttaactacctactatgcattgggcattgtgctaatactttacatatataatatgatgtcatttcacaacaacacaaagtggtaatacagagttttaactaatagttcaaattctagagtcagactacttgggttagatgtctttacttcatctcttataagctgagggaccttgcagaagttacataatctctttgttccttagtttccgtatctatctataatacagaaataatgaaagaatctgttacatagaatttctgtaaagattgaagtactcaataagtattagctatttattatttctgttttacagattaaaaaacaacaacaacaaaaaactaaggcctagcaacattaactgactcgtccacacagttagagttcatatatatgtctgtctgactctaaatccagcatccttaactgctataccactttgacttcccaaaatattctcaggcccagactttctcaaagcatgttctatggaaaatggagaggaggaggcagagcaagatggccaaatagaagcctccagcaattgtgttcgcccttccgccacccatccccatgcaggaacaccaaattgaacaactatccatacaaaaaaaagcacctttataaaaataaaaaaatcagcttgggtaccagctcagccacagtggaacagagcaccaggcaggctcctgggagtccccagctctaggccttggctcctagatggcgtgtctggacctgccctgggccagaggggagcccatagccctgaagggagagactcaggactggcagcattcaacacaagctgactgaagagttcttgggccttgagtgaatattggcagtagccaggcagtactcacagcaggcctagggtggtcgtggccacagggagagactcctctgcttgaagaaaggggaaagaagaaggggaaggactttgtcttgaggtttgggtgccagctcagcagcagtggaatagagtaccaagtaaattcctaaggttcccaactccaggccctggctcccagacaacacctctggacctacctggggctggggggtagttcgccaccctgaatgcaaggaaacaagcctggctggcttcaccactgctgactgtagaccccttaggtggcagccaggcacttatgaccatgaactgtcaccgagacccaatgctatgctggtttcaggtctgactcagtgcagtcccaggggtggtgaacatagtggtgcttaagtcacctctcccctatctcaaggcagctcagcacagagagacacagactgtttccatttgtttgcaggcaaagtaagggaaggaaacaagagtctctgcctaatccagtgaattctcctggatcttacccaagactcccaaggcagtacctctatgacactgcatgagccacactgttacttggcttggggtgccccctcatgcagatatagctgcagtgaccaaagacttacatcacaacacccaaatccctttgaatacgtggaaagcgttcccaagaagaatgggtacaaaaagactgtgaagactacaataaatatctaactcatcaacgcccagacaccaacgaacatccacaaccatcaacaacatccaggaaaatatgacctcaccaaaagaactaaataggccaccagggaccaatcctggagaggcagagaaatgtgacctttcagacagaaattcaaaatagctgttctaaggaaactccaagaaattcaagatgacataaagaaggaattcagaatcctattagataaatttaacaaagaaactgaaataattaaaaagtagcagaaaatctggagatgaaaaatgcatcaatatcctttaattatagaattaatcagaagaaataattagtaagcttgaagatggggtatttgaacatacatagaggagacaaaagaaaaaagaattttttaaaatgaaacatacctataagaccaagaatatagcctcaaaatgacaaatctaagagctattgtccttaaagaagaggtagaaagaatgaagtagaaagtttatccaaagggataatatcagaaaacatcccaaacctagaaaagaaatcaatattcaagtacaagaaggttatagaacaccaaacacatctaatacaaagaagactatctctcaagacattaaataatcaaactccaaaaggtcaaggttagagaaaggatcctaaaagcagcaagagaaaagaaaccggtaacaaaggagctccaatacatctggcaatggacttctcagtggaaatcgtatgggccaggaaagagtagcatgactttttttttagacagagtctcactgtgtcacctatgctggagtgcagtcgcacaatcacagcacaccacagacttaacctcccaggctactgtgatcctcccacctcagcctcccaaatagctgggactacaggcatctgccaccatatctggctaattttttttttattttgtatagatggtgtttcaccatttcccaaagctgttctcaaactcctgggctcaagcgatcctcagcttcccaaagtgctgggactgtaggcatgagctactgtgcctgggcagcattacatatttaaagtgctaaagaaaaaactttatcctagaatagtatattcagcaaaaatatccttcagacatgaaggagaaataaaaactttctcagacaaacaaatgctgaggattttcatcaataccagacctgtcctacaagaaatcctaaagggagtttttcatatataaaaaaaaggatgttaatgagcaataagaaaacatctgaaagtagaaaactcactggtaatagtaagtgtgcagaaaaatacaaaatattataccactataattgtaatatataaactactcatatcttgaatagaaagactaaaagatgaacctatcaaaaataataactacaacaacttttcaagacatagacagtacaataggatatgaatagaaacaataaaatgtttaaaagcagaggggaaagagtagagtttttattagttttctcttttcttgtacaatcagtgttaaactgtcatcagtttaaaataatgagttatacggtattatttgtctcatggtaacctcaaatcaaaaagcatacaagtaccaaaaaataaaaagtgagaaactataacatactaccaaagaaaatcaccttcactaaaaggaagacaggaagaaggaaagaaggaagagaagactacaagacaagtagaaaacacataacaaaatggcagaagtaagtccttagttatcaataataacattgaatttaaaagtctaaactttccaatcaaaagacatacagtggctgaatggatagaaaaaaaaaaacaagacccagtgatcggctgcctacaaaaaacacacttcacctataaagacacacacaaactgaaaataaagggatagtaaaaggtattcagtgccaatggaaaccaacgaagagcaagagtagctatgtttatatcacatggaatagatttcaagataaaaactacaaagagaaaccaaaaaggtcatcatataagaataaaggggtcaattcagcaagagaatacaaaaattataaatatataggcacctaacactggagcacctgatatattataaaaagcaaatattattagagctaatgagagagatagactccaatacaatagtagctggagacttcaacaccccactttcagcattggacagatcatccagatagaaaatcaacaaagaaatactggatttaatctgcactagagacccaatggatctaatgaatatttcatccaagagctggagaatacatattcttatcctcggtacataggtcattcccaaaaacagaccacgtaaggccacaaaacaactcttaaaagttcaaaaaattaaaatcatatcaagtattttctctgaatgtaacagaataaaactagaaattaataataagagaaattttgaaacatagaacacatggaaattaaacaatatgttcctaacttattggcagcacaatgaagaaactaagaagaaaatttaaaaatttctttaaataaatgaaaatggaagcacaacataccaaaacctataggacacagcaaaaacagtactaagaagaaagtctgtagcaataaatacctacatcaaaaaaagtagaaaaacttcagataaacaatataatgatgcatcttaatgaactgtaaaagcaaaagcaaaccaaacccaaaatcaatagaaaaaagaaataataaagaccagagcagatatcaatgaaactgaaacaaaaaatacaaaggattgataaaacaaagagttcattttctgaaaagacaaacaaaatcaaatctttagccagattaaaaaaaaaacccaaataaatacaatcagagatgaaaaagaagacattacaactgatattgcagaaattcaaaagataattagaggctacctgagaaactacatgccaataaactggaaaacctaaaagaaacaaacacatacaactcaccaagattgaaccatgaaaaaaatccaaaacctgaacagaccaataataagtaatgagatcaaatgctaataaaaagtcttccagcaaagaaaagcccagatccaatggcttcactgctgaattttattaaacatttaaagaagaactattaccaaacctactcaaactattctgaaaaattagagaagaaggaagaacttccaaattcattctacaaggccaggattatcttgataccaaaaccagacatattaaaaaaagaaaactacaggccaaaatcccttatgaacattgttacaagaatcaataaaattcaaccaagccaaataaacaacatattaaaaagatcactcactcggaccaagtgggatttatgtcagtgatgcaaggatggctcgacataggcaaatcaatcagtatgatacatcatgtcaacaaaaagaaggacaaaaaaagatcatttcaactgatgctaaaaaagcatttgataaattcaacatcccttcatgataaaaaccctcaaataactaggtatataaggaatatgccttaacacaataaaagccatatacaatagagccactgctagtatcatactgaatgggcctttcctctaagatctagaacaagacaagtgcacccaattacaccactgctacgcagcatagtactggaagttctagatatagcaataagacgagaaaaaaacaaagggcctcaaaatttggaaaaaaaaatcaaattatccttgtttgtacatgatataatcttatatttggaaaaaaacaaagactccattaaaaaaaaactattagaactgataagttgagtaaagttgcaggatatgaaatcaacatacaaaaatcaatagcatttctatatgccaacacaaacaatctgaaaaagaaatcaagaaagtaatcccacttacagtagcaagaaataaaataaaacacccagaaataagcttagcaaaagaagtaaacaatctctacagtgaaaactataaaacattgatgaaaggaattgaagaggacaccataaaaatggagatattccatgttcatgcattggaagaatcaatattgttaaaatgtccattctacccatagcaatctacagattcaatgcaatccctatcaaaatatcaatgacattcttcaccaaaataaaaaaaaaatcctaaaatttatatggaaccacaaaagaccaagaatagccaaaactatccttagcaaacctagcaaaactggaggaatcacattacctgacttcatattatactgcagaggtatagtaaccaaaacagcatggtagtggcataaaaacagacacatagatcaacggacagaatagagaacccagaaataaaaacatacctctacagtgaactcattttcaacaaaggtacaaagaacacacactggggaaaggacagtctcttcaataaatggtgctgggaaaactgcatatccatatgcagaagaataaaactaggcccgtatctcttactgtatgcaaaaatcaaatcaaaatggattaaaaacttaaatctaagacttcaaactatgaaactactaaaaggaaacattgcagaaaatctctaggacattggtctgggcaaaaaattgttgagtaataccccacaaacacaggtaaccaaagtgaaaatgaataccctggatcacatcaagttaaaaagcttctgcacagcaaaggattcaaccaacaaagtgaagagacaacccacagaatggtagaaaacatttacaaactacgcatctgacaagggattaataaccagaatacataaggagcccaaacaaactctataggaaaaaaaatttaataatctgatcaaaaaaatgggcaaaagatttcaacagacatttctcaaaataagacatacaaatagcaaacaggcatatgaaaaggtgctcaacatcactgatcatcagaaacatgcaaatcaaaactgcaaggagatattatctcaccccagttaaaatggcttacatccaaaagacaggcaataacaaatgctggcaaggatgtgcagaaaaggaaatccttgtacattgctggtgctggtgcaaatgtagattagtatgaccactatggagaagagtttagaggttcctcaaaaaagctgaaaattgagctaccatattatccagcaatcctactactgggtatatacctcccaaaaaagcaaatcagtatatcaaagaggtatctgcactcttgtgtttgttgcagcactgtttacaacagctaagatttggaatcaacctaagtatccatcaacagatgagtgaataaagaaaatgtggtatatatacacaatggagtactattcagccataaaaaggaatgagattcagtcctttgcaacaccatggatggaaatagaaatcattatgttaagtgaaataagccaggcacagatagacaaacattgcatgttctcacttatttgtgggatctaaaaagtcaaaacaattaaactcatggacatagtaaaaggattgttaccagaggctgggaagggtcatggggggttggcagggaggtgaagatggttaatgggtacaaaaaaatagaaagaatgaacaagacctactgttggctagcacaacagagtgattacagtaaataataaaatgtacattttaaaataacaagagtgtatgtggattgtttgtaactcaaaggataaatgcttgaggggatggataccccattctccattatgtgcttatttcacattgcatgcttgtatcaaaatatctcatgtatcccataatatatataccaactatgtacacaaaaattaaaaataaaaataagaaaacaaaataaataatactgctaagaaaagaatgagtatccacctgacagagttttttgaagattaaatgacacatacatgcgaagcacttagcaaatagtaaaatatcatgtaaatgtaatatagaaatactaatataaaacatgagtctgatgaagataaacaagacagagagaatatatcattttcatagactcagtaacacccgagcataacactactaaactgtaaacttaaaaatggttacaatgggccaggcgcagtggctcacaccggtaatcccatcactttgggaggccaaagcaggtggatcacctgagatcaggagtttgagaccagcctggccaaccatggccaacatggtgaaaccccagctctactaaaaatacaaaaattagccaggtgtggtggcgcacacctgtaatcccagcaactcgggaggctgaggcaagagaattgcttgaacccaggaagcacaggttgcagtgagccaagatcgtgccacactccagcttgggcaacagagcaagactccgtctcaaaaaaaaaaaaaagtgaattttttccaaggccacagtaatttattaccagctaataagatacatttcttgaggaataaaaaacaatcaaaaacagcaaaggcccagtttcaaatcttactaattatgtcatttcacacaactcacacgtttctgaatctcagatacctcatctttaaaatgtgagtaataataattttttctcaaggtttaataaatgtttaaatgaaacaaactatattaaatatttaggacagtgtctggtacacagttaatgttcaaaaataacagtttccagcatttagtttgaaggagcttactctcctcataatcaatacatctttgcataaatcaaaagcagtaactactgtatgattctccaacgtttttattgcacaaggtatgggagaaataaaagacatggactccacttttatagagcttacaactgagttatgataccataaataataacagatggcatgattttattgaaatggcaaatcactactcatgacctaactataggtaagactcatagtacaacactttaaaaccttaatatgtacatataataaactttagggttttataatatgaaggctatgatggaaattttttatattattgtggtaataacacaacatgagctctaccctcagtttttacaaataactgttgttaactaaggtcacaaaattctacagctgatcttaatgaattaattaatcatcgtgcatatgtgaaactttatacccactggataataatttcccattttcctcttctcccagtacctggaaaccaccattctactctttgtttctattagtttgactatctcaaatacttcatataagcgagatcatgcaatatttgtccttctgtgattagtttatttcacttagcataatgtgctccaggttaatccatgttgtcacatatgacaaaactgctttctttttaacgctgaataatattccattgtctttttataccacattttttagtcattaatccatcaatggacatttaggttgtttccacatcttgactattgtgaatattgttgcaaggaacatgggagtgcaaatacctctttgagattttaatttcaattctcttggaatgagaggatttctggatcataaagtatcttaattttttaaggaacttccatactgttttacatagtggctgcaccattttacatttccattgatagtataaaagggttccagtttctccacatcctcaccaacagctatcattttttaaataatagctatcctaacaggtatgaagtgatatctcactgtggtttaatttgcatttccctgatgattagtgatactgagtctttagtccattttggcttgatttttgggtatggtataaaataagggtccgattttattcttttgcatgtggatatcccgttttcccaacatcacttgttgaagggactgtcattttccaattgtatatttatggcacccttgtcaaggattatttgaccatatatgcatggtcttatttctgggctctcaattatgttcctttggtctatatgtctgtctttatgcccttacaaaactattttaattaatgtagctctgtaatatattttgaaacaaggacacgtaacgcctccagctttgttctttctcaagaatgcattggcatttcaaagtcttttgtgattccaaatggattttttgaattgttttctctgtttctgttaagaaaaacaacagacattgagattctgatagggattgcattgaatctgtagatttctttcggtagtatagacactttaaaaatattaattcttctaacccatgaacatggaatgtctttccatttatgtgtgtcttcttcaactccttcatcaatgttttgtagttttcagcatagtagtctttcacctccttaagtttattcctaaatattttaccctctttgatgctattgtaaatggaattgttttatttccttctcagatagctcaatgttagtgtaaagaaatgcaactgatttttgtatggtaattttgtatctacaactttactgaattcatttattagttcaaaatggtaaattttatattatgtgttttttttaccacaattaaaaaaatcacctgggcagctagtgacccattactattagtaactgcctgactgaaatgtgttctgcatgtagcaaagcgataggcacctggaaacatgacatcaaacattttataagtaactctttgtccctataaccagatttctcgttaggaagtacaataatattaggatgcaagtttttatagctctaaaactgatgctgaagaggtacctggaagtgttttagcagatattgtagagatttggggtcaagtgatctgagttcctgtcctagctctgacatttattagcagtacaaccttcaacaagttatttaacattttcagcttaaacttcctcatttgtgcaataataaaaatggtacctacctcataagatggttatatgataattaaataaaatggtaggtataatatgaatacaatgcctggttcatattaaatgttttaataagtatcatcaataataaaatgatgacaatgatgatgatgacaagtaacagggccattcactcacccagtccttgtttctaagcaagaacatataattgtaagaaaacaggttaggtttagcagcacattattagctacagaaagattttcccctctatattaactagattcatatgtatctgtcacactggtatgtcatatttagctgtataagaaggtatctcacatacaaaagtacttcctacccatgtaccaatacttggaaaccattttttaacccatcctcaactatcaaattgtctgcctgcattttggcttttaggagaggactcaggcaaaaagaataaataggtaaaagcagaaaagtgaattgttttcagctgatttgacagagccaaaaatctaatctgcactgaatttttgaaaattaagtttgagtcatgcccatgttattaactcctcagtttataagcattatttgatcccagtacattttccaaaaaaatacaaatgtctccctttcatactgcaactcaaatacaaataattgcaaaggatattatccagatcaaatcaattaccatatcctgtcaatttttcctttgtaatgagtccctaactatccctttcttttccactgctgcttgactaatgtaatcatgctcatctcactcttgaatatcttcactagcctttttggtccttctaacctaggcaacctcaccactattctattctgtcctgtgaggagccatgagataaatcttcctaaaatatcacacataattttcttagtcacaatccttccttgactccctattgtttaaagaaaaatcaaatccccttatcttaattctaaagctgtctcagattgtcttccacaatctgatctcaacccctacaacttcatttttcaaggaaagtcttttacaactagttcctaaactacattagtatattggaaatggaatttgcccaatgacacattattattatctgtaacttatccatttccaaacattaggcactttgtgaaacacaaacaagagtatccctgcctttccaaatactcctgattatgactaaaaacctcagaaaagggatcaaaggttaatatgcataaaacaaaaactcattctatattccttcatttccaagaaaaccttatttctcagcctagactcctagttttttccagagcccttccaactcccaagaaaccaaaatggccagaagatgaacacgacgccatactccatggtggtaactcattagcccaccacaatatcaccagggtctcacgatgctcacttccatactctaaccacagccatctcctattctagtaaataaaacgagatcactggaagagcaagccaggtgctggaagtaacaaagtaaatccactgccaggccagaatacaatctttaccttcctcacatctgatatatagatagatagagatatagatatagataatatagatatagacagatatagagatagagatatcagttatatatagtgatttttaaaacaccatgatatactcaagagcagagataccaggaacagagatgatgaaatgcagagcaaatcctcaggcatcattatttgatactaagaggatcgttagcccctatttggcttttaaatgttataagggtattcagaaattcaatataaggatgcaagtatttctgatcaaccatatatattcatcgctaaactaaaaatgatgatacttttaaatggagcaagagtaaccatgtattgttgaagacgacagattttagaatcattagcactaattcccaaatcctagttgtaaagctgggacaagttatttaacccctgctgaacttcagtttcctcatctttaaaatggcagtattttatcacatgtacccccaaaatatgtatatctattatgtatcaatttaaaaatgaattaaatggtggtatttggaaacctgcttagtagggtagttgtgaggattaaatgagataaaatataaagcagagtcccagccagatgtcagcaagatggtagaataagactttccagcactcatcacccctatagacacatccatttgaacaactaaccacacacaaacgaaccttcacaatagctaagaaaactaggtgagagattatagcacctaggcatagcacaaaaaataagaaaagacatactgaagagaataagagggacaattttacccatgtcacccctcctccgactctaggcagcacatcatggagagagaaggaaagagaaggaagtgagcaatccgactttgccttggaccctgaaactgggccctcctcagtaaagtccagtgctggacaggcccccatggccccagaacgagcctccaaaccttccctcatgccaagccagatcctgcagcatcagcttttggcctgcctagcagattcagtctccaggcccatcccaccacgaggatgaccccagcagtcccaggcttcagaccagcctcagcactagcctggcccaaccccagcaacaggccagcccccagagactcagactacaggccagcccccagggccaggatagccccagtgacatgagatcctagacaatccccagctccaagatggctccctgcagccctagtcacgagccagcaccctcaaacccagtctgtacgcaggctcctacaactacaggctccaagcccaccaaacacctggccagtccctgtggtctcagattccaatcctactccaggtttcagaccatccaagccaggtcagcaaccctggcctcatgtaccaggccaacagctatggacacaggctccaggcccgcccagtgccaggccaatccctgcagccccatacttcagcagacccagaattcagtactgctcaatcagacccaggatccaggcccatcccaacagactcctgcactagactggcccccacagacacaggcttcaggagctccctgtgggcccaggttccagacccaagactgaaaccagccctcgaaaacctaccatccaggccagcacccacacgctgaaccaaccgccaggctggccctagtggacccagtctccagggaagttctcatggccccaggctccaaggccagcacccatagctccaggaccaggttagcacccataatctcaggctccaggccagttgccacaaacccagaagccaggaccgctccaccaggcccaagggtccaggcccactccagcagaccctggtgacagatatgaccccacaggccaaggttccaggaccacccctagaaacccaggctataggccagcacttatagacacagactccaagcctgtctcagtggatcttatagacacagactccaggcctgtcccattggatccaggagccaggtacatcccagcacattgtcagcccctgtacaatccaggtcaaggcccacaccagtgccaggtcccctacattggacccagacttcaggctgatgaccattcatacaggccccaggcatgccttcaaaaacctaggctcgaggcccaatcccacaaacccaaacaacagacccaccccagtagatccaggctccaggtccaaccccatgtaaccaggtcccaggcccacacacctgctgactcaggaactaggccagcctgcctgatgactccagcagcagtccatcccatggaccatgccagataaccttccctgaatctctggactgtctcactgcttaagggctttcctagacaaaaccagtctgcaaaaattcaaataagttcctacttcacaaaatgcacagacatcaatgtaaggtaacaggaaacatgaaaaaaacctaggaaatattaacaccactgaaagaacacaataatctcccaatagctgactccaaagaaatggagatgtataaaccgcctgataaataatttaaagtaattattttgaggaagctcaacaaacctcaagaaaatacagtagacctgtgaccagcaccatgtaaataaactccatgggttcaactatatgcagattttttgaataaatatatggaaacattttttggagatttggaaaaatttgaaaaaaagttgcagataaactgcatagcacagaaatatttaaaaaaagaaaatgttaagtatggcatgaattcacaaaatatatgtagatagtagtctatgttatttactgcaataaaatatatgcaaatctttatgagttaatatttttcaacactttgcagccataacaaagaatgaaatgtccttcacaacaacatgtatagagctgaggccattatcctaagtgaactaactcagaaaaccaaatgctgcatgttctcacttataagtggaagctaaacaatgggtacacatggtcataaagatgtaaataatagacaccagcaactccaaaagcagggaaggtaggagggaagcaagggctgaaaaattacttattggttacaatgttcactatttgggtactgggtattctagaagcccagtccctaccagtatgtaacatgcccatgtaacaaagaagcacgtgtagctcccgaatctaaaataaaattttaaaactaaaaaaatagaccagatctggtctgagtaatgtttaagagaaaaaaaataggccaggtgtagtggctcacacctataatcccagcactttgggaggctgaggcgagtggatcatgaggtcaggagttcaagcctgaccaagatggtgaaagcccctctctaccaaaactataaaaattagccaggcatggtggcaggtgcctgtaatcccagccactcgggaggctgaggcatgagaatcgcttgaacccgggcggcagaggttgcagtgagtcaagatcacaccactgcactcctgcctgggcaacagagtgagactctgtctcaaaaaaaaagctcattttcttggatttcatgtgaaatttcacacacataaaaatatacatatatatcaaaacctacacaaacacaaactggacacgccaattcacagtcaaaagaaatgtaaaaagatataaaatgcagtattaaaccataactgcgtaaaattaactgttgtacataccatactactatattaattctgtagccacctgctattgctaagtagtaagttcaagtcttgggagcaccaacctaaaatgccatgtgatgctaaccatctctgcatgagcaatttgtctctccaataaactacatatggcagtaaaaagtgatctcttatggttctcacatattttccaccatgtttagcacaatgctgcaaaccttgactaacatcatgggactcatatgaagtgtcactggtgatgctggaagtgctcccaagaagccaagaaaagtaatgacattataagaaaaagttcaattgcttgatacatactgtaggttgaggtctgcaactgcagatgtccaccatttcaagatagataaatccagcataaagatcattatgaaaacagaataggaaatctgtgaaactgtcagtgcagctacaacagcaggtgcaaaaaccttacacatttgcaaaaaacaaaatatgtgttaatctactgttccataaggcttctggtcaaaagaaggctattagtacttatgtttttcagaaataaagttatgcatatgctgggcacagtgtcttatgtctgtaatcccagcaatttgagaggccaaggcaggtggatcacttgaactgaggaattcaagcctagcctgggcaacatggtgaaacccaatgtctacaaaaaattagccgggggtggtggcatgcgctatggtctcagctacctgggaggctgaggtagcaggatcgcttgagcccaggaggtcaaggctgcagtggttgacagagcaagaccctgtctcaaaaaaaaaaaaaaaaagttatacagatttgtgaatgcatggcaaattggcactcctaacccccatgttgttccagggtcaatggtaaaaagaaacaaatgaaatctggaaaccaataaatgaccaaaattataagtataatgagaaattgaaattatcttttaaaattaaacataaattctggagcttaaaaaatacaatgaatcaactgaaaaatgcaatagagagcctcaacagcagaattgatcaagcagaagatagaatcaatgaaatcaaagactggttattttgaaatatataaccagaggagaaaagtgtaaaggaatgaagaaagtttacaagatttatgagacagcatcaaaaggacaaattttttaggtataagagttcaaaaagaataagaggaagactaggaaagaaagcttattttaaaaaataatagcagaatattttccaaatctagagaaagatataaatatccaggcacaggaaagtcaaagatctttaatcaattgcaatccaaataagactacaaggcattttatcatcaaactgttaaaaatcaaagattgagagatttccaaaaccagcaaaagaaaagtagcaaatgacatataagggagttataataaggctagcagaagacttctcagcagaaactttataggccaggagacagaaggatgacatattctaagggctaaaagaaaaaaatacccaatcatagataccgtacccagcaaagctgcctttccaaaataaaagatagacagactttcccagacaaataaaggctaaggaactcatcatcaccagacgtgtcttttaagaaatgctaaagggagttctgaaagaaaaagatgctaactagcaacaccaaaacccactaagatataaaaatcactgataaaagggagtcgaattcagaaaaatactgtaatgatagtatgtgaataatttatatctttagtataatgcttacaagacaaaattactaaaagtactaaaaataataatggctataataaaggaaccttaacaataaaagtttttaaagaatatgcaatatacaaagatataaattgtgacatcataaacataacatgtggagggagtagagtgaaggtgttgagttgttttatgtgatcgaagttactacagttttaaaaagcctaaaataactatgtttttatataagcttcactctaaatacaaagtaaaaacctatagtaggtttaatagccaccccccaccttattcacaagggatacagttcaagatccccagtagatgcctgaaaccacacatagtaccaaaccatataatatatataatgttttctcttatacatacatacctatgataaagtttaatttataaattaggcacagtaagagattaacaataactaataataaaatggaacaattataacaatatactataatttattatagtataattatattataatataagaagttatactataataaaatagtattataacaagttataccataataaaattcaaacatgtaaatgttttctttcttcctctttctctctcaaaatatcttattgtaatgtaccatagtaactgaaagttcagaaagcaaaacgatggacaaaaagaaactattgtacacaaaagatcaaaaacgaatcaaagcaaaatactattaaaaaaatcacctaatcagaaatgaagacaagacaggaagaaagaaacaaacaaaactaccagaaaacattaacaaaatcacaatagtaagtccttacctatcaatagttaccttgaatgtaaatgaattacattgtccattcaaaaggcattagagtggctaggtacagtggcttatgtctgtaattccagcactttgggaggccaaagcaggcatatttcttgagcccaggaattcaagaccagcctgggcaacatggcaaaaccccatctctgcaaaaaatacagaaaattagccaggcatgatggtgcatgcctatagtcccaactatgtgagaggaatgaggtgggaggatcaccaacccagcaggtcgaggctgcagtcagccatgattacaccactgcactcccacctgggtgacagagtgagatccagtctcaaaaaataaaaataaaaaaaaaaagacatagagtgactgaatggatttaaaaaaatactcaactaaatgctgcctacaagagacttacttctcctttaaggacacaggctgaaaatgaggggatgaggaaacctactccatgcaaaaggaaaccaaaagagaagaggggtagctataacttagatcaaatgtactttaagtcaaaagctgttaaacagacaaaaaaggtcataaaacatgataaagggattaattaatgaacatataatagttaaaaatatctgtgcaacaaacattgcagcacctaaatatataaagcaaaaattaatagatctcaagggagtgatagacaaatacaataatagcagggtacttcaataacctaccttcagcgattatccagagagaaaattaataaggaaaaactggacatgaacaatactacaaaccaattggacataacagacatatataaaacattccatccaacagcagcaaaacatacattcttcttgagcacatacagaaaattctccaggattggtcatatattaggccacaaacaaatcttaacaaattaaggaagactgaaatcatatcaaatatattttccaaccacaatagtataaaactagaaaccagtaacaggaagaaattcagaaatttcacaaatacatggtaatttaacaacatgctgctaaataaccaattgatcaatggagaaattaaaaggcaaattttaaaatattgtaagacaaataaaaatggaaccacaatataccaaaacttatgggaagcagcaaaataagatgcaagtttatagcaataaatgcttacaggggaaaaaaaagattttaaataacctaacattatgcctgaaggaactagaaaaaaagaacaaactaggcccaaagttagtagaaggagagaaataataaagatcagagcagaaataataaaatagtgactagaaaaacaatagaaaatattaatacaactaagagttgtttgtttgtttgttttgagatggagtctcgctctgtcacccaggctggagtgcagtggcatgatcttggctcactgcaacctccgcctcccgggttcaagcgattcttctgcctcagcctcccaagtagctgggactacaggtgcatgccaccacgcctggctaatttttgtatttttagtggagacagggtttcaccatattgatcagactggtctccaactcctgacctcgtgatctgcccacctcagcctcccaaagtgctgggattacaggcgtaagccactgcgcccagccttagagctgtttttttgaaaagataaaatcaacaaatctttagctagattaagaaaaaagagaaaaaactaaaataaataaaattataaatgaaacaggaggcattacaacttgtaccgcagaaacacaaagatcctaagaaaactaccaagagcagttatatgcaagaaaatcgaataacctggaagaagtggataaattcctagacacacacaacctaccaagactgaatcgtgaagaaataaaaaatctgaacagaccaataatgactaaggagactgaatcagaaataaaagatctctcctcaaagaaaaggccaggatccgacagcttccctgctaaattctaccaaacatttaaagaactaataccaatccttctcaaatgcttccaaaaaattgaagaagagggaatacttccaaactcattttatgagaccagaattaccttgatacaaaagccagacgatgatactacaagaaaagataattatggaccaatatctctgatgaatatagttgaaaaattcctcaacaaaatgctaacaaactgaattcaacagcacattaagagaatcattcaccatgaacaagtagaatttatctcagggatacatggatgattcaacatacacaaatcaataaatgtgttacaccatattaatagaatgaaggacaaaaaccttatgatcatctcaacagatgtagaaaaagcatctgacaaaattttatgcccttttatgatacaaactctccacaaattaagtatagaaggaatgtaccaccacacaataaaggccatgtatgacaaactcacagctaacgttatactcaacagtgaaaagtcgaaagctcttctgctaagatgaggaataagataaagatgccctctctcaccacttctattcaatatgaactggaagtcctagacagatcaattaggcataaagaagaaataaaggctccaagttggaaaggaagaagttagactatccctctttccagacataatcttatatctagaaaaccctaagattcaaccaaaaaactgtcagaactatatacaaattcagtaaagttgcagggtacaaaatcaacatacaaaactcacaagcatttttgtacactaacaatgaactatccaaaaaaaagaaatgaagacaacaattctatttataatagcttttacaaaaaaaaaatacttagaaatatttaaccaaacaggtaaaagactcgtacacataagagctatcccatgttcatggattcaaagaataaatatcattgaaatatccatactatccaaagagattcaatgctgtccctaacaaaatcccaatggtatttttcatagatttagaaaaaatcctaaaattcatatggaagcccagaagaccccaaacagccaaaacaatcttgagcaaaaagaactaagctggaggcctcacactacctgacttcaaaatagacaacaaagctatcgtaataaaaagaaaaaaaagtatggtactggcattaaaaaatggcacatataccaatggaacagaaccgagacgccagaaatggagccacacattacactcaactgatttttgacaaaattgccaagaacaggcaatagggaaaagacagcctcttcaataaatggtgttgagaaactggatatccacatgcagaagaatgcaattagacctttatctcacatcttatacaaacatcaactcaaaatggattaaagggttaaatttaagacctgaaactataaaactattagaagaacacatacaggaaaagctccattacattggcctgggcaataattttttggatatgaacaggcaacaaaataaaaatttgacaaatgggattacatcaaactaaaaagcttgtgcacagccaaggaaacaatcaacacagggaagagacaacctaaaaaatgagaaaatatttgcaaaccacacatctgataagcagttaatattcaaaatatataaagaacacaactcaacagcaagaaaacaaatatttttaaatgggcaaagtcatttcacaaaagaagatggacaaatggccaaaaagtatatggaaaaatgttcaacgtcactgattatcagggaaatgcaaattaaatccatagtgacatcatctcacatctgttagaatagctattatcaaaaagacaaaagataataagtgttggtgagggtgtagagaaaaggaaacccttgcatacttggtgggaatgtaaatcagtagagccattatggaaaacagtacggaagttcctcaagaaactaaaaatccagcaatcccactactagatatatatacataggaaatgaaatcactatgtcaaacagatagctgcacttccatgttcactgcaacattattcacaatagtcaagataaagaacccacttaagtgtccatcaacagataaataaagaaaatgtggtatatatacatatacaacagaatattattcagccttgaaaaagaaggaaatcctgtcatttgcaataacatggatgaacctaggcaacattagggtaagtgaaataaaccaggcacaaaaagaatactaccacacaatctcatttatatttgtaaacccacagaagcagagagtaaaatggtggttattgtggggcagagggttggtttgggagatattgctcaaaggatataaaatttcagttataaaagaataccttcaagagatctactgtacaacataatgactacggttagtaacaatattctttaaaatcgctaagagaatagattaagtattctcaccacagaaaaattaaaaagtatgtgaggtaatatatatgttaattagctccactgagccattccacaaggtatacatatttcaaaacatcatattgtaaataatatagaatgtttttgccagttaaataaataaagtgccttgcagagggtaggtgctcaagaaatgtttattcccttcctttcaaagaaattagggccattgacttcaataaggaggttaccattttagcataaggcctggaataggacaacaacagaccaaaggtagagtgagaaataccaaaagcagtcaaacaggtaggaaagagaattggcactgtatcaaaaaagcttcattatactcgaactaaaagaaacattctcttacagaaaaaactgagtctcaaaataagaatgaaattttttttctaccttaagaaaaaataagacttctaaggtaagtccaaaatgcagagaagagaaaaaatactcttggaataaaatattctgggtcattatacttgaacaagaagaaaaaaaaattccctaaagagttcaacattgatgatttgcttcataaacaatctctgataaagaaccatacaattattatagagaccacctctggccataggttccatccctctgctgtccaagatcataatgtccatgatcaaaggaaagcatcatcatatttcattgagcatttggcaaaaaaaacaaaaaacaccattttctttgagacaccacacccacacacaacttcagtttgaggcatatatcttatacaatgtcactgtcaattgccagagccattaagaggcatagaaggcttatgttctcccttgagtatttgtgctctgggttcacgtttttagaaaaaaaaaaaaattcaaatgaggcattaagaattatgcaccaagtcaaactgcccaccaatgggcagaggtgggggagcatggatgtgaaatcctggctctgttccttataatctatgcggccttatgcaagtctgagcctcaatttcctcttctacaaaatgggaataataacagaatctacctctcagagacattgtgaaaattaaatgagataattaccaaattaaaaaacatttgttcttgaaacgacatgctcaaggaagtaaaaagaatccacagaatgagggaaaaattttgtaaatcatatgtttgataaaggacttatatctagaatatatgaaaaactcttacaactcaataataaaaagacaaataaatgaatttaaaaagggataaagaatctgaagagacatttctcaaaagaagatctacaaatggtcaaaaagcacaggaaaagatgctcaacattattagccatcggggaataaaaatcaaaaccatgatgagataccatttcacacctactaggatgtcaagaatcaaaatgagagccattaacaagtgttggcatggatgtggaaaaactggcaccctcataccctgctggttcaaatgtgaaatggtatagccattggggaaaacaatttgtcattttctcaaagaggatagaattaccacatgacccagcatatattcctactccttggtatatactcaagagaagggaaaacatatgtccatacaaaaacttgtatacaaattttcatagcagcatattcataacagccaaaaagtcaattaaactaataaatggttaaatgaaatgtggtatattcatacagtggaatataatttagtcataaaaggaaatgaaatactaatatgtgctataacaagtattaactttgaaaactttgttaacttaaagaagacagtcacacaaatgggatctaattaagctaaagagcatctacacatcaaaagaaactatcatcagggtgaacaggcaacctaccgtatgggggaaaaattttgcaatctgtccatctggcaaaggtctaatatccagaatctacaagcaacttaaacaaatttacaagaaaaaaaaaaccatcaaaaagtgggtgaaggatatgaacagacacttctcaaaagaagacatttaagtggccaaaaaacatatgataaaaagttcaacatcactgatcattagagaaatgcaaatcaaaaccacaatgagataccatctcacatcagtcagaatggcgattattaaaaagtcaagaaactacacatgctggtgaggctgtggagaaatagtaacatttttacactgttggtgggaatgtaaattagtttaaccattggggaagacagtgcaccaattcctcaaggatttagtaccagaagtaccatttgactcagcaatcccattactgggtatatacccagaggaatataactcacccggcccaacctaaactataaaaacacatgcacccatatgtttactgcaacactatttacaatagaaaagacatggaaccaacccaaatgcccaccaatgacggacatttctttattttcaccaatgaagaaaatgtggtacatatacaccaaggaatactatgcagtcataaaaaggaatgaaatcatgctttgcaaggacatggatgaagctgtaagccatcatcttcagcaaactaacacaggatcagaaaaccaaacactgcatgttctcactcataagtgggagctgaacaacgagaacacatggacacagggagggaaacatcaccaccagggcctgtcggcggggtaggggggcgaaaggagggagagcatcaggacaaatatctaatgcatgcagggcttaaaacctagatgacaggttgatgtagcaaaccaccatggcacaagtatacctaggtaacaaatctgtactttctgcacatgtatccctggaatttaaagtaaaataaaattttaaaaagcgtcacaaacgaccacatgttgtatgattcccatcatatgaaatatccaaaataagcaaaccaatagagacagaaggtagattagtggttgcctaaggctgggatggaaaagttatgaggaaacggccacggagtgagagttttccttttgggctaatgaaaatgttttaaaattgactgtggcaatggctgcacagctctaactataatagaagtcactgaatggtaaattttaaatggtatgtgcattgtataggatgtgaattctatctcaataaagctgtttttaaaggaagattaaataagacaaatacttgtaaagtgtttagcacagtgcctagcaccttggaacggttcaataaatgtagtctgataatgttgctgatattgttgctacttccagaagaaaatacgtttaatctaaaaaatgtttgtcatgcatgtaattgatgagaataacctggtcctttaatctcaaaattatgaaaccattctgaaatgcagaggaagcttttaaaaatctcggcaatggtctaataacctaaactttttttttttttttttttttttctgagacagagtttcactggttgcccaggctggagtgcagtggcacgatcttggctcactgcaacttctacctctggagttcaagcgattctcctgcctcagcctcctgagtagcttggattacaagcgcctgccaccatgccctgctaatttttgtatttttggtagagacagggtttctccatattggccaggcttgtctcgaactcttgacctcaggtgatccgcccgcctcggcctcccaaagtgctgggattacaggcatgagccactgcaccggcctaacctagactcttataaacatttacaacaatcagagataataacaacagtaaatttgtctggtgacacctgtggaatcctcctcaactatttcaggtaaggtttactgcttcttcctctgtaatttgcctgttcagatttctactatatcattatctactctatacatcatttttttccactaaagtgtaagttctatcaggacaagacaatgtctcattcatttttgtatcctataaggacagcatattgcaatgctggtacatagtaggtgcttaattgaatgaacatgtaactgtgaaaattcctggctatcttatcatttctcatctatctgaactcctgtttcagccccctttaagaacaggaagaaagggtttgataactgacgagtttaattacaatcacatcttttcctaacagattaaaacacctcaacaagtaaagttttactagtttcaccacagtcttgaagttccaagcattctcaagaatagaaaaataacccataacagtttatttaaaccctaggaaagcctatgatagccctaggaaaacactaagaactttatataatcagcctgtgatccctgccatcatcactaaagcaaaatgcatgagcagcccctcccagctccccatgttgtttctgcctttcggtgaacattttctcctcttgctaccataagtagtaacattagtatctagtagcaagctttgctgttgcaaacttccaggtgatgccctcctcctggttcccgggccaggaggagggcatcacctggaagtttgttagaaattcggcatcttatttcttactagatccactggcgattcaaatgcacattaaaactttaggcatttttccgtaagagctggctgtgcctggctttagattcaagctggctatacttgggctctagatttgaaggccactacagaccatctgaagtgcatttggcaaatcaactcactcagagattcttatgctgtgtgcattttagaaccacctggggagattttttttaaatcaaaatgcctatgctccaccctagagattgaattggcctaggacccagtttttttgttgttgttgttgttgtgctgctgcttgtttgtttttgagacaaatctctgtcatccaggctggagtgcagtgggatgattatgtctcactgcctcacacttgggctaaagcaatcctcccgcctcagcctcctgagtagctaagactacaggtctgtgccaccaagcccagctaactttttattttgtagagacggggtccccctatgttgcctaggctgatctcaaacacctggcctcaaacaatcctcttggcttagcctcacaacgttttgggacttcagatgtgagccactgtgcctgcccccaatattttttaaagctcccctagctaatactaatggacagctagagttgggaaccactgattaacttctataagcttctatcaaatgggacaattaatagtagctgcctcgttggggtgtgaagaccaaacctgatcacctttgaaaagctcttggtccagtacttgtaacatttaagtgatcaacaaatggtagttattattataatacctggaaacccggaaatgaatgcaacaacagggataaaaagaataggctcagattgtactagtctggtcccatcctacaggtaagtaactgccacagtcaaagaacacattatctccaaggacaagtttgccccttacctgacactttgagtttccttgaagctttctgaaggaaactcagaatgtcaggtaaggggcaaggtgtcagaaaggccagcaccttcatttggaatttattgatggaaggtgggggagcatagtttcaacaaggctgtaacacaggaaatcccccttaccacacctttctgatttacactgattcttgatacacaccacatgtgtcctcgactctcttttcccctccccctgagttttcaatcgttctgttccacatttaggtgatgaaaacttaaaacctgtggttataacttctatgagaaatttcattttgaaagcttgctaaatttcaactttattgccatgagaaaaacaaaagaaacaaaagacctcagtcattcagtgacacaaaaaccccaaatgaagacatttcataaatgtaagttttctgctgcaagttgttgaaaatcctgacttttggacaggggtgccattcatttgcttctacaaatgttctatgaaacaatagcacttatttttctaatagttttaggttacatgtttagtttcacctatggattttaacttggctaagcctagcctatagatccttttgaatctacatctcacaggatttatcctaagtctactcttccaaggagattcgtaatggccaggcaaataagtccatgatctgcttttccaacaattacaaggaaataaactcccagatgagaataacatacctatcaggccactgagagataaccaaagatttacctcaatggtgattacattcattttttaaagtgtgcatggcttagtgactaagtcaccagaaagctcaagttatatttccactcctctgcttattcactatgggcctcctctgcagtaaaggaagcagactcctcctccctctcactgggtgcattgtgatagctaatgaatgtctgcatttcaatggcttttagaatctttttggaagtttcagaagtgattttggcatcccacagagtgctctcaaatagtgctcctattctctggactggtttctaaccacaccttgggtttggggcctactgcaaagggggtctgggattcaagtcctaagtctccaagaatgtcattctacagcctcttcaggagtctgtcaatgaatgacagtttaaaaacatggaagaatccaggagtaaactcacccttgcacacctacaagcacacatggcctctcccagaaaccacagacccactctagtctcccagagaacctgtttcagattggcccaaccacccccaaaacacaagtacctacaccagttcacttcagtggagtggagggattacttttagctgttatagttcatttaagaatgtcatgcttaaatgtataagtaatgagttctaatcccagctcttctacgtaaaagccctgttattttgagcaacttccttgagtctgttttctcagttataaaatggagatgccaacttaaaataagattaccgtactgtgaaaatcagaggagtttttacaatctttaaatattacaaatgtaaagtgtaattatttttctcctgcagacaactggctagggagctattcaaaaatggtgaccttctgccttctttagtctgtttctaactaaaaattatcccaggtatttaaaaatctttatttgttggctgattagtattcaaattcacagagcagcattaatgagatgagtaatattcaaagagaatcaaaaattccttagccaggatttcttacaaatgacacagtgatatactatttgagccaaaaatcaaaacaatgttagtgtcactttctatctgcatccaaaactttacaaagcacttgttttattaaaggatatcatattttgatgcataaggttagttttgctatggccatttttgtgacacttacccaaagaatgtactatagttattaaaaggattaagatggataatggtgtttaaagagatgttacagggaaagaattaatttagatcagagaaatatgatactatagcacaaataacaaacagataacttcttgtttaaaaaaaaaagtaccaatgaaagagaataaacaggtcctctgcatatattctttacccactgaaaaacacaccataattaccaactataaggttatctagacaagcaagttttataacaatgtgattctatctatatactttaaaatgtatatacttctgtatgcatggcaaatgatctgaaaagatacaggtcagactgttgaaagtggttatacctatggagtagaactggggatggaggccaggtgtggtggttcacgcctgtaatcccagcactttgggaagccgaggtgggcggatcatgagctcaagagatcgagaccatcctggccaacatggtgaaaccctgtctccactaaaaatacaaaaattatctgggcgtggtggcgcatgcctgtagtcccacctactccagaggctgaggcaggagaatctcttgaacccgggaggtggaggttgcagtgagctgagactgcatcactgcaccccaactccaacctggcaacagagtgagactccgtctcaaaaaaaaaaaaaaaagtgggaatggaacatgaagggaggctttcacttttttttttttttttttttgacggagtttcactcttgttgcccaggctggagtgcaacagctcactacaacctccacctccgaggttcaagcgattctctcgcctcagcctcccaagtagctgggattacaggtgcccgccatcacgcccagctaatttttgtatttttagtagagacggggtttcaccatgttggcctggctggtctcaaactcctgacctcaggtgatccgcccgcctcagcctcccaaagtgctggaattacaggcatgagccaccgcacttggccggctttcagtttttatttgatgtacatattatttaatgagagtattcatgtgcatgcattacattgataataaaatgaatgaaaagcataaatctgtagaagtatgaagaagttaagcaacaactagaagtgggagagaggttattagcatattagctaccaaataagtgggaaataaccagtcaacaagtacttactgaagagctactacataaaaggcactttactagattgtagaaactacagaaatgttacaatcactactctcacagtgccctataatctaggagtagagccaagtttacatgaacattcacaaaaaaatacctgagaacataaagcagaatacgaaaatggccacaagagtgatttttagacaataagtattttagaaactcaggctcaataagtgtttcataaatgaattaattaaacactttgagctaagatagcaaagaatcatagaaaaggagaaaaaacttgagcagggctttgaaaagtaggcagaattcagaaatgggtagaatgtggcagagggatgataaggtggaatatccagagggttagaaatgaaaagaatgtcagagagggtagaagtagagtaacaagctataccatctgcttgtaaataaacttaggttcctacagggaggcggagagaagaagctggccaaggagtgcagactgaccttagggagccttggaaagctcaaaaacttgagctagcagacaagggatgtcggtgaaggtttcgagctaggcagtgacaggaggaaagtggagcttcagaaaggttaataagacaacaagatggagagaggctgaaaacaggaaacccagctgagacgtgctacagaacaggtgtgaggtgatgagtgcccaaaccagatgaaaacagtcacaagggaaacaacaataattatcatttagccctatttacaagcaaactttcaaatcagactccagctaatataaaggcctttcctctaggggaaaggcctttgaagctgacttggtagaggaatgagaaacactgtgctgctatgttataacaggggtaatgaaaatcaccagctttggagagagactgccctggattcaaccacagctcagccatttactagtacagttacttaacccctgagacattttgcagactgtataacctctttgttccttgatttcttcattttaagtgtctatagctgtgttccctacttgaatttaacaaaatctcagttcaaacagaaagataaggcaaagaagtatgaagaaaaggctttcttgaaatctcacctttatcaattcccttttctcttcacaggacttcactaggcttaaaacttgaaggaagaataagtcagagtatggttcagtgtataaataaaaagtaattataaaattgcccagtaattttttcaaatattctcaaaattgtccaataattttttcaaatattcttatttctcttttttcctgaaatttcccttacatcaataacaccattgatccatttctattattcccttcaatgcatctgcttccaaaatatacctccttcctagagaaactataagtcctttcctacattggatcagttgttgttctactccttcaacatgtcctaaaatgtgacaatcatttctttcaactgttcatgtgtcttcctgcagttatcgttctctgttttacctaacaactattttgtgtcacaacccacaagacctttgaatatgttcatgggactatattcatgggaaggcatatggcacacatttttttaatgctccacaatgcttagtttaggggtttcggagccagacaaatgaatggacgaataaataggacaatgcatgattcaaagattgaatccctctcttacctaagcacaatacacgactgggatctaatcctggttctaccagctatttaatacttcatagcagaggctccatttaagcttgaaggtttaatgattgatatcactgagtctctgtggcacaactcattagctgggtagtcttgggcaaattacttaacctctctgtgccttggtttccccatctgtcaaatggggtaaacagtactttcctcatagggttgatggaaggattaatgtattaatgcatgtatactgcttaaaacagtacctggcacataataagcattcaataacattaagtattattattatggttgtgttattactattattgggctgcagagaaacattcattcttccatagtatttaagagataatgtcccaaatctgggcagtttaccttttcccagctttctaacttcgcattccaaaccaagtgaaaataaggtactggtttaacccctaattccttcaacacaaacatatagatacatgcatgcacccatcttttctaaatatacagcatatacatttcactcttcattatctgctacacaaaaaccaaaacacatatatttaggtttgtaaataacataaatactttgtttgacttaatgtgtctgttccatgcagtatgatggtggttatatctatattggtttttgtatgtgtaacaatagcagtgtatttttattgtaaattcctaaggacaaaaatgacttgcttaagtcagtctgggtacttggactaaattggagtgcatattcagaaaagaattttagaaaaattagagaaagagggaaattaatgggtactgacttagcagaaggtttaatgaaagatggaatttgagcagagctttcaagaacaggtaaaattttcaatttcaggggagagggagatgtgtgttcaacatggaaagtataatatatgtaagtggagaagtagaggaactaagcaaagattggtctaactaaagagaggacactggagactactacaaaatttatgtttaatatataagatcacagcactcttgagagtacagttcatgtttattcctcttggttgccccaatatctagcactaagtctggcttatatacaactgataatcaaaaaacatttattgaattgagcaaaattacactgtctttcaccatatcaaagtgaagaaaactgaatggaactgaactcaactcaattagatcatgaaagccaatggataaaataattcaacaaacttgtacaaggtatgtaaaccttgaacagcactaaccactagtcaagaaatatgtcttcactttgcctaaattaccactgatagacaagttcagggaatgaaacacaaaattctctcattctcatattcattctcactctctttctctctgacacacacacacacacacacacacacacacacatagctcagagtttcaatctactgtcttacagactgagatagctgaaagcatgattaaggaactaagaagtacccaaatcaagattcttaacatctaatccattttgatgaaggattctcagacaagacttctgactacaggagtccagatcacatgaccagcagactaagcaaaaccagaaaactttttgaaagaaactgcttttcttccatgaggtccccatcccatcagtagggattgcgagaccaggagagataatttaaatgaatttggcagatgaaataataatttggtattggcaacagtagtacagttgcattgtacaaaaaaaattgatgaattacctttttccccaaggtggtaaattatacaaatgtgggtcagcattaaaaggtttatttactggcttttctgattcgctgaaattaattaagccacctccacaagtaatggaccagtatttcttggtctctaccacttctagcagtaggcacgtggccacaatgactacactgtgactagacatggtgactaaatctttgtaagatacaaattcagatttactgggatatagtgaactgcagctcacactcagggcctgcgtacaaaatttcaaaggtattacagaaatgcatccattttgatttcaaaaggcagaataaaataaacataaataaaacttcataaataaacatacataaaatttcaggtgattactgacactttttaatacaatattaaattatatcaaatccttctaaagttattggcagacaaattgtgaaatgccaaggatgaagttagaatgaggtcttttcttgggcctaaaattctctacaaactgcttttagctgctgctgctgaagtaacaagaagtcaatagtaagtaatttgacaatcacacctgggccccattaatcttcccagcttcagtgtcaaacagaggcctgaaactagatgcctactcaatgagtaaataaatgattataaaatactagcctacatttactctacaaaagaaggaagaataacataaaataacaagcaaattttaagaccttttactttataaaacttgcaatgtaaggatctaattaataattcaattttaggatctgtcttttaagcatgctttgtaactcaaaccttgacaaatgcagttattataacacagtttagttagagggaggggatgaatgtgtctagtgatttggaaagggaagatgggagagagcaagtgtcatggaaggcccctgttgaaatgtgtccttcccttctccaatgaagtaaaataaaatagcctcttttttcctctatggccaattccattttactatgcctaaatttcaagattcccataatctgatctggatttacccaaccaacattttctctcacacatgtactttctttttcttcttcttcttcaattacatattttgaagttaagaaaaatagattagaatgtattaaaactcaatttaaacataattctagcaatatgaactttgcttgggataatttctaatgtactttattttatacatttttctttaattataaacatttctatttaacaaaaatgtgtaaataggcttctataaaagagattttgacatggttttaccacatgaagataattctaacatactttctatgtagccagggtggtctccttcctgcccaaatatatacgaggatttgcctcatgctctctctcttgagttgcatatcctctcttcttgtctctctctctctaaggtctacctacctatctaactcccacctaagtctcaccagcattcaactctacttttcttgttataccctggcaaactattatattccacttagcacttcattctaaattgtctttctgttattcttcagttttgtcagtgttaatgttgtctcaccaactacactattggttcattgacagcagatgcagtatcttttgaagaatacaagtcaggtatcttgtagagtatccttcagtttgggtttgactaatgttttctcatgtttactgagagttacagatttggggaaagaatattacatggtgaagtgcccttctcattatatcatatcagagaataatacatgatatcaatatgacttatctgctgatgttaaccttagtcattgataaaatgatatctgtcaatttcttcagtgaaaagttactattttcccctttggagactctcttctttaaatccaagtcacactcaagggaagaagaattaagctccacctcccagaggtggagaatttgtggacatatattaaaaccaccacaataattagttaataaatattatgagggagatgctttaaggctatgcaaatatcctcttttaaagttccacccgctaagtccaacacttgattaaggtatctcgcctaaagcaattattactgttgtgttctaatggtgatttgggatagcatcttttatttattttatattctgccattctttgtctagcatgaaactaaacagagagtagataatcagtacatacttattaaatgtaacagaatttcaaaaccattatgtgaaataaaatgagataatagaaagtggataagttcaaggcaaatatgtattttggcagttgtgctgttcttacaccataagtcttgattgatagaatgggattaaaaagaaaaagaattaattacttcatctgtggaaaagcttcctagagaaaagagaataataatagttatacagtgtcttagagtttacaaagtatacacacattcatcatttagaattcagaagctctctgaagagaaaaatcttcaggagataaagataaaagatatttgaaagttgtgaaaaggcactgttacaccaggaattgaaaaatcaggaatagaaattacattagactaacaaagaaaagcaaaagtaaaggcaaggtagaaacagatacaattttttaaaatgtagttctagtgcaaggctttaaactgggtaataaagttaatttaacacatagcataaaataaagacaacttagacaaccacagataaagagcacatggttaaaatcatgaagaatgccattaaaaaataagcatcaagaatggactgcatgggaatatgtgttgaaagtgtaaaatgaatggaatcttcatgtataccttcagtcatttctccactggtcacctccattttcccagggcctttcacagtgcttttaacctagcatacacccaagaaaatttgctgaagatctaccatgtgtcataaaggctagacattgtggatatacaataattagatacggtgtcttcctataaagaatttgcattctagatggaaaggtaaaatatatatatatatgtatatatataaagttgaatgtctatatatatatataaagttgaatgtgtatatatgtgtgtgtgtgtgtgtgtgtgtgtatatacatatatatatatatacataaaattaaatggcaaaacaaggcagaaggagccaaaagaaaagcataaagagtaaaagctacagcagtctaaagaaagaagagatcactgtggaatgacctgttcaagaacagttttgtgcaaataaggaacatttgcaatgggccttcaaaaactaggtgagatggaataagctctgacttaagccaagagaaatacattcaatgcatattcatatagtaactgaacaaaggtacggggttgagataataaaggtgctttaagaagacagtgaacaatcaagtaagttgggctgtaataaaaggtatatggaaacacagggtagtgaaagtaagctgagactgaaatgtgaaaggttttgaatgtcaggttgaggagtttgaacatattatgtaagcaatccaaaaataaccatagttttttagcaaaagagcaacatgatgaatatgacattttagaaatattaagctggcttttgatgtacatttaaaaaatggtgtacatcttcattaaagatgcagttatggtcttaaaaaaacatgcatacaaataaatcacattgaatacaatacaaagaggggaagactggaaaaaaataaacttaagaacagaagaataacccaagatttccttgttgagagcaggtaaagcataacattacatagaacaaaaaggaagttaggcaacagtaagattccttgggtataaagaacaactctatttttacttcttccatcatcactatttgtgtatataattcaaggtgcctaagcatagagtagaatagttaactgcattaaaggagtaaccagtgaagctcccaaagtgatacataaacagtggttttacaaagttagagaaaatacagttgcattaatgtgctcagaaagtatctggaaaacagaagacacatgagttgttaattgcattattaattcatgggaaaacaaggggaacaacaaaatcacatcggggccaggcacagtggctcatgtctgtaatcccagcactttggggaggctgaactgggcagatcagttgaggtcaggagttcaagaccagcctggccaacatggtgaaatcccatctctactaaaaatacaaaaattagcgaggcatggtgacgcacacctgtaatcccagctactgaagaggctgaggcacgaaaatcactctacctgggaggtagagattgcagtaaatcaagataatgccactgccctctagcctgggcaaaagaggagactccatatcgaaaaaaaaaaaaaaacttatcagggtagcaatataaacggattaaccagaaaagtggaagctttttgctcaatgctacaactatccattcattttaacattagtacataacaaaagccacctttggttctcaactctgttccttaaagataattctccttacattctctcaatcctctcaggtaattccataaatctaccttctgccttctgtaaaagcttcagtctcattaaatcttactcactccttaatcccactttaaaacattaaatatatattagaaatttgctgaagttgcctttaatgaatgtaagaatccttacctttcttatagtgttgtgcagtcaaaaaaataacttacaaacattacctcttagaaccttcagagaagcaaggtacagcaggtaatcatcatcatccacatgctataaacagtaagccctgggccacacattcataagtcatagggccaggcatgcagtgcaaccttcctaagtccaaattccattttctcttcactgtatcattcagtttcataatgtgccagtaggtatatcttattactcaaaatgtatgttgttattctgtactacgtctaagtaaatacattttttaataagatgcctttatgcccaagtgcttactacaggaccatttcctaagaaggcttaattactttaagatgctcatgatgataacagttatcactagatgaaaagggacaacagaagcataatgttttcaaaattgctgagactataccaagaacattttgccttgaattctgcaatgcaacatgcaacaacaaagacagtatgggtaatttaaggatatgtgagcttcaaagggcagaaataggacattctcattctctttaactctgctaaagcctcaaatactgatatagttcagagcatcttattactaggaaaacataaatcaaaaggagttcggctaggagcaataaaacagattagtgtctggaaggactgactttaaagaaagttttaaaagaattagatccaggtagtctagataaaaaacagctatgaggaaacatttttttttaagctaacactcacaccaaaggcagaaattattttgaagatagatgtctaaaaaatgcaaacaggaataattgtaaatccttataaagggaaaattcaggagaaatttcccagcaaaagcttatgggacagaagaactctctcccctatgagtggtgaaaaactacattcctagagatatttaatgccaggttggacaaaacaagaaaaggattccatatggaatgatcctatactggcccctaacgtgatagaggactgaaggtaacctcttagatcttttccgtttatgttttttttttaattttatatagttttacagggcactgccttctgccaatttcttttctccccatgatgcccactttctcctttcacaaagggaaacaaattgtagccttcattttaaacagatctcattgttctcagtgtaacataatcctaggtacaaagttgggagaaacagaccaatttctaaacttataatggtcctttcctccctccctcacccccagcaattcctggggctcttacaagttttcccacaaactaaagaggaagtagttcaaatggattggaagaagaaaaaccattaatatcagaaaaaccattaatattctcccttcttatgtctgatcacagagctgacagtgaccctgggagctataaggttctgggtcaaattaccataggaggtgctgttaaagactatcttttacctttcagcatttatgctgagtgacagcaaaagtctacttgcaatccatactttcatagcaatgacttttatctttgaaaagatatagccttaaacacctacatgctttggcaaatgttataaaagagtaagtcctagtcatgctccaaactcaagaagccttagccttgccctctttctctattctggcacttaaaaaaaaatgttcctctgccacccttgaaatacattccaatacctctccagaagtacttttcaatgaaggcccaagaaaatacaagggcatttgctcctttagctgatttgtaaggacaagatataacaaaattcagaaggctctgaaaatctgtccctgagccctttacatataaaactagtttacttataagaaggaacagcaacggggatgatagccctccaagaatggacactaatgcctcttctatccaatcttaacagtgtcaatagctcaagaaacgccaataccctccatcgtgcctctttgaaagtacatccctccacttaaacaggaagttcatagatgttaacacctaaccttctaaacaaaaaattttcaatagcattttcattttttatccctagtaaaaatgagaccgttcaaaccaaaaaagattggcctctcagattgaaataagatttcaagttttcaaagcccttccaacacttatctaatcccgtcaggaaagaaagctggcatttgtaatcccattttaaaacagaaaaaaaaaaatgcaactctgagattaggcaatctgaagaagaactaactgtggagatttccaaaccttcctcaacaagggaccaatttaaaagggattattccagaaaactttagagtgggtttcaaaaacggctgaattccttctgtaccctaatcacaggaaggcaagaaataagaaaaacagaaaggcactttgcctagaattttagcaatgaaatatgactctgacctttaataatctatgaacctggctgaattttctcaaaaaacctgctgcatctacaccccgcaggaacagcctgttaagcagtttgggctaccagctctcagcctccaagacagccgcccagcaaaaggccggcagctgggtgagaacaacctggagaaccccctttgcgcaatgaggtcaggagttccacactgcagtgtctcctcatctgaagcttccaacttttcattttcaggcgaggtgcaaccaggctctccaaatctgccccaacgcgcgcgcgcgcatacacacacacacacacacacacacacacacacacacacacacgaacacacagacacacgaacacacagatacacaaacacagcgggtgcttgcttccgctccccaaataaagaatggtaatcaagtttctcaccatcctcatagtttttgagatagtaatccgggcccgggcccccgcggcttttcgccgggttcctcaggttctggaactgcaggaagtcggtccttttgcccccgaagcgcagaaaggcgggcgaaagtccccgggccagggtcaccaagcgcttggagctgcagaggaagagaataagagaggaaaggttcccaggacaggacgagagcgcgtggggcacggagaagggccctcttcctactccctgagggcgacctggccggggctagaggctctgtgcctgccccagccggcagtccacgctggcccttggccgctgccctgcgccccagcccgccctcaccgcccggctctgggggctgtgcctcccgcttccagacgcccgcagcggccccctcccgcagacacccagatcctgatctcctaaaggctacagatagtgtttgttcatagagtgtttgtatggggtgggtgtacgtgctacgagcacggcgctaaagcgcagttgcccggcttctgccactgccaggaaagcgctccgggcggagacgcgctaggcgcgcctacctctggcttccgaccgttgccaaaaacttgtatgctgaaagccggcattgcctccgcagccccaggggccccacaaacctccgtgcaggaggtgaaacctgccttgtttctctcagaccaggcccggcgcctgagcttaagtggattcctactttctttcttttaatgtccgagttgattttcctttttcactatattgtaaaaactgcattgtttcccaaatccccggacggagagatccccagggtaaaccctcgcctttccaagaacacttctccactcccgcaccaccaccaccaccaccacacacacacacagtaaaggcaaagtctctttggcccctgaaataattccgcctgatctcaggaaaggtaacatcctcctccccaccccacccccgagttaggctccatctttcttctttcccacttggggccgtttggaaccgctagggaaaatgaagcttgccgaaatgtggaacctgcgcgttatgggatactaaatgagcacaaaacaatagcatttgcatctatttaaggtcaggatttccatcaataggttttttaaaagccaaaggctgctgctttgggaaggagtagaaaaggagcaatgcagatactgataatgcagaggggatcagctgttgagttccgggtctgtaaattattttttaacgctttactgtttcagattctgaaaacccaaatccacatggtgacgttaaagagcatcataaaggaggtggatacgagaaagaaaaaacagactctgcttttggagagttttttgagaagagacgtggctaccccagggtcttgtaaccagaatggtcgtttggcagaagtctccgggaccgcactccaggacaggcacagtcagggcgtcgcgtgggcctactgtggcaaaggagacgtccgcgcgaatccggtcctggggaaagggcagttccaacaacctttcatccagaagcctgcacagccaatgcgaatgcgccccgccaggacttcttccccgaaaatctgccttccagactcttttctgaggcaggaaagcattaggcgaacaggcagattttttaaaaaaagaaagaaagctggtgggggaaagggggtctgcgcagctgaaggagttcaatgaaagtgggacaagcgttgcggaaaactccgttgcaccctacattcggacgagctcatagacgcgctctgctgcacgaaagagctttcgaagaggaagctgggccgcgcggagctggctgttccgccctcgcggcaaccgcaccaacaggaaccgaaacggcctcggcaagggcagctacagcctctcagtcctccggctacctttcctccacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgagcccaattagattacaagccctagagcaaaggggatcacaaacctccgggtttgctaatctgctggtgcggagttcagatctccgaagcctccctggagtatttctaggactcttaccgcttcccttataacgctgtgaccccagcgaggattttttttttcctttaaagaaaagctaaactgtgcagttaccgcaggagatttaaggaggaggaactggcggggggaggggggcattccgtctataaaaagcgccttacaaagtcctgaagtctggaaatgacagcggaggatataaaataaaaaattttaactccgatccaacttgcccaccactcaagcctctgcttaaattcgttttctgagagtgggagagaactgacgaaacgatctttccgtggaaaattccagtttcgtgcaatcccgcttgaacactcacacacacacactctcctgtctcacatacacacacacacacacacacacacacatacccattcctttcagctctttgttgtttgagaccttttcttcgcttttgtaactgctctgaacctcttgtttctttttcagaagtagacgggaaggctaattgtggatatatgtaagcacaacattttttcagtcataactgataagtttctgaaatgccttctgcattgcaaacatgtgcatcttaatagaaaacattgcttttctcaatcactagttacagcctcacagcacacaatccaggagaaggaaaacctcttttcttctctttgagagatctgcttggcttattttcttctttcccctttggaatgggggataggaagggcttgagggggtgttactaaaaaattttaaatgatccatcgaaacccctgccttaccttaggaaatcgagccagccatcatgaatgatggacggatccagctgcagagagaggaagttctcattgactgtcctgactgggttcttggtgctcacatcaagtagaatcagggtcttttccttcaaacctgcagctctgtctacaggcaagggtctcctgtctccagcctgggaggaaagggagagatggagcaacagagccaagtagagagcccccggggctaggcacgcgggggggcgggagttgctggagggcatggcttcagggaaggcacaaagcaccctcattcaatccctctgatttaaacctctcttcctactgggtctcgctagtgactaattgtccttatctaaagtgtgtgtctgtccgcctttttcccccctttttttcccttcctcccaccacccccccaacacacacacactctctctctctcccgctctctctctctctcgctcgctcgctcgctcgttttgtttttttcttttttttttttaattttttttaattttttttttcagtgttttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggtacagagcaaagggtctcgtttttacgtccttccctgagaggctctggagggcggttcaagctccgactccgacccgaaagccccagcgccaacccgggacgcgctgggatagagttcccaccgacagcacgcttgtttctcctgacagcgtcaggcacttcgtccgctcagggcccttttctggttgaagcagcaataccaagggcggttaagttgcagaggggtcttgaggcggtgattcctgtcaaagcatagagccctgaaggacattccccgaagaggagccctgatctctgtgacgcgttggatagccacaccgaagcatcctctgacctccatagggcaaagagtagcaagaaggaaaaacatagtgacctggtcaagcagcttttccgatccgagggccaaaagggacatgcgccctcgctctgctctgctcttcccgcaaccgaggaataagcgtcttgggagcgtcaatacatgctggctttggccaagtcgaagctacctgagctgtgcttggatagtcagggcggctctgcgtccaactgtgccacttcttggccactctattctgctgcacaggtagagtcccccctccagaccctcctggaggtcaatcctatacttagccctcctgcagggaagtgcgcctttacagtgccagatgggaccatagtgacactttcgggtttccatctcggcccccagtcaaaaccagagtcacatagccctggatggggaataacagccggaagccgctgtgatgcacgacccgccgctgctcattgagcttccaccccacaacagcttgcaaattgaactctaggtcctatcctgaagcgcgggaaagggatcaggcacagtttgctgcagtcacattgctgggccccactttcggcttctttctgagacaaaatgggacttctacttggcagatgaagggaactactttatgtagtgcgggcagtcagaaacgcagaagcgtccagggccctccttggtatcaaacaagcaaaaccctaaaatgcagagcaagggttttccccagaagtggatggacaagggttagtcttaaagcccagcaaacgctgtaatagcaacctgtatcctcttacctccacccagaccaggattaacaaatctgaaaacagctggaatagatgaccttcaactgaagttccctgaaaagcctctaccaacctaagcacccaggaaatcgagattatgttgcattcatctgtgaagcgccatgacgaccttctagaaataggactgcataagatgaggatatgggagaaagcaaatgcaagtcatattatttaaagatgatttttttaaatcaagctgttacatagtgaagtattggatgttggctccagccctaaggcctgtttccttcagttcctgaacatttctaagacatctagatcctttaaactgtgtgtgtgtgtctgtgtatgggtgtgtggtgtgacataaatttcagtcgaaattcttgtaatttttaagtatgtattgagcacctcttagagatggcaacagcctggcgggcaaacacttttgcctttgtgttcccagactggagcacttagtaggcactcaataaattctgtgaagtaaattaatggtaaatccaatcatgctcaacacactgaaataatatgcccctctccagaacaatgtgaaaaataaatacttttatttgtcatagtaaattatgttttgggtctctgttcaataatttgttttcccagttattaacattttcctggccatctccttcaaaaaatacttaacgtgtaaagccattagttcatttgctatactaagaatttttaaaattatatatttttaacaatgagccagattttccaagggcctaaaatacccttggcttacaagtgaatgcacttttagaagccatgttaattgggaccaatggaagacaatttgaatacgtatatccactagatgtctataattaatacctttcaaaaatacctattcttgtgaccaagaatgaacttgagtataatgagaatgcacataattatgaattttcaccatttttgcttactgacctaactactctataatggtttattggcctaactaagtagtatttaatgttttcatcagaatctgtatgtggtattaaaatcaaaaccaacaaaacaaagtgcttgttttcttaattcctgatgaaaaccatttctctagtctagccattgaaattctaagtcattctatagaggacatcaggggaaagaaataactgatatttaagaggttagccctcgttggtctctaagatgatttgattgtttggtgctttggtttagtttgggtttagatctccagagatactctgcaaatagctgccacacatataccatatcatggtttttgtcttgcctcttatctattaatatgctgtaagtagttcattagtaatcagtatattagattgatgtttctatcctatcttctgtgtgctaggtgacagcaatctgcatctctgttttgtcttagattgtaacttcctagaagacaagtattgggcctctgtataaaatatgaactgtcaggccaggcacagtggctcacatctgtaatcccagcactttgggagccaaggcaggcggatcacctgaggtaaggagttcgagaccaacctggcaacatggtgaaaccccgtctctactaaaaatataaaaattagctgggcatggtggtgggcacttgtaatcccagctactcaggaagctgagacagaagaattgcttgaacctgggaggaggaggttgcagtgagccaagatggagccattgcactccagcctgggtgacaagagcaagactctgtctcaaaaaaataaaaagtaaaattaaaattaaaaaataaaatatgaactctcaggaactagatgcactgatgtctccttggaaacgctctgcttagtgtctactgaatggtcttcatagataaattgctttgatatctaagagcccaggttcccagaactgtaagaaaacgtgaagattaactgattcagtgatttctagactttgttttttcaaaataaatattagttaatggggaggagtggacataatgtttgtcaaggtttttttttttttttttttttttttttttgagacagagtctcgctctgtcgcccaggttggagtgcagtggcacgatctcggctcactgcaacctccacctccggggttcaagcaattctcctgcctcagcctcccaagtagctgggactacaggcgcacatcgccacgcgcagctaattttttgtattttagtagagacggggcttcaccgtgttgcctaggctggtctcaaactcttgagctcaggcaatccacccacctcagtctcccaaagtgatggaattacaggcatgagccaccacgcccagccccgtttgtcaactttttatattatctagtaaggaccttaataaaaactgtcaactacttatctctattactttccaaaagaaaggaaaattttaacatctgaacaaaagctaaaatgacatgtcaaaataaagagcagttgtttaaactgagtaaatttagctttatgaaaaatcccggccaggtgcagtggctcacgcctgtaattccagcactttgagaggtcgaggtgggtggatcacctgaggtcaggagttcgagaccagcctgaccaacatagtgaaacccagtctctactaaaaatacaaaacttagctgggcatggtggtgggtgcctgtaatcccaactactcagaaggctgaggcaggaaaatcacttgaactcaggaggtggaggttacagtgagccgagatcatgccattgcactccagtctgggcgacaagagcaaaactccatctcaaaaaaagaaaagaaaaggaaaaaaagaaaagaaaaatccctatattattatcatttcatctcagacaagtggaaatatataccagtaaccaacatgggtactaggactggtgaatgggactactgggatattattctgtgtttatgtccaaattctactttgtagcatatagtattgcaagatgtacagctaatggtcatcttgagtacaatgattttcttttttttttttttttttcgagacagagtctcactctgtcacccaggctggagtgcagtggtgcgatctcagctcactgcaagctctgcctcccaggttcacgccattctcctgcctcagcctcccaagtagctgggactacaggcacctgccaccatgcccggctaatttttttgtattttttagtggagacagggtttcaccgtgttagccaggatggtcttgacctcctgacctcgcgatctgcccgcctcggcttccaaaagtgctgagattacaggcgtgagccaccacgcccagcctacaatgatttcttttgacttttcctatgcctttttctcactttcagcctgtcacaaactcattaattctatatgccgcctgccctttccttctactaaacattcaaagcttagttttcactattcccattttccccttctgtaagaattatgcctagctgtctaatagaaattttaaaaaatgctttacactgtaactaggactgggaagcatgaagatataacagccagtccactgtgtcctcacttactgcctgtatacccaactatgatgactaatatttattgagatctcatggttcaagcatggtgctctcaaaaaaaccctaagaagagttttgtataaacttcttcttatacctagtttacatatgaaaaaattgagacttagatattaactttctcatggtacacagattaataagtaccaacacagaattaaaccaagggccatctgactctaaagcctaggtttgtgttcttagtcaacacaagtggctaaagtattgtataaccctccagaacctatcaatgtatagtgggaaaacaaaaacaacaacaaaaaaaaccttagagcaggagttggaggctctaggtttaagtcctgactttaccagatctagtcttgtaaacttggataaaatttttaatggttctaagcctcagctgccttatctgtcaaactgatataatatccaagagtaaagcaataattagtaagtttatgtacggggaaagtactttataaattctaaaatatacaatcaatcaggcacagtggctcatgctaatcccagcactttggaaggctaagacgggaggattgctcgagcccaggagtttgagaccaacctgagcaacacagtgagactctgtctctacaaaatgtttaaaacattatccgggtatggtggcacatgcctgtagtccaacctactcaggagattgaggtgggaagaatcactaaagcccgggagttcaaggctacagtgagctatgagatcatgccactgcactctagcctgggtaacagaacgagaccttatctcaaaaaaataaaaaaaattatacaattgtgctatcgctttcttattcattcttatttcctgtctcccacacgtgccacaaatacatccccttaactaatgactatggtaagaattaagttatacatgaatgacttagtggtaaacctgaaacaaaaggtgaactctatctaatataatatggtgttaataaacgtggtcaaacaagtctataccacatattttaatcatgtaggctcttctgcctgtgattagcatcttttaaggaagaaattagagtaggttttatatgtctttgattttctactaggaaagggaaaacaggaataggcaaaggacagtacaagagaaccctggttacaaagtatgttattttgccatcaaggactgtctctgtcctgccaggagaagcaagggatgacaacactttctccatatggaatgctgaaggagaaaataattggcagctctactgactacactttggggatgtttgttattgaaaatacctgagaatttttatgtgtaatatccctgggaaaaaaatcagattgcctttcatgtgttcaatggcttcataatttataactgtgattgctccacctcatcatattaagaaaactctggtctttgtccttactactgccatcaagcagtacatttatttggggaagatcataaccataataaatgtgattgactctaataagttcagtttgaaaccccttagcatgtttggaggtagggatgacagttacttgagggactgctagagatagaaaactaacagaaaagcagattaaaattactcatgtcttagttacacccagtgaagaacctatcttttaccatccctgccaattttgccatttatacattcaggtaagtcctgaaaagcatcatattatattgaaaaaagtgtggactttggagtctgatagactgattaaaatctaattcccaatttaatatctgctaatgtgacctttgttgaacaagttatttatccttgctgagtcccaatttccccatctataaaacaggcataagattacttccctccaaatgtgttgtgagaattaaatgagataatatctttagtacctggcatatagttgctactcattgtccttctcctggttgggtttcactgtggaaatgagtgtaatttgcacagatgggttacaaggaaattatatacctacaacctaaggttttgaaatataatttacatatatactatttaattttatgctcatagcataaaaaagcacagactttatcttcataatttgggtaaaaaattagagttaagtccgggcacagtggctcacgcctataatcccagcactttaggaggctgaggcaggcggatcacgaggtcagggaattgagaccatcctggctaactccatgaaaccctgtctctactaaaaataaaaaaaattagctgggtgtggtggcacatgcctatagtcccagctactcgggaggctgaggcaggagaattgcttgaacccaggaggcggaggttgcagtgagctgagattgcaccactgcactccagcctcagtgacagagcaagactctgtctcaaaaaaaaaaaaaattatagagttaaaattttcaagttgtttcttgaagaatttgaaactaatgccagctctactgactacacttcgagtatgtttcttattgaaaataccaagaacttttaatatcctaggggtaaaaaatcagattgcctttcacatgttctatagcttcattaactatgtatgtatgtataagttgtttttatatgtactgttttcttacacagttattacatattaatcaatcttaaagataatttctgagaaagcaatgtatataaatcatgtatatttatctcaatacatttaaaatattaatctccctgtaatcccagcattttgggaggttgaggcaggcagatcacctgaggctgggagtttgagaccagcctggccaacaaggcaaaaccccatctctactaaaagtacaaaacttagctgggcatggtggcaagcacctgtaatcccagctactcaggaggctgacgcaggagaattgcttgaacctgggaggtggaggttgcagtgagtagagattgccccactgcactccagcttgggcaacagagagagactcagtctcgaaaataaaataaaatattaatctcaaacattgagattaatggacctgtaataaaacatttgcctgtaatacaattgtgtttgtcaactccaaaaaactgactagctacgactgtattttctctttttctgagacagagtctcgctctgtcacccaggcgggactgcagtggtgctatctcggctcattttcctgcctcagcctccagagtagctgggactacaagcgcccgccaccgtgcccggctaattttttgtatttttagtagagagagggtttcaccatgttagccaggatggtctcaatctcctgacctcgtgatccgcccacctcagcctcccaaagtactgggattacaagcgtgagccaccacgcccggcctacaacggtattttcttttgttctctaggctaatggcatactttgacctttttatttttatttcttttattattattattattattattattattattattattatttgagacacggtctcactctgtcacccaggctggagcgcaatggtgtgatcatggctcactgcagtctctacttcctaaactcaagcaaccctctcacttcagcagccttgtgtagctgagaccacaggtgtgaactatgcctggatttttttttttttttttttttttgtagaggcagggtctcaccatgttgcccaggctggtctcaaactcttgggctagagcaatcctcccaccttagcctcccaaatgctgtgactacaggcatgagactttgacctttttaaatactctaatatgtttagttcattataaggagagttaagcaaatgtttataacagaaggcttaccactgattcattccactactcaataatcaaaatcagctgacagactttagtagtacatacttactcaatagaatattttacttctgcttgaattaacatctagacccctaattctttggagtagttttgtccccacataagcagatccaagaacttccttaattcaatactagttatattaaaccttatcagccctgtcaccaaattttctaatacttctagtccttttcattatctagagatattgacatgctgatgactcttgggaagtatatttaattttgatcagacacttaaattttaaattcttcttttgattttctgaagcctggaccacacaataaaatagtatttcctgtgctgaaatacttaaaaatagtcttttcccctttcaagtagaaatgaaaataacgtgcaagcctaggtcagggattctcacccctggctgcacattaaaatcatctgaggagctttttaataatttatttggagtagggcctgagaatattccagatccctcactacacaattctatttggtttctaatttcagagagcaaatttagatgacaaaggataccacattatttaatctatttgattcctaggtttcaggtaatgaggagaaataggtcagattctaagggatatctcaaaaaaattattggaatctattctacacctaatttagaaagtgaaagttcagatagagagggaccatcccctaagggggaaaattatgcaagtaaataccatacatcctactagctttaacagattctcaaactgatcattctttcattcaataaatattttcactttataccatctgattaggaaatttgaaatactgaataacgctaattgtgaatgtagaaaaatgggaaacttcttgcatgctgatggaagtataaagtaattgggccactctggagactgatctggcaatacttagtgaaattaaatatgtatattccctaagagccagtaatcccactgctgggcataaactccagtagtaaaatttgcaaaaaggccattaaaacatttgaatgaagatggtcagtaaagcgctgagtttaatagtga

SEQ ID NO: 1262 - DNA, 26799 bp, Homo sapiens
tttctgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttttgagacagagtctcactctgtcgcccaggcaggagtgcagtggttcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtcttgatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaaaaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgctttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatattggccaggctggtcttgaactcctgacctcaggtgatccgcctgcctcggccccccaaagtgttgggattacaggcgtgagccaccacacgcagcctttttgttattagactctgtcattactgacttttttttttttttaatagaaacagggtctttctttcccaggctaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttaatttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggccataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtatccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccccaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttgggggtggggggtgtcaaagcttggggcccggaagcggagtcaaaagcatcaccctcggtcccttgttctcgcgtggatgtcagggcccccacccaccgagcagaaggcggactcaggggcgctccagggtggctcgagctcacacacgctgagtagacacgtgcccgctgcaccctgggtaaatacagacccggagccgagcggattctaatttagacgcccgcgaacgctgcgcgcacgcacacgtgtcctcggctcgctggcactttcgtcccgccccctccgtcgcgtgcgggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggggctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgcctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagagccctggcaaccgggtccctcagctgttcccgcggttccttccatgagcccagccttgcgtcccggctccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccggaggcctgggcaggacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggtgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggatgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtggcccgaggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagggtgcatttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagacgaaaaaggcgccactggtggctcaggaagctcccagacagagtgcatgcctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgctttgcagcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaatgtgagtgggggcagcaccggatggaggggacacggtcctcggaagaatgactcgcagcggtgggagcattcaagggcacctctcccaatcccattctcggggacagggaattccagcctaaaccagggggtaatgaaaattctagccaggcgcagtggctcaggtctgtaatcccaacactttggaaggttgaggcggatgaatcacttgaggccaggagttcgagaccagcccggccaacatggcgaaaacccgtctctacaaaaattagccggtcgtggtggtgggcgcctgtggtcccagctacttgggaggctgaggcaggagaatcgcttgagcctgggaggcagaggttgcagggagccgagatcccgccactgcactccagcctgggcaacagagtgagactctttcttagaaaaacagaaaaagaaaattatagggaataggagcacggccctcctcaaatcctggattagaacactgacctgggcttcacctccttccattcggtgaagaagggcgaggaattttagccgcaacagcagcctgattgtcggggaaggaggctctgataggaggcaggatcctcttctgcccatcagaggcgcggtggtctcccatcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtaagtggcagctggggagaggcggggcgaggtatctgagagggggcgtgacctgggtcttggggcggccggccccgcctgcctccctctcggtcccggtagactagacggaagtgggacagagtagaagtcaaaggtgccttagcgggtggggctgttgatcgcactttgaggggtgggagatggaggtggcagggggactgaattcaaggggagggaccctccggggctgtcactgctgcaggaaaggactttaaaacttgggctggattctgcgtggtggaaacttgacccaattcacaatccactgtggggaagattggggagggaccaaagtcattggatgttggagggagagaggggtcaagatcgccttctctcacttcctgaagctcctggggctgggttctctctggggtcgggggaacctgacctggtcctgccggtcctcattttttgggggatggggagagttgacttgtcgccagggggctaagtgtggtcacgggtttatatccccatgggctgaagtgcgatataaatcgggactcgggtcgccctggcactgggagtggccttattgcatgggttgtctcccttctcccaaggccagacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacggagcgggcggcggcgctggcggggcggcaggcgcggagggcggacccgaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaaggaactccctgtctccgcttctgtttctgcaaggtggaacaagcccagggttccagtcgtgacctcccgagttattcattcaaaaagcgatttttgagagggcctggggtggtggcttaggcctgtaatcccaggacttgtgggaggcccaggtgggaggatcccttgcacccaagagtttcagaccagcctgggcaacatagggagaccctacaaaaaatatttttcaaaaattagccaaggccggtcgcggtggctcatgcgtgtaatcccaggactttggaaggccgaggcggccagatcacgaggtcgaggtcatgagatcgagaccatcctggccaatatggtgaaaccctgtctctactaaaaatacaaaaattagctgggcatggtggtgcgcgcctgtagtcccagctattcgggaggctgaggcaggagaatcgctttaaccccggaggcagaggttgcagtgagccgagatcgtgccactgaactccagcctggcgacagagcgagattccgtcttaaaaaaaaaaccaggcgtggtggctcacgcctgtaatcccagcactttgggaggccgaggcgggcggatcacgaggtcgggagatcgagaccatcctcgctaacacggtgaaaccccgtctctactaaaaatacaaaaaaaaaaaaaaaaaaaaaattagccgagcgtggtggcgggcgcctgtagtcccagctactcaggaggctgaggcaggagaatggcatgaacccggggagcagagcttgcagtgagccgagatcgcgccactgcactccaccctggcagacagcaagactccgtctcaaaaaaaaaaaaaaaaattagccagggccgagcacagtactctcgcttgaatcccagaactttgggaaactaaggcggggggggggggtcacttgaggtcaggagttcgagaccaccctggccaacgtggtgaaacaccttctctaccaaaaatacaaaaaaattaaggccgggtgaagtggctcacgtctgtaatcccagcactttgcgaggctgaggcgggcggatcatggggttagaagatcaagactgtcctggctaacatggtgaaaccccgtcactactaaaaacacaaaaattagccgggcgtggtggcacatgcctgtagtcccagctactcaagaggctgaggcaggagaatcgctttaaccccggaggcagaggttgcagtgagccaagatcgcaccactgcactccagcctgggcaatagagcgagactctgtctcaaaaaaaaaccaaaaacaaaaacaaaaaaatacaaaaatttagctgggctgtagtggcacacgccctgtaatcccagctactcgtgaggctgaggcaggagaattgctagaacccgggaggtagagatcttgccattgcactccagcctgggcaacagaactagactctgtctcaaaaaaaaaaaaaaaaaaaaaaaagtgttttttgagggggctgggcatggtggctcaagcctgtaatcccaggacttttgggaggcccaggtgggaggatcccttgtgcccacgagtttcagaccagcctgggcaacatagcgagaccctacaaaaaaacatgtttcaaaaaaaaatttttttttttgagatggagtctcgctctgtcgcccaggctggacagcagtggcactatctctgctcactgcaagctccgtctcccgggttcatgccattctcctgcctcagcctcccaagtagctgggattacaggcgcctgccaccacacccagctaatttttttttgtatttttagtagagatgggatttcaccgtgttcgccaggatggtctctattcctgacctcgagatccacccgcctcagcctcccaaagtgctgggattacaggcgtgagccaccgcgcccggcctcaaaaaaaaaattttttttttgagatggagtcttgctctgtcacccaggctggagtgctgtggtgtgatcttggctcactgcaacctctgcctcctgggttcaagcaattcccctgccttggcttcccaaatagctgggactataggcatgcaccaccacacccagctaatttttgtatttttagtagagacagggtttcaccatgttggccaggctggtctcgaactcctgacctaaggtgatccacctgcctcggtctcccaaagtgctgggattacagctgtaagccaccatgcctggtgtatttttcaaaaattagccagacatggtggtgcatgcctgtagtcccagctacttgggaggctgaggcaggaggatcctttgagcctaggaggtcaaagccacttccagctatgatatcgtcattgtgctccagcccaggtgacagaaccagaccctgtctctaaaaacaaacaacgaaaaaatccaaaaactttttttgaacacctactatgcatcaggcacaatctaagctgtctttttctttttcttttttttttttttttgagacggagtctctctgtcgcccaggctggagtgcagtggtgtaatctcagctcactgcaagctctgcctcccacgttcaagcgattttcctgcctcagcctcctgagtagctgggattacaggcgcgcgccaccactacgcccggctaatttttgtatttttagtagagacagggtttcaccatgttggtcaggctagtctggaactactgacctcgtgattcacctgcctcggtctcccaacgtgctggaattacaagcctgagccactgtgcctggcccggctggctgtcttttctcagtgtgacctagagctcgtcctctctcagtgcctgttttctgctctcttcacacccttgggcaggggtgggggcctcactccttcctcctacttatctcttccacccagcactgccctctgatccgggtcactcttggaggtgggggctaggtgcttcccccaggcctggttaccggcagagctgaggccgccttgccagggtgggtggaggccctctccgttgtgcccctgccctgagacttcggtgagaccttcctgggcaggcactggctgatgctatgggtgtcagcccttagcatgtcctccctgttaaagggggcacccctgccccgccctcaatgcctcctttgtcctgtgtccacccacagtgcttcagtttacccccaccctgcctttccactcagcccatcatgattcagaacagacacacacagggtatccgctgcaacccccactacacggcaccttcccccctcatccccaacagcataaggcacagcagctgggcctcctccccacagcctcctcctctgcccctcctccctcaaaagcaggaacacggagccctagagaaggaagccagtcccatgcaaacatgtaatgagcaaagatgagacggggaaatggcacaagagggcaggccagtgctcggtgctggagccaggggccaggtataacacccaaaaaggcaccagccaggtgcagtccctgccactaacagcacctcaccttttctgcctgtgccctccctacttaatgatctctctccgctcctactgacctcaaggtctctttcagagccttcagatgagatatttattttagtaggttggtgcaaaagtaattgctgtttttgccattgaaagtaatggcaggcagggcatggtggctcacgcctgtaatcccagcactttgggaggccgaggtgggcagatcacgaggtcaggagttcaagaccagcctggctaacatggtgaaaccctgtctctactaacaatacaaaaaaaattagccggacatggtggcacacccctgtagtctcagctacttgggaggctgaggcaggagaactgcttgaaccctgaagcggaggctgcagtgagctgaaatcacgccactgcactccagcctgggccacagagtgagactgtctcagaggaaaaaaaaaaaaaaaaagtaatggcaaaaactgcaattactttttctttttctttctgtttttttttttgtttgtttgtttgtttgtttgtttgtttgagacggagtctcactgtgtggcccaggctggagtgcagtggcgcaatcttggcttactgcagcctccgcctcccaggttcaagtgattctctcctgcctcagcctcccaataggattacaggcacccaccactatgcctggctaatttttgtatctttagcagagatggggtttcaccatgtttgccaggctggtctcgaactcctgatccacccacctcagcttcccaaagtgctgggattacaggcaggcatgagccatggtgcccgacatttttttttttttttctttttttttttgagacagagtctcactttgtcacccaggctggagtgcaaaggcaagatctcactgcagcctctgcctcctgggttaaagcgattctcccaccttagccccctgagtaggtgagattacaggcacatgccaccacacctgcctaatttttgtatttttaatagagagggggtttcaccattttgtccacgctggtctcgaactcctgacctcaagggattcgcccacctcagcctcccaaagtgctgggattacaggcatgagccaccacgcccgacctccttaactcttttatttccttgcacactttttctctgtagcccagctcacaacttaacatcctcttagacatacacctgaggttttttttttttttttttttgagagggagtctctctctgtcacccaggatggaatgcagtggtgtgctctcagctcactgcaaccttgcaaccactgcctcccaggttcaagcaattctcctgcctcagcctcccgagtagctgggactacagacacatgccgccacacctggctgattttttgttttttagtagagacagggtttcaccgtgttgcccaggctggtctcaaactcctgagttcaggcagtccgcctgccttagccttccaaaatgctgggattacaggcatgaggcaccgcgtcctgcctctgagttttttttttttttttttttttactgtctcctagaacatcagccccagtagagcagggatctttgttctgttcaccactgagggtcctcattgggtcctagcacacacagttgctcaataaatgttgaataagtgggtaaagacagccacgagcttgcagatatgtgttcaaggtgtgtccttgcagagagcttctctatacttggcactggagaggcctgtcgtgggcaaggacatagatgtggcgacctcagacttgagaactcctggggcagtaggggagatggatgtggataatgtaaccataagccttcctttctattttagactgagtggtcaaggaaggcttccagacaatggaaattctgataggttctaagagggagaccagcaaggagctgaaccggaggctgacacagggtgagagtgggaatgtctattttattttttttttggagacagggtctcactctgttgctcaggcagcagtgcagtggcacgatcgtggctcactgcagcttcaacttcccagactcaagtgatcctcccacctcagcctcccaagcagctgggaatataggtgcatgccaccacatccggctaatttttgtatttttggtagaaacggggtttcaccatgttgcccaggctggtcttgaactcctgggttcaagtgatcttgctgccttgggctcccaaagtgcttggattacaggtgtgagcctgtgagccacatctggcctattttattttttaattagttttttgtttttgtttttgttttgagatggagtctctgtctccaaggctggagtgcagtggcacgatctcggctcactgtaacctccacctcccaagtagctgggattacaggcacatgccaccacgcctggctaatttttgtatctttagtagagacagggtttccccatgttggccaggctggtctcgaactcctgacctccggtgatccacctgcctcagtttcccaaagtgctgggattataggaatgagccactctgcctggctgggcatgtgtcttgtttttttcattctgtagataacaagcaattgtcctccctcagcctcccaagtagctggtactacaggcgcctgccactacgcccggctattttttgtagttttagcagaggtggggtttcaccatgttaaccagtctctaactcctgacctcaggtgatcctcctgccttggcctcccaaagtgctggaattacaggtgtgagccaccaagcccagcctcaaactcctgagtttaagtgatcctcacacctcagcctccctgagtgctgggattacaggtgtgagccaccacacccggcctgagtcgggggaggtgtctattttagtctgagtggtcaaggaaggcttctctgaagagctgatgttggggccaggcctcctcaagcgattagaaggtgtcagccatggggagatgtggagggagggtgtttcaggccaaggaagggtaagatcaaataattcagggatctgagggcagaggaatctggactccagttctcccattcagggctgcccaggagagacaaagaggatctcataagggtgtgtggctttgtggctcactcacgcccacagcaaggaccatgcccaccctacttttttttttttccccaagtctccctctattacccaggctggagtacagtggtacgatcacggttcactgcagtcttgacctccagggctcaagtgatcctcccacctcagtgtcctgagtagctggcactacaggcatgcaccaccacccctggctcattttttgattttttggtagagacggggtctcactgtgttacccaggctggtctcaaactcctgggctcaagcgatcctcccacctctgccttctgaagtgttgggattacaggtgtgagccaccatgcccagcccgccaccagtcttgactctccatcctccctccctccctgtgagtgctggtggcctgtgtgtcccgcctgctgaaagatgcctctgacttggggcttttgacttcaggcccgggagacacattttggctggattagggagatcttaaaagggggtaggggacacagcaggggctaaggagagtgacacactgcaggcaggggttgggtgacagatgaaggatccactggtatatgctgccagtgtgtgccatctacttgtgtgttttacgtgtgtctggtgcatgtgtcctgtgtgggctgtatctgtgtgtgactcagctacgtgtcagcatatccctgtcgacgtgtgtctctgctgatgtgtctgtcagcacgcacggctgtcttgcatgtgtcttttttgagatagagtctcgctctgtcacccaggctggagtgcagtggcacgatcttggctcattgcaacctcaacctcccaggttcaagcgattctcctgcctgagcctcccaagtagctcggattacaggcacatgctaccacgcctggctaatttttgcatatttagtagagacggggtttcatcatgttggccaggctggtctcgatctcctgacctcaggtgatccacctgcatcagcctcccaaagtgctgggattacagaaatgagccactgtgcctggctagacatgtgtctttttttttcccttctgtatataacagggtctcactatgttgcccaggctggtctcaaactcgtggcctcaagcaatcctcctgcctcagcctcccaaagtgttgggattacaggcgtgagccactgcacccggcttgtgtgtgtctttctgtatctgttgtgtgtgtctgtgggtagtggctgtttccctgcatgggacattgtggtaaatgtggctaattccctgtgtgggggctgctgcctgtggataagactgtgtctctgtgcatgcgcacgtgtgtgcacgcccctcacaaccccaacgagaaaacacctgtccaccttcctgggctggcacaggggcacaggaggcgggatcccaaatcacaggctttttctctcggcatatctctgtactttattgtccctgctgtaacaatgctcatccttcctgagagcgtctcctgagggggcctcggccaaggctgactggagaaggggctggtgacccctagcaggctctgccacctgaggcctgggtcttcccccgggatccttgaatctggagatggcagagaggaggcaggccggctctttccccaatcctcctaggagagctgcttctgcccattctcccactggtgaaacggaggcagaagcagcagctcagcagggtgaagctgggtttaaccttcctgaatggggtccagggacactccacatctgccacatagcctcttgggctggacatttttcctgggcaccagccagcagctggagcagcgagtgccgtatttcttgtacctagggttgggggacaagaaactgccatttaggatgcagtgggggcccggaaaccgccacaaggaaaccacttttcccaagaggtaggtgttttgctttttgctttccccacaggccatcctggttacacgtggactgatttggggacccccgccccaactccctcctccattctaaggacctgatcccacaggcgttgcagagaggggtcccatcttcagcgtctctccagagcggggtcctctgggtccgacaggaagcacagcgccggggctctgaagggtcagaggtcaaagggcaggggtcagaggccaagcatgtgagctcgggatgcctgtgcggagtcgggcattttgtgggggtctcagtaaaggccccacctagctctggatcagccctgggagttgccagctctaagccacagcaaagccaggaagggagacagatggcagcattccgcagaggaggaagctgggggtgggggtgactcagcccaagtggaggggggtgctgcgactcctccctgagggctctaaatggggaagcaagatggagaaggggggggcagggagaaaggcagggaagacaggaaattggcccccaaaatatttatagctcttgggttttcaggactcacccagggcctcgctgcctgctgagtgggcctcggtgcctcctgggtgggctgcagggcccccaacagcatctgcaggggattcctgagaacggctactgcagggcaggctgtggggcagacaaggtattagcactgggggggatctgtagcttgtccccaacagccctccgaaatgaagatttagtatcaaggtatcagccatcccccgaggaggcaactaatatctgaatggcctggctttgcctctcattagtaatattattattattattattattatttttgcagatggagtctcgctctgttgcccaggctggagtgtagtggtgtcatctcagctcactacaacctccacctcccgggttcaagcaattcttgagcctcagcctcccaagcagctgggactacaggcgcgcgacaccacgcccagctaatttttgtatttttagtacagacggggtttcaccatgttggccaggctggtctcgaactcctgacctcaagtgatccacccacctcggcctcccaaagtgcagggattacaggcatgagctaccgtgcccgacctaattattattattattatttgaaaaatagtaagcacagggacagcctgccaggttccaatcccagttctccatgtccttgctgtgtgagcctggacacattatctcctactctgtgcctcagtttcctcatctgtaaaatgggcttcccaatacaacagtttttttttctttgaaaatttgatttattgatttttaaaaagagatgggagtctgggcaatatagggagaccccgtctctacaaacaaaaaaaatagccaggagtggtggtacaggcctgcactcccagctagttgggaggctgaggagggaggatggcttgggcctgggaggtccaggctgcagtgagccatgattgcgccact

SEQ ID NO: 1263 - DNA, 47327 bp, Homo sapiens
tcccgccagactgcctgctggaaaactagctctgggaggtgggggtgtcaccatccagtatgtgagggtggaaccttctgggctgaccatttatgggacaggcccctagaatgggaggcccaggacagccggagagccacagagcccagcagctggaccagggtgaccatgatgccactggggctgggacacctgcacgagactcttcaggaataagcccctatttccccacctaaaaatggaagtggggccgggcacagtggctcacgcctgtaatcccagcactttgggaggccgaggcgggtggatcacttgaggtcaggagttcgagaccagcctgaccaacatggtgaaaccccgtgtctacaaaaatacaaaaattagccaggcatcatggtggggggcctgtaatcccagctactcaggaagctgagggaggagaatcacttgaactgggaaacagaggttgcagtgagcagagattgtgcccctgccctccagcctgggccacagagcgagactctgtctccaaaagtaaaaaaagagacaaataaacagagaaacaaggagagacagaggcagtgagagacagagacacagagagatacacagggagacacagagacaggtgaaacagagacagagagagatgagacagaaacacacagagagacagacacagagaaacagggaaagagagaaagggagacacagggagacagagacagagagacagaagtgagacagagagatgagacaaagagacagagagagagacagggagagagatgagaaatgagataaagagaaagatgacacaaatattttgggaggctgaggggggaggattgctggaggccaggaattagagaccagcctgggcaacataatgagacccttatctctacaaaaagaaaaagaaaaaaaaagatggcaaagaaagagacaaggagagagacagagagacaaaacacaaagatagagagagaggggcacagggagaaagagacaaagaggggcaagacaagccaggtgcgatggctcactcctgtaatccaagcactttgggaggccgaggagggcggattacctgaggccagagagttcaagatcagcctgaccaacatggtgaaaccccgtctctactaaaaatacaaaaattagcatagtagggtggcgcacgcctgtgatctcagctacttgggaggttgaggcaggagaatctcttgaacctgggaggtggaggttgcagtgagccaagatcacgccattgcactccagcctgggcaatagagtgagactctgtctcaaaaaattaaaaaaaaaaaaattaaaaaaaaaaataaaagcaagtcagagaaatagagacagagagacaggaagagatgagaaatgagagatagggagagacagggagggaggaaggaaataggaagctgggggtggggccaggacacagtggctcatgcttgtaatcccagcactttgggaggctgagatgggaggactgcttgaggccaggaatctgagaccagcctgagcagcagagtgagtgctctttctacaaaaaatacaaaaattagctgggcttggtggcacacacctgcggtctcagctacttggaaggctgaggtgggaggattgtttgagcccaggaggctgcagtgagctatgatcacaccactgcactccagcctctgggtgacagacagagacagtgtctcaaaataaaacaaaatgaaaattagccaggcatggtggcgggcacttgtaatcccagccactcggaaggctgaggcaggagaatcgcttgaacctgggaggtgaagattgcagtgagccgagatcgcaccagcctgggaaaggagagcaaaactccgtctcagaataataataaaataaaataaagatcactcctgtttagttggttaagaagaaaaaaaaaagaggttaggggtacaagaccagccactgggagaagagggccctcctacccggccagaggagccccctgcctggagctcctgatcccagcacataaggtttaatattattaaaggtgatgatatcttggagggttgggcacctcgttcacctagctccttctcacctctcataggcctccccggggggttaactaccccattgcaccgatggggaaactgaggctcggagaagccctggctgcacaggcagttggaagcagagccaggactcggctggatccttgagacgtttgtcgactgactgtgtgacccttggcccctccagtctccaacccggaggagaaacccgcccctcttcccgtcccccacccccagcccgcccggcgggtgttttttttttcctcctcctgggtattttggtttcggcaggaaccgccccggggagcaggcggttcccgctggcagggtcagcccagggcggggacgggagccaggagcagctccaggccagggaaggtggggaggactcggggaggaagcctggccgtggccccgaccactgggaccaggcaggtcgcgtccccatcccaatcttccggtgcctcagtttccccacctggaaagcggggctctgcgtgatcgcggcacagcccgtggaggcgcgtcgcgcatggggccgggcggggtttccacgtctccgccaaggttctgtccactcagttattaaacattgatggatcggggacagagccagaggccagtgccccaaaccggggcgggaggtggggaggggaggaggggggagggacaggccagaggtgggggctgggggcggggaggatggggagaggtgcccgcaagaggggtttatcaagatcaggaggattctcaggtagcacacccaaagcacaagccagcaaaggaaaatagatcaacccgactccacacaatgcaagacttttcttctgcaaggccactattaagagaggcctggcacagtggctcacacctgtaatcccagcactttgggaggttgaggcaggaggatcgcttgagtccaggagttcaggatcagtctggacaacatagtgagatgagaccttgtctatacaaaaaatatttaaaaattagccaggtgtggtggtgtgtgcttgtatagtcccagctactggggaggctgaggtgggaggatcgcttgaacccaggagttcgaggctgcagtgagctatgattgcgttgctgcactccagcctgggcaaaagagggagactctatctcaaaaaaaaaaaaaaaaatgacaacccacagaatgggagaatatatgtgcaaattttgtatctgataagggtcaaaaagataaataatccagtcagacatggtggctcacgcctgtaatcccagcactttggaaggctgaagcgggcagatcactcaaggtcaggagttcaagaccagcctggccaacatggtgaaacattgtttctactaaaaatacaaaaattatccgggcatggtggctaacgcctgtaatcccagctacttgggaggctgaggcaggagaatcgcttgaatctgggagacagagattgtggtgagccaagataacgccactgtactccagccttggcatcagaacatcaaaaagaagaagaaggaggaggaggagaaggagaaggataagaagaaaaaggaggccaggcgcagtggctcacgtctgtaatctcaacactttgggaggctgaggtgggagggttacttgagctcaggagttccagaacagcctggccaacatggtgaaactctgtctctagtaaacatacaaaaattagccgggcatggtggcaagagcctgtaatcccagctacttgggaagctgaagcacgaggatgatcgcttgaacccgggaggcagaggttgcagtgatccgagatcacgccactgcactgcagcctgggtgacagagtgagatcctgtctcaaaaaaaaaaaaaaaaaaaagaaaagaaaaaggaaaatagcaagtgttgatgaggatgtggagaaatttgaacccccatgccttgctggagggaatgtgaaatggtacagctgacgtggaaaactttggcagatcttccagaagttaaacacagaattaccatatgactctgtgattccactcctagatgtatacggagaaaactgaaaacaggtgtttacgccaaaacttgtacacaaactctcagagctgcgctatccacaatagccagaaaatggaaaccaccgaaatgtccattgatggctgagtggataaataaatagtgacacatccacacaatggaatgctattcagccatcaaaaagaacgaaaccctgacacacactataatgaggatgcgtttcaaaaacatctgagtttctttcacaaaagaacagacagaaaggccacatattgtatgatttcattgatatgaaatgcccagaacaggcaaatccatagagacaggaagcagattagtggctgccaggggctgggggaggggaacggggagtggctactgatggcacaggttttctttttggggagatgaaaatgttctagaattaggtatgagtgatggctgcacaaccttgtgattgtacaaaaaccactgaattgtacttttttttttttttttttttgagacagggtctcactctgtcactcaggctggagtgcagtggtgcaattacggttcactgcagcctcaacctcttgggctcaagtgatcctcctgcctcggcttctcaaaatgctgggattgcaggcatgagccaccacgctcagtgtcaactgtacactttaagagggtgaattgtatggtgtgtgaatgtatcttaaaaaaggaggaatggccgggcgcagtgactcacgcctgtaatcccatcactttgggaggccaaggtgggcagatcgcctgaggtcaggagtttgagaccagcctggccaacatggtgaaactccgtccctagcaaaaatacaaaaattagccatgcatgcttggtggtaggtgcctgcagtcccagctactccagaggctgaggcagaagaattgcttgaacccaggaggtggggttgcagtgagccgagatcacgccactgcactccagcctcctgggcgacagagtgagattccatctaaaaaaaaaaaaaaaaagaggaataaggctggggctcagtggctcgtgcctataatctcaacagtttgggaggctgagacaggaggattgcttgagcccaggagttcaagattggtctggacaacatagcaagactctgtttctactttaaattttttttttaaatgaaagaaatgagttaaaaaagagagagagagaaatgggcagagggcagagttggaagaagggccttcctgggcagagggcctggcatctggggcacagataataaagtatcaggggccaggccaggggctaccctgagtccaggggtcatctcctgcagctcatggttcccagaaacctgacacctcagtcccatcccggctgaagggcagaggcagagacaacatctgtttctgaccaaacccagaggctactggagagatagagaaggaaggtacctgggaaggtaaactgaggcagcctatctctctgatggagacacgcttcccacccagtaggtgggagccatggagaagggaaaagatggatcaggaaagacagagacagaggaggggaggtgggaagaggggcaggggctctggagaggctgcctgaccacatccattttatggaccagaaaactgaggcccacaagatgaatcacttactcccagctgaactgcagccagaataaactctgaacctctcacccgtcaggacctgactctccagctccaggaccccacaacccaagaataaaaccctagcccgccaggcgcggtggctcacgcctataatcccagcactttgggaggacggggcaggcggatcacgaggtcaggagatcgagaccatcctggccaacatggtgaaacaccgtctctactaaaaacagaaaaagattagccgggcatggtggcgggcgcctgtagtcctagctactcgggaggctgaggcaggagaatggcgtgaacccggaaggcagagcttgcagtgagcctagatcgcgccactgcactccagcctgggcaacagagcgagactccatctcaaaaaaaaaaaaaacctagcccacgggtacagtggctcacgcctgtaatcccagcacattgagaggccaagacaggaggatcacttgagcctaggagtttgagatcagcccaggcaatatggtgagactctgtctctacaaataatcaaataaactaagctgagcgtggtggcacgtgcctgtggttctagctgcacaggaggctgaggaaggaggaacagttgagcccgagaggtcgaggctgcagtgcgctgtggtcacgccactgcactccagcctgggcgacagaacgagaccccatctcaaaagaaaaaaaacagctctggtccatatgcccccagcctcacgtgggctacaacctcttcccccatcccccgtccattccccaccagcaacctcagggcctttgcactccctcttctggcccctctttaccaccttggtcctagcattgcctcctccaggaagccctccctcactggctactcctcacatccccactcatcactcttacggtttctcataactctctgagtgataattagattagtgtctgccttccccacccagctaagagccccttatgaccaggaagatcctgacttgtgcaagatggggcctggtatacagtaggcactcaatgctggctttttttttttttttttttgagacagggtctcaccttgtcacccaggctggagtgcagtggcgcgatctcagctcactgcaaccttgacctccccaggttcaggtgattctcccacctcagccctcagcctcccaagtagctgagactacaggcatgtgccaccaaacctggctaatttttgtatttttagtagagacggggtttcaccatgttggccaggctggcctcgaactcctgagctcaagcgatcggcccgccttggcctcccaaagtgctgggattacaggtgtgagccaccgcgccggaccctgatttcttaaatgaatgaatgaaactgagctgtgaaatgggggctaacaccatcctgactcctggagctgctgggagaagctgaggcaatggctgctctgaggagccctggagtaatagttgcatagcagttgctcaataaataccaggccagggcccagctaagcaaacttgctgggcccattgagaaaaggactccaaatcccttcctattttatagacgggtaagcagaggcccagaaagaacctcctgttggtcattttctagggacagaagaaggactcaaagtggcttcatcaaacagggaactgaggccgggtgcagtggctcatgcctgtaatcccagcactttgggaggccaagtcaggtggatcatttgagctcagcagttcgagaccagcctgggcaacatggcaaaaccttggcaacaaggcttgagcctgaggctgaggctggaggatcactcgatcctaggaagtggaggttgcagtgagccaagatggtgctactgcactccagcctgggcaacagagtgagaccctgtctcaaaaaagaaacaaaaaataaaaaaaaatatttatttatttatttatttatttatttattttttgagacggagtctcgctctgtcgcccaggctggagtgtagtggcacaatctcggctcactgcaaccacccccttccaggttcaagcgattctcccgcctcagcctaccaagtagctgggattataggcgcttgccaccacgcccagctaatttttgtatttttagtagagacggggtttcaccatgttggccgggcttgtctcaaactcctgacctcaggtgatcagcccgcctctgcctcccaaagtgctgggattacaggcgtgagccaccatgcccggcctaaaatattttttaaaaacaggaaccagatggaaaatattgggtttcaggtatggctggatccaggaactaatgcttcatctcggtgctgctgtcctccctgcaggctcctctctcagacaggcatccccacggtaggaaggaaagaggctccaagctccaggcttccctctgtccagctcagtctcccgctagtggaagcagggtgtgcatcttccccatgcactctggcaaaagtcccagctgctgccagtaaacattgcctgtctcctacttctcgcacccaagggactgtgcataggggtgggtttgcagccaactccaggggcctccagggctcacacctgcaatcccagcagtttgggaggccgaggcgggtggatcacttgaggtctggagttcaagacgagcctggccaacatggtgaaaccctgtttctactaaaaatacaaacacattttagctggtcagggtggcgggcgcctgtaatcccagctacttgggaggctgaggcaggagaatcgcttgaacccgggaggttgccgtgagccaagatcgcgccattgcactccagcaacaagagccaaactccgtctcagaaaaaagaaaggaggataaacgctcaagggagggcatgcctggtggagggaacggcttgagcagaagctgggatgtggcagatccggagcggggcggggggcatttgcagaactctgaccagccaccgtgtggctggggcaccgagatccaggcctctgtttccctatctagatgcatcgatggggaaagggaggcccccagaccaaaggggcggggcctgggcctcttgcctcctggccctattggctgccaggggtctctccccgagaggtctcatcctttttttgccacaaaattcagtagttctgggctttttaactcccctcctctgtctgaaaccggaaaagtctgtttagcaaacgcggtgggaggaggcagggcgggcccggccggggaaacgcgcgccgctgttgccacctggtggccatggggagaatctggactacccgctaatcgccagggctggggtgggatttcaggagcccccccccacacctcggctcagaccgcagtggggatcagggggaggcggctgcagaacgcgagggaggtggggcagtgtgggcagaaagagggaggattcagggtgtgtaaggggggcaagggtcctgctgcgagttggtgggcgtgaggaggaaggagcgtgggggcaaaccacggttcctgttaccggagtgcccggctgctccactccccctaggccgtcccttcccctgctcagtcctaacttagtagggttccaagctctcatccggctctgtctcccccggattaggtgctcctggaggagacctagaggaagagattaataaatatatgtggaatgaatgaatgaatgaatgaatgaattccaaggctcgtgttttgagattttgagcaggacattcaagcttcaaacaggaaaaaaatacccaagaggaggctcatttacgatgattttgaacagctgtgtaaggtcattatcaccacccccattttataggggggtgagggtggggtggggggtgggatgggaggaccgtcatttttcccacaaagtttacagcccccttccctatatgcctggatcctccaagctacaagaccccgcaatgctgcagggagcccttgagtccagactccccatccagtgctcctgggggtggatgcccagcccagggtccagggatccatctgagccccccttgcccccattcccagtccattctacgccagaacaggtaaatggcagggtctgctcctgccccacggatgccaggcccagcagggtgcagcagcttccatttcatggcagcatctagggttcccccgcaggatgggtggcaacaggcacggggcagagaggaggcaggtgcactggagcctggaggagctctgggttatttgggtccaaatgtgactcctgtgtgtgctacgtagcctcgggcgagtcactcaccctctctgagcctcaacgatcacatctgtaaagtacaacagtcatggttcctttcagggggtggttgtagggatttggtagggaatcatgtgagtggatggaatgggctgggtatgccataagtgcttaataaccagccgttgtgattgagatagtcgctcttcgtgtctgtaagacaaagtggatgttttcgtttctccctcaggcctccaggccctgatatcccaggagcgatggatgtctagcccccccaccccccgggcagggttgcacccctgaccgtctggcccactgggccccaggaccttggccttgcacctgtctccatcctccaaggacaactctgtatccagggccagctcaggggcaccctcaggtagctctgtcttctcgagaggctcagtcctctcgcctttgtcccaggacatctctaccaccagggcctcctgcagggatgcctcttcctggaagtccactgggttgatccactgccaagtctgcagagggagggtagggccacagctgtgagcagagctctacttcccatccacagcaggatggaacggaccaggtcactgctggttaaattctctaacatcctgagacctggacgggtgcagtggctcacacctgtcatcccagcactttgggaggctgaggcgggtggatcacttgaggtcagcagtttgagaccagcctggagaacatggccaaaccccatctctactaaaaatacaaaaattagctgagcttggttgcgcacgcctgtaatcccagctacttgggaggctgaagcaggagaatcgtttgaacccgggaatcagaggttgcagtgagccgagatggcgccactgcactccaggctgggtgacagagcgagactccatatatcctgagaccgatttgaggatggagtctgccgcactgactcccattcagcccctcttaggaagagcactcccatctgtctttgggaaatttccctccctcttttcacagatggtgtggttgacagtgcagtgaccccacctcagctctagcaatggtcatgtgaccctggccagcccacccatcagacccttccctacccctctggttctagccataggctcagggaagggcatgtgacccaagctggaccaatcagtgatggccctgagacttttgccccagttaatggggaaaatggacaccctgcttccaatcagagaaggctcagcctgcctgcggaagaaccctgaacgggcagctccgagatagaccccaatcgctggattcaggcatatctgaagcccattcccttgggattttttccatcaggtttcctttataataaagccactttgaattctgtttctagtgccaggaaatggacctctgcctgcctgtctttaaaatgggaaggggtatggagcactggttttggagtccttaccttgatgaattgggagagaataaaatgagctaatgcgtaacccttgtccagcatgtgcacccaataaaaagacttggaattagaaaaggcatccttacctccttccctccagggaactcaatggcggagctggcacagggtgtgggcagcggcgggcacaggtgccgtgcggccctggggaggaaaggggaccagtgagaggagctgaggttttttttttttttggagacggagtcttgctctgttgcccaggctggagtgcagtggcgcgatctcggctcactgcaacctctgcctcctgggttcaatcgattctcctgactcagcctcctgagtagctgagattacaaacgtgtgccaccacacccggctaatttttgtagttttggtagagagaggtttcgccatgttggccaggctggtgtccaactcctggcctaaagcgatctgcctgcctcagcctcccaaagtgctgggattacaggagtgagccaccgtgcccggcttgaaagcagctttcaatcagacatgcccaccagtgtcaccgcccctttccatgggaatgaccaaggacccaaaagttactatcccttccctagaaatttctgcataggatcacctgaggtcaggagttcaagaccagcctggccaacatggtgaaaccctatctctactgaaaatacaaaataaatagctgggtgtgatggcacgcacctgtagtcccagctacttgggaggctgagacaggagaatggcttgaacccgggagggggaggttgcaataagccaagatcgtgccactgcactctagcctgggtaacagagtaagactccatctcaaaaaagaaaaaaaaaagaaagaaattttgcataaactgccccccttaatctgcatgcaattaaaagtaagtataaatctgactgcaaaaccgctctcagcggctactctccgcctacagggaagccctgctctgcagaggcagtcacggagctataactgctgcttcaataaagctgttttcttctacctctggcttgcccttgaattatttcctgggcaaagccaaggacccaatctgcgggctaagctccactttagggctcccctgcccagcatcattaccatcgctatggtaacggtaagaggtgtcagttacctgttcaggccaaggtagccaaggacgcccacgagaaggatgctcaggaagctccccagggaggcgaagaagatgagccaatcagaaacctgcacttctgaggtgggagagcgtgggttggcagagggctacctcctgcctcttcctcagggaaggagctaggagggcctggtttctccatgaacttgctgctgatcctggtgcacatgccacgggcttctcactgggagaccacagaacccacctgcccggtagctgtcaagaaataaaggcctggcatgcaggaagtgttcaagactctgtaattccaggccgggcacagtgactcatgactgttatcccagcactttgggaggccaacgtgggctgatcacctgaggtcaggagttcgagaccagcctgaccaatatgatgaaacctgtctctactaaaaacacaaaaattagctgggcgtggtggtgtgcgccggtaatcccagctacttgggagggtgagacagaagaatcgcttgaactcgggaggcggaggttgcagtgagccgagatcgcatcattgcattccagcctcggcaataagagggaaaatctgtctcaaaaagataaaaaaagactctgtaattccaggagcctgcacatagggcacatgtggctgcccctggacccaggcctgcctgccccccaccaaccctgactcttttgttctctgggttccagttggttctcttggaactgaaaggacaccgtggcatgaacagggatcatttgatctctgaatctcttataaccatgcacccgacaacagagcctgtgttgttctcttcctcctcctcctcctcctcctccctcttcttctattcctcttcctcttcttcttctttcttctccttcttcttcttctatttttttttttttttttttttttttttttttttttgagacagggtcttgctccgtcgcccaggccagagtgcagtggtgcagtcacggctcactgcaaccttgaactcctggtctcaagccatcctcccacctcagcctcctgagcagctgagactacaggtgtgcaccaccacaccccactattttaaaaatattttttgtagagatgaggtctcaccatgttgcccaggctggtcttgaactcctcggctcaagcaatcctccagcctcagcctcccaaagtgctgggattacaggtgtgagccaccacaccgggttttgcctgtgtcctccttatttttgcattcatttatttgtcgctcaatgaacagattcctgcatcttcctcctccccaagagcccccagataccttgacacatctaccccaaccccgcagtgtcagaccagggagaagggacagttgtaaacaagggcatggccagaaggaggcagagaagtcttgctggaggagggaacttttgagctgagttttgaaggacgaataggagttggaccgtgtggaaaacaaacattccaggcaggaggcagggaagggcctgcatgggcaaggctcctggagtgtgagaggaagctgcgagagaaggcaatgggagcagtttgagctgctactttctcctgagggcagtagggagccatagagggagtgagagtgagggcagggctgctaagatcattgtgggaagcgcagtgcagtgcatgctgggtaaataactgggtcctaccccctccactcaccgatgctgaagcgctggggctggctccagacacccctcagccacgctgtgtctgctcgcacctgcaccgtgtaggctacaccagcccgcaggccactgagggtaacttgggtctctgtgggctgcacgggatgctctgcagtgggagaggcaaccctgagtcctgggacctctttactcctcagaggccaggctgggctaccacagcctgtgggtggggtggggattcataggcattttgctaaaatctctactctttctttctttttttttttttttttttgagacggagtcttgctctgtcgcccaggctggagtgtagtggcgccatctcggctcactgcaagctctgcctcctgggttcacaccattctcctgcctcagcctcccgagtagctgagactacaggcgcccgccaccacgcccagctaattttttgtatttgtagtagagacggggtttcactgtgttagccaggatggtctcgatctcctgacctcgtgatctgcccacctcggcctcccaaagtgctgggattacaggtgtgagccaccaagcccaacctaaaatctcttctcttaatgcgcccattcatctcaagattttttttttttttgagatggagtctcactctgttgcccaggctggagtgcagtggcacaatctcagctcactgcaacctccacctcccaggttcaagcgattcttgtgcctcagcctcctgagtagccgggattacaggcgcccaccaccatagccagctaattttttgtatttttaatacacatgaggtttcaccatgttggccaggctggtcttgaactcctggcctcaagtgatccgcccgcctcagcctcccaaagtgctgggattacaggcgtgagccaccgcgtccggctgacttgttggatctttgggcaggtggatctgaggttggaggcaggattggactctggaggcagggcttggacacaggaccaaactgaggactagctaaagcaggtcctgggctttccataagacacgcccaccagtgtgccatgtcagtttaccattaccatggcaacacccggaaattaccgcccctgtccacggcaatgatcccacaacccggaagttactaccttcatcctagatatttctgcataaaccgccccttcatttgcatataattaaaagcgggtataaatatgagacgtagctgccctgcctgtggggcgtccccactctgcaaggagcaggacttctgctgctgctctacacggccacttcagtaaaagtttctgtctaacaccaccgacatgcacttgaactctttcctggggaaagccaaaaaccctcctggctaaaccctgttttgtgggctttcctgtccctcatcagatcccccctccaggccttagtttcctcatctgtggaatggagacagtcatccctgcttgatgagagttcagctgctgctacatgtgaggggcagcttcccatggatgaatccaatacaccataagcacttggctggtgcccacccagccttctccagggtctgcaaggggtgatcgagaccctcaagttcagctgggtgctcatgactaatcccagcactttgggaggccaaggtgggaggatagtttgaggccagaagtttgaaaccagcctgagcgaggccggacacggtggctcacacctgtaatcccagccctttgggaggccaaggcgggtgattcacctgaggtcaagagtttgagaccagcctggtcaacatggtgaaactccgtctctgctaaaaatacaaaaatttgccaggcatggtggtgggtgcctgtaatcccagctacttgggaggctgaggcaagagaattgcctgaacccgggaggcagaggttgcagtgagctgagatggcgccactgcactccagcctgggtgacagagacagactccctctcaaaaagaaaaaaaagaaaaaatcccagcctgggcaatatagcaaggcctcatttctacaaaaaataaaatattaactgtgcatggtggtgtgcacctgtgtttccagctactagggaggctgaggtgggaggatcgcttgagcccaggaggttgaggctgctgtgagctatgatggcaccactgcactccagcctgggcacagagtgagtccctgtctataaaattaaaaaaaaaaaaaaaaagaccctcaagtctaattctcttgtttttgttttttgtttgtttgttttcgtttttgttttttctgagacagagtctcactctgtcacccaggctggagtgcactggtacaatctcggctcactgcaatctccgcctcctgggttcaagcgattctcctgcctcagcctcccgtgtagctagaattacaggcatgtgccaccatgcccggctaattttgtatttttaggagagacggggtttctccaagtttgtcaggctggtcttgaactcctgacctcaggtgatccgcccgccttggcctcccaaagtgctgggattacaggcgtgagccactgcgcccagccaattctcttgttttaagggtttgataaccaaggcccagagaaggacggcaaggtgcccagggtcacacagcaagagagatcacaggccaggatcctcccttcctccccaagccaggtctgcactgcctcacgtacctgacacctgtttgctgtcttcatctcggcagcggacaacatactcctttaggacgccgggacaggtgctcagcagggatggtgcccagtccacagacacagagtccaagctatgattcttcaccgagacgtggtgcggtgtcccagctgctgaggctgcaaccagtaccattgtcatagtcaacaccaagaatgctggtcgaggcctggcacagtggctcgcacctgtaatcccagcactttgggaggccgaggtgggtaagtcatttgaggccaggagttcaagaccagcctggccaacatggcaaaaccccttctctactaaaaatacaaaaattagccaggcatggtggcggacacctgtaatcccagctactcaggaggctgaggcaggagaatcacttgagcccaggaggcagaggttgcagtgagccaagatggcaccactgcactccagcctgggcaacagagcaagaccctgtctttaaaaaaaaaaaaaagcccagccacgatggctcatgcctgcaatcccagcatattgggaggccaaggtgggtagatcacttaaggtcaggagttcgagactagcctgaggaacatggggaaaccctgtttctactaaaactacaaaaattagccaggcatgatggtgggcgcctgtaatcccagctactcggcaggctgaggcacgagaatcgcttgaacccgggatgcagaggtttcagtgagccaagatcgtgccactgcactccagcctgggccacagagagtgactctgtctcaagaaaaaaaaaaaaaaaaaaaaaaaaggagtgctggttgagcacttcctgaatgcccagcctcccactgtccagagacggaggtaacattggccacagagtcaggtgagctgggttttaattctggttctgccactcagtcactgtcatttcccttccctgggcctcagttttcttatctataaaatggacaatgctggccgggcgcagtggctcacacctgtaatcccggcactttgggaggccaaggcaggtggatcacgaggttaggcatttgagaccagcctggccaacatgctaaaaccctgtctctactaaagatacaaaaaattatccaggcatggtagtgcacacctataatcccagctactcaggaggctgaggaaggagaatggcttgaacccgggaggcagaggttgtatgattgcagtggtgcaatcatagctcactgcagcctcaaactcctgggatcaagtgatcttaccacctcagcctcctgagtagttgggactacaggcacatgccaccatggctggcaaacttttttctttctgtagagacggggtcttgctatgttgcccaggctgttcttgaactcctgggttcaagtgatccacaagcctcagcctcccaaagtgccaaagtgctgggattacaggggtgagccattctgtctgccttaacagcattgtccttttttttttttttttttttttttttgagacagagtcttgctctgtcacccagactggagtacagtggcatgatctcagctcactgcaacctccgcctcctgggttcaagcgattctcctgcctcagcctcccaagtatctggaattacaggcacccgccaccacacccggctaatttttgtatttttagtagagacagggtttcgccacattggccaggctggtttcaaactcctgacctcaggtgatccacccaccttggcctcccaaagtgctgggattacatgcgtgagtcactgtgcccagcctctatttttttaaattatttaaaaagaaaaaataatgtaaacctgcaggtttgggtcacttaccattgcccccaaagtggtaggtggacaggaccgtagaccacaaggtgagcttctcggggtgcgcagaggcaaagatggtaatgtagtaacacttttcctgccccattgccccagactctcgactccagctgtaggttgctggaaggataagcaaaggccaggccattcagtagattgtgttcccacctctgcacctttgcactggctgtgccatctgccaggaacccccagaaaactcctactcatgtttcaaagcccttgcaccaatatcccctcctccaagatctcttccctatgcaacacccccaaccccatccccatccccctctaacccagcccttactccatggaaccagggcttcttttttttttttttttgagatggagtctcgctgtgtcacccaggctggagtgcaatagcgcaatcttgactcactgcaatccctgcctcccgggttcaagcgattctcctgtctcagcctcctgagtagctgggatttacaggtgcacaccatcatgcctggctaatttttatatttttagtagagacagggtttctccatgttggccaggctggtctcgaactcctgacctctgttgatccacctgcctcagcctcccaaagtgctgggattacaggtgttagccaccttgcccggacaatggggtcaggggttccgtgtccagttctgtctcctcaggctgtgtattcttcaaggaacaggctgaggctgaggctttctggggctctggcaaggcccagagcaggaagcgggagagtgagaggccacctgagcctcacggcccccctttccctaaagactgctcattaatttgccaccagcatctcgcgaactgccaccttccctggcgcggttgaatatttaacaaacaccttgggatgtgagattcattacctgtatgtgtgtgatctgcctggaactgagctcaggatgccagcaagaggttccagacccatatgggtgagaggctccgaacctcaccctgtccctacctctgtatgacattgagtaagcagcaacacctctctgggccttagacacccgctgtgtgccttccctgcaggtttgaacccaccaggacctaaaagggagggcacagaggaggggtaggcgcaggccattccaggccattacccattccagccggatccgggtcttgcggcgcagtcaggctgcaggtggcaaggcccccgtcctggcccacaggctgccattcaatgcaatacgtcatgctctgagcccgggctggccaatacatggtggtcccgttggttccgacgctgatattcagagccactggttctggaaggagaggggagagacgcatcgagacagttgccatctctctccccagtccccttctctggctcctgcagcctctctcccaccctctcgtctatacccctgaccctacagggccaggggtgtctgtgtttggctgtttccctgcactggaggctgccttggggccaggcacaaagtgggtagcagatggcgtttgtttttttttgttttttctttggagacggattcttgctctgtcgcccaggctggagtgcagtggcatgatctcggctccctgcaacctcagcctcccgggttcaaatgagtctcctgcctcagcctcctgagtagctgggaccacaggcatgcgccaccatttcctggctaatttattattattttttggtggagatggggtttcaccgtgttgcccaggctggtctcgaactcctgacctccagtgatccacctgccttggcttcccaaagtgctgggattacaggcataatccgccgcatccagtcagcaggtggtgtttgaatgagctgagtcctcctccagcctaactgctgtctccttgccaggatattcaccatgagagcttcctgtactgccattacacccacttccagccttgtaggcgtctccggctgtggcagatacctggctgcccaccacttgcctagcctaggcggagagtgtgatgcaagactaggcctccctggcctgaccggcgccactggtggtctcatgccaaactcagaagcacgagcacacacccactcagtccctgggcaaatctctcccactccctcccgccagggcgtcttcatgaatgtcagagagatggatactgcttgcaattctggggatagcaacagccgtttattgagtaccaactgcatgtgccaagccaatgctgagagctttacaggcaccatttcactatgatatgggaccaggctgggtacggtggctcacgcctgtaatcctagcactttgggaggtggagatgggtggatcacttgagcccaggagttcgagaccagcctgggcaacgtagagagacacctgtctctacaaaaaataaaaataaaaaattaaccaggtgtggtggtgcatgtctgtagtcccagctactccagaggctgaggtggaaggatcacttgagtctgggagttcaaggctgcagtgagccatgattgcactccagtctgccaacagactgagaacctagctcaaaaataataaaaatagtaggtcggccacagtggctcacacctgtaatcccagcactttgagaggctgaggtgggtggatcacctgagggcaggagtttgagaccagcctgggcaacatggtgaaactccatctctactaaaaatacaaaaattaggctgggcatggtggctcacgcctataatcccaacactttgggaggccaaggcaggtggatcacttgaggtcaggagttcgagaccagcctggccaacgtggtgaaaccccgtctctactaaaaatacaaaattagccgggtatggtggcagatgcctgtaatcccagctactcgggaggctgaagcaggagaatctcttgaatctggaaggcggaggttgcagtgagctgagatcatgccatctgtcacaagaaaaaaaagaaattagatcttaaataaacacagggtcaactctagccttttttctttctttctctcttttttcttttttgaaaaagagtgtagctctatcaaccagggtggagcgcagtggctcagctagtttttgttgttgttctttaataatgcataatagccaggtatgatggcacatgcctatattcccagctatttgggaggctgagggagaaagattgcttgagcccagaagttcaagtccagcctgggcaacatagcaaaactctgtctcttaaaaaaaacaaaccaacaacaacaaaaaactgcattatggatcttgattattgaattttttttttttgacacagtcttgctctttgttgcccaggctggagtgcaatggcacaattttggctcactgcaacctctggctcctgggttcaagcgattctcctgcctcagcctcccaagtagctgggactacagccaccacactcagctaatttttgtatttttagtagagactgggtttcaccacgttggccagactggtctcgaactgctgacctcaggtgattcacctgtcttagcctcccaaagtgctgggattacaggtgtgagccaccgtgcctggctgattactgaatttttgatacacccctaaatcaggcactcctttaaaattttctgcctcgctcctctcaccctggtctagctgaggctcagagtaggtgctcagctctgaggggccctcataccgccctccccacccagaggaggcacctgtgtgggtgtcggcaggaatgtgccacgtctggttcaggccaggaccaaattggttcgaggagatgacagccacgttgtaggcagcacccgagagatagggcatcttccccaggtgcagggtcctggtggccttggccttacacgggcaggacagcatgtggagctgtagtcggtaagtgacctccgtgccaggcgccagcccttgacagccttctggaagctccagctgggttggctgtcaggagtatgaaagacagcttgtgggtacctgatcacactcatcatcccataggcagacagcagggcacagcctatgaagacagacttggacaaaggccacagccaataacatgcatcaaaaattaaaagaataataaacctcaatgctggcaaagctgctgtgagacaggcattcacctcccgcacacatctagcttgagggaggtgggaaattgacaaaacccactgacattcaggaaaacaaaaatgtttccatcttttaacccagttacctcaagcagaaaatttttccttagaaaaggaatttgagaggccgggcacgggggctcacgcctctaatcccagcactttgggaggccgagacgggtagatcatgaggtcaggagattgagaccatcctggctaacacggtgaaaccccgtctctactaaaaatacaaaaaattagcccggcatggtggtgggcgcctgtagtcccagctactcgggaggctgaggcaggagaatggcgtgaacccgggaggcggagcttgtagtgagccgagatggcgccactgcactccagcctgggcgacagagcaagactccatctcaaaaaaaaaaaaaaaaaaaggaaaaaaaagaagaggaatttgagttagaggaacataggaaataaaggatttttgctacagccttatagtaacagcccattagggacctgactaagatgactatggtaaagtcaacgagtggagtatttgtcagttttgtctcaacagagatactccctctatgcctcagtttccctctctgtaaactaatcagactgcacttaatgggttgttttgggacttaaagcaataatctgctacccaggcaaatgcagtcaccattatctccttcctggccttctggcttctgtgcaattcccccacactctgtttctcacacaggagccagggaaagtctgtgaacatctgagtccagtcatgtgcctctcctgctcacacacacactccatggctccctattaccttcagagttaaacccacaatttgcccacttcctgccacctctacatctcatctccctccatctaccacttgctcatcccccgcctaggcttttgcctcctgctccccatcccaggccaccccacagccctgtgacagccccgttacctgctctttcagggtcagccgcctcctcccatcctggcccagctgctccaccgagaatctcacctgaggctgtggggggttttctgcaatcagaaccaaaccaactagacgaattggaaggagagaaagactgatggatgttttctttgtaaatgatggattctccacatttacaaagtgaaaatcccttgctgccccaaattgcagaaaagagaaaaaactgaaggaagaaaaattaacacaatttgcatccccagggataactgccacctgtaatctcatgttgcctaaggttttttgtttgtttgtttgttcgtttgctttttgagacgaagtctcactctattacctaggctggagtgcactggtgcgatctcggctcactgcaatctctgccttctgggttcaagcgattctcctgcctcagccttccaagtagctgggattacaggcatgcaccaccatgtccggctaatttttgtatttttagtagagacggggtttcaccatgttggtcaggctgttcttgaactcctgaccttgtgatccacttgcctcggcctcccaaactgctggaattataggcgtgagccactgcgcctggcctctaagttcctttttgaatgcaaatgtatttctctgcatggttttgttgttgttgctgttgttttatagactagagacagagtctcgttttgattcccaggcttgtctcaaactcctggcctcaaacaatcctctggcctcggcctcccaaagtgctgggattacaggcataaaccacagcgccaggcctttctgcatggtttgaaaccctctcactcattttcctgttgcccaggctcagggcagcagctgtttagtacaccctgccacctgcaggtgacattgtccttgagacaccgtgaggttcagcctgatgattctcacttgataaagccctgtagtgggctgagcgcagtggctcatacctggaattctagcactttgggagaccgtggtgggaggatcacttgaggccaggagttcgagaccagccgggcaaacatggcgaaaccccatctctactaaaaatacaaaattagctgggcgtggtggtgcatgcctgtaaatcccagctactctggaggctgaggcaggagaatcgcttgaacccgtgaggcggaggttgcagtgagccaagatcacaccactgcactccagccagggtgacagagcaagacagtctcaaaacaaaacaaaaaatagcagtaggccgggcgcggtggctcacgcctgtaatcccagcactttgggaggccgaggagggcagatcacgaggtcaggagattgagaccatcctggctaacatggtgaaaccccgtctctactaaaaaatacaaaaaattaaccgggcgtggttgcagacacctgtagtcccagctacttgggaggctgaggcaggacaatggcgtgaacccgggaggcggagcttgcagtgagccgagatggcgccactgcactccagcctgggtgacagagtgagactccgtctcaaaaaaaaaaacaacaaaaaacaacaaacaaacaaacaaaaaaaacagcagcaaaaaaccctaaagtgggtgcagcaagaccggatgccacattgtcagggtttgagcacccatttctccctctgccttatttctaacactcaccaccttgtttctaatacctgctgccttatttctttttccattttattttattattacttttttttttttttttacttttttttgagacagagtctggccctgtcacccaggctggagtgcagtggtgtgatcttggatccctgcaacctccacctcccgggttcaagggattctcctgcctcagcctcccaagtagctgggattacaggctcccgccaccacgcccagctaattttcgtatttttagtagagaaggggtttcaccatgttggccaggctggtctcgaactcctgacctcaagtgatctgcccgcctcagcctcccaaagtgctgggattacaggcatcagccaccacgcccagccccattttattttattttttagagatggggtctcactatgttgcccgggctggtctcaaaccactggcctcaagtgatcctcccgcctcagccttctgagcagctggaactacaggtgtgcaccaccacctccggctgttgccttatttctaatgcttgcccctgttcctgtactcagagtgatcttaccagggggaacgcacacggggctgctccacttgctccaggaacttccttggctccccagctgccgtcgtcggagctggaattcctgggccacattcatctccagggggcagaggcaggactctggggagaggcaggtcgaacatcaggccgtaagaattgtccaggacttggcaccagtcacttaaccatcatgtgcttattgagctccaactgtgtacagagccacgtgctgggtcctgggggctcagcagaagcaggccaggccctgtcctcttagggcctccaggatcacccacgtccatccctgcccctcagttcaagtcctggctgcggccatcccttcggtcgtgaccttggccaaaggcttctcaccccctccaagtcgtgatttgtttccccacctgcaatttggaaagaatccaatactgaactatggggcagggtaagaggcatacaaaaaaattcagcattggacctggcatacagtaggtgctcaattaatgccaatttgctgcagctgttgttgtcattactattattattctcaccagtatcatcatcctgaggtccgcagtcgccctagaataaaaacatattcatatattgttttgcattttggtgctgaaaaatatttgctgttttacaattagttatttatttacttatttatctgagacacggtctcactctgtcatctaggctggagtgcagtggtgcaatcatggcttattgaagcctcaacctcccagggctcaggtgatcctcccgcctcagtctcctgagtagttgggactacaggcatgcaccatcacactcagctaatttttgcatttttggtagagacgggatttcaccatgttgcccaggctggtctcaaactcctggcctcaagcaatcccaccccaactcggcctcccaaagcactgggattacaggcgtgagccaccgcacctcgctaaatttttttaaattaaagaccatacttccagggattatttctatcgttaattactagagaaccttctctaggttcaaaccttctttaggaacatataaagcagtaaaaaattattataactaaattttaaaaattaataattattttactaaacacaatgtgggatcctggattgaatctgggagcagaaaaaagacattcctggaaaaattggtgacattcaaataatgcctggagtttatgtaagacattaacattagaggagtttgggtaaaggatatatgggcgttctctgcaccagtttatatagtaacttttctgaaaatcgaaggttattccaaaagaaaaaatttattttaaaaaattttagtgggagcaaggcgtggtggttcatgcctgtattcccagcactttggaaggccaaggtgggcggatcacctgaggagtttgagaccagcctggcccacatggcgaaaccccgtctctactaaaaatacaaaaattagctgcgtgtggtagtgggcgcatgcctgtaatcccagctactcgggaggctgacgcaggacaatcgcttgaacccgggaggcagaggttgcagtgagctgagatcatgccactgcactccagcctgggcgacagagcaaggctccgtctcagaaaaaaaaaaagaaaaagaaaaaaaccacctcaggggctagagtgggggctggttgggagcggggacagatgcagagatggtgagactgatttgggggtgaaggtgccctggagaggcccgtgtccaccctggacttgggaaacaaactcaccaacttccatgggctgctgggtgtccggtgccggaactgcacctcagcaccaacctggttatccggggtctcccactccatacgcagctgcccggccaacttggacaccttgatgtctcccagaggaggctcatatttaactggaagcagaggtagggattggcgaggggcagcccacacgtatgtgagttaatgggccctgaaaatccaccctgtccagggtaagcaactgaatccctaaatatgaattaggggacacttgcaggtcccagctaagcctggtatattatgatcaaaaagtcaagatttatacacaagccacatacggtggctcaccctgtaattccagtattttgggaggccaaggcaggaagatcacttaagcccaggagttcgagaccagcctgggcaacatagtgagaccccctcatctctacataaaaattagccaggcatggtagttcatgactgtggttccagctacttaggagagtgagatgggaggatctcttgagcctaggaggctgaggctgaagtgagccctgatcacaccactgctctccaatctaggagagagagggagaacttgtctctaaaaaaacaacaaatatggccaggagcagtggctcatagctgtaatcctagcactttgggaagccaaggtgggtggatcatctgaggtcaggagtttaagaccaacctggccaacacggtgaaacaccgtctctactaaatacaaaaattagccaggcatggtggtgggcacctgtaatcccagctacttgggagcctgaggcaggagaatcgcttgaacccaggaggcggaggttgtagttagacaagatcccaccactgccctccggcctgggtgacagagcaagactctgtctcaaaacaaattaaaattaaattaaaatttaaaaataaataatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccgcccacctcgggctcccaaagtgctgggattataggcatgagccactgtgtccagccaattctttttttgtttgtttgtttgtttagaactatcagggaaatcgtacttagtttttagatctatttcaaggaacctgacccaaggagagacataaattagcataaaatagtcttgctgcaccgtggtcatacccggcctgattctttttttatatcattgtataaatttaagaggtatgatggtttgatatacatatccatagtgaaatgattactacagtaaggaatttaacatatccatggccaggcacaggggcccacgcctgtactcgaagcactttgggaggccaagacaggaggatcatttgagcccaggagttcaagaccaccctggccaacacagcaagaccccatctcttaaaaatatatatacatatccatcaccttctataattacttttttggtgtgtggtgagaacacttaaaatttttttttttttttttgagatggagtctcgctctgtcacccaggctggagtgcagtggtgtgatctcggttcactgtaacctccataccacaggttcacgtgattctcctgcctcagcatcccgagtagctggaattacaggcgcccgccaccacactcggctaatttttgtatttttagtagagatggggtttcaccatgttggtcaggctggtctcgaactcctgacctcaggtgatcctcccacctcggcctctcgaagtgctaggattacaggcgtgaaccactgcacccagcccttaaatctattcttttagcaaattttcaatatacattatttttaattatagttctctactgtaccttggaactctagatttatttgtgctgcgtaactacaaattgtattcctttgacctacatctcccccatttcctccttctctccatccccggtaaccacagttctactttcggtgcctagatattcgactttttttttttaagattatacatgtaagtgggatgggcgcggtggctcacgcctgtaatcccagcactttgggaggctgaggcgggtggatcatgaggtcaggagatcgagaccacggtgaaaccccgtctctactaaaaatacaaaaacttagccgggcgcggtggcgggcgcctgtagtcccagctactggggaggctgaggcaggagaatggtgtgaacccaggaggcagagcttgcagtgagccgagatcgcgccactgcactccagcctgggcgacagagcgaaactccatctcaaaaaaaagaaaaaagaaaaaaagattatacatgtaagtgagatcatgaaatgtttttgtttctgtgcctggcttacttcactcagcgtaatgtcctccagctttgtccatgttgtggcaaatgacatgttttccttcattcttttcttttcttttttcttttttttctttttttttgagacagtgtcttgctctgtcactcaggctggaatgcagtgacttgatcttagctcactgcaacatctgcctcctggattcaagccattctcccgcctcagcctcctgggtagctgggattgcaggcatgcaccaccacaccaggcaaatttttttggcttttttgtgtgttgctgttgttttttagatggagtcctgctctgtcgccaggcaggagtgcagtggctcaatctcagctcactgtaacctccacctcccgggttcaagcgattctcctgcctcagtctccccagtagctgggactacaggcgcgcgtggccactcctggctaatttttgtatttttaatagagatggggtttcaccatgttgaccaggatggtctcgatctcttgaccttgtgatccacccacctcagcctcccaaagtgctgggattacaggcgtgatccaccgcacccggcaaaatacatgatgtcgagtcatgagaacagataataagaacccaaccaggtcttggcagcattatggctagcagagagaaaccagaagcaatctaagtgcccacgaataggggattggtaaggggaccatgaaagactgctttgtcacaatagtgtttgcgtgacactacgtgaagtgacaatggctagtagtatcaagtcccttgccaagggccaggaatcctctctagctccagccttgcagcctgatggcctctctgggtaaaaaacggacggggggagaacaaggtgctaacctgagttgtagagctgcagggtcacctcaggagacttctctgtctggttcctggcccaggattccacccagagtgtgacagtgtacagcacagacaccccagcctggtcggagaactgcagcctggtggctgagccggcggcgaagtagcagcagcgcccggagctaaggctgcagcaggaaggagggtgtcagtgccgagtctggggtcctagtggaccccacagccgactttgtgcatcacatcccagcatcgtttttttggtgtttgtttgtttgtttggagatggagtttcattctgtcacccaggctggagtgcagtcgcgcaatctcggctcactgcaacctccacctccctggttcaagcaattctcccacctcagcctccctagtagctgggattacaggcacatgccaccacatgcgtctaagttttgtatttttagtagagatggagtttcaccatgttggccaggctggtctccaacttctggcctcaagtgatccgcccacctcagcctcccaaagtgctgggattacaagcgtgagccaccgtgcccagcccccagcatccttttctgtcccttgtacacctcctcccccagcctgggggttccttggagatcagtctgggactggaggggtttgagggaccccagtatctcccagcaaggactgcaccacacagcgaagaaacgaatgaaagggctgggcgcagtgcctcacgcttgtaatcccagcactttgggaggccaagggggggtggatcacctgaggccaggagttcaagaccagcctggccaacatggtgagactctgtctctactaaaaatacaaaaattagcaggtgtggtggcgtgtgcctatagtcccagctactcaggaggctgaggcaggaaaatcactctaactcaggaggcagaggttgcagtgagctgacatcatgccactgcactccagcctgggcaacagagcaagactccatctcaaaaaaagaaaaaaagaaaaaagaaaaaatggatggatggatggatggatggatggatggatggatggttggatgggtggataagtgaaagggtgaagaagaaaaaaggactagagagaccctcatggccacccaccctgggatgcctaccttcactgaccaaccccccaccacaatcctccaactctctcttcttagatgagaaactgaagcccaggaaggagtgttgacccagccaagatcacgcatccgagagtaggggcaccagagggggttgaagcaagagtgggatggtgggtgagggtttgggaatggtagaggggtcctcaccaacaccgcaggaagtggctgaccccagctgtgggaccctcatactgccaggagcactcgtaacgatcactggatatccgatagcatctcaggtccctagggcccgaggccgagcctggaagagatcctgtaggcttgggaacagaccagagtctggaggggtcttcgtgcctaagacaaatctttgtgatgcttacatctttcagcgtcacctcagcctaaaccctccccgcgtccttcctacctcatcccctgccgtctctcacctcaacctattccgaatcctcagcctcctaacttgtcctcacagaggccagatgtcctgccacctctctctctatccctcaccctcctctggtgtttttttttggggggtccccagggccccaactttcctcctctggttcttcaaaacacatcatcacatttgtgatagacatttgtttgcctgttgtctatctcttccactaggctgtggtcttgggaagttagttgagctcatagccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcacggtggctcattcctggaatcccagcactttgggaggctgaggcaggtggctcaccatcacctgagctcaggagttcaagaccagcctgggcgacatggtgaaacctggtctctactaaaaatacaaaaattagccgggtgtggtggcgggcacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctactccagggcaacttgaacctggtaagaatgggccagcaggtggtggggtggggactcccaagaccacaggcagggctgggtctttggcctggtggtggaggccatgggaggggccgctgtggatggggtcaggcagagccctacataatcctcagccaacaatgaggaactgccccgaacctgagtctgcatccggatatggcgggtcctgaaaacagcactcactggttctgcaggcagctgcaaaggcaatgaagacataatgacattcctggccttgcactgtgtggggagaagggctcagccttggggtctacacccaagtgatcatcagccctcccacccacccactttcccatctatgcaccctcctaccaccacccatccatccatctgcccatgtatttatctgcccatctacccatccatccatgtatttattcatccgtccaccatctacccatccatccacccatgaattcatccattcacccatccatccatccatccatccatccatccatccatgtattcatccatcatccatccaccccaccatccacccatctacccatccatccatccatgtactcatccatccatccactcatctacccatccatctatccaaccatccatgtattcattcatccatccacccatctatccatccatccatccacctcaccatccacccattcacccatccatccatgtattcatccatccatgtattcatccatccatgcacccatctacccatccatccatccatccatccatccatccatccaccccaccatccacccatttacccatccatccatgtatttatccatccatgtattcatccatccatccacgcatctacccatccatctatccatccatgtgttcattcatccatctactcatccatccatctgccccaccatccatccatccacgtattcatacatccatccatccaccccaccatccgtccatccatccacgtattcatccatccatccatccaccccccatccatctatccatccatccatccatccatccatccatccatcaatccatgtattaatccatgcatccaccccaccatccacccatttatccgtccattcgtccattcatccatccatccatgtattaatccatccatccatccatccatccatcccaccatccacccattcacccatccatccatgtattcattagtccatccatccatccatccatccatgtatttatccatgcatccatgcattcattaatccattatccattcacccaaccatccatctatccatctagtcaccaatctatccatctatccatccacgtattcattcatccatacacccacccatccatccatttatctacctaccgatatatccatccagccatccatccatccatccatccatccatccatccatccatacatacatacatgtatttattaattcatccatccattcatttacccacccatccacctgtctatccattcatccaccaccctttagtcctcagaggttgagatgcatatttgggagacactctcgggaggtacccctgcaggaaagaacagtaagaccaacagtctggagggcagagagaagtggaggtgtgcctggggtggcaccagtgtctgaagccagcatggggaaagacagtagagggtgcatggcagggagaggcctgccagggctggcccaggcaagcacacttggcccactagcagtcagggcaattattaataacatttctccaggaggcagcgacctccctcagccactgggatccccgtgccctttgggattgccacagtctgctaggtgtggaactgggtgagagaaggagggggatgccaccatggatgggtcaggaagaccccggcgccctcactcccacaagaaggacctgtcctgagccctgcaggcagattggaagccttgggggagaaggcggcaccccaggaaacagccccaagtgtccaaccttgaggggggaaagatgcttaacacacaaggctctccatccttccatctctctctgtgatgacacagaacccccacccacccacccacccctgagagcctaaagcccatcctccttccctttccctggactgaccactcactgccactatctccaggatacctcgtgggctgcctctcgccccctccctgctgctggtctccagccatgcctggcccctgaaggcgctgggaccttgaggtgtggccagcactgctgtgggcattctacaggcactcagtgcatctcaagagccattgaaaaagtcagcaccccgctgatccccagtgtacagagaaggaaagtttatttattattattattattgagatagagtcttgctctgccacacaggctggaatgcagtgctgcaatctcggctcactgcaacctctgcctcctgggttcaagcgatcctcccacctcagctcctaagtagctgggagtacaggtgcccatcatcaagcctggctaatttttgcatttttagtagagatggggtttcaccatgttagccaggctggtctcgaactcctgacctcaagtgatccacccatcttggcctcccatagtgctggattttcaggagtgagtcaccgtgcagggcctgagattattaaaagtatatgggaaggctgggcatggtggctcatgcctgtaatctgagcactttgggaggccaaggtgagtggatcatttgagcccaggagttcgagaccagcctgggcaacacagcgagacgctgtctctgtaaaaagtatacaccaaaaaaattaaccaggcatggtagtgtgcacctgcagtcccagctactcaaggggctaaggcaggaggatcacttgagcccaggtggtcaaggctgcaatgagttatgattaggccactgcactccagcctgggacacagagtgagaccctacctcagtaaataaataaataaataaataaataaataaataaataaataaataagtaaagtatacggaaggatgtgcataggttatatgcaaatactttaccattttatatcaggaacttgagcatctttggattttggtatctgcagagggtcctggaaccattgccccgtaaatatggaaatgactgtatacattatattatgtatgtctatctattgtaaactacatacataagatactatactatgtatacctattagatacatacttgctttttattccttccttagttttttttctcattgaactccgggaggtggaaaaaatttagtgcatttcacagaagagaaaatctagaccagaggaaagatgtctaagttcgatcccagaagccatgactgcccatctcccatttgacagcaggaaagactgaggcacagagagatgaaaccaacccacacagcaggcccacagctctccacacatacacgtgcctccacccagcaagaggagccgccatgccagggtcaggggactcaccgccctgcctggacagcaggaagaggaagaggagggggaccacccaggtcaccagcggctccatcggatccacgtagagccccacagccccaggggagcctctctgccacctgcgaggttcagccaccccgtccccactccggaacacattgaagctgagcaaggagaaaagactgaaaaaaaagaaaaaagaaaaaaagtaaagtgtcacagcccatccctaaggcaagtcaaagtgaaagagaaacccaggaagtcagctccgtggtggtggtgatggtggcggccacagactctggagcaagtctgactttggagcaagtcagggttctagggggttctgccctgctggccccagacctgaactgaacacccagatgccagccccatgggcccatgggccacctgtggttccatgcacttggccaggtctctggccctctctagccaatttttttttttttttttgagatggagccctgctctgtcgcccgggctggagtgtggtggcatgatctccactcactgcaacttctgcctcccgggttcaagcaattctcctgcctcagcctcccgagtagctggaattacaggcaactgccacaacatcgagctaatttttgtatttttagtagagacagggtttcaccatgctggccaggctggtctcgaactcctaaccctaagtgatccacccacctcagcctcccaaagtgctgggatgacaggcgtgagctaccgtgcctggctgccaaattctttttttcttcttttgagatagggtcttgatctgtggcccagctgtagtgcagtggtgcaatcacggctcactgcaacatcaacctccccaggctcaggccatcctcctacctcagcctccccaggaactgggactacaggcatgcaccaccacgcccagctaatttttgcatttttttttttttaagagagggggttttgccatgttgcccaggctggtctcaaactcccgggttcaaatgatccgtccgccttggcctaccaaaattctgggatcacaggcgtgagccaccgcaccgggccatctcgccagcttctgaatctgagactcaagagctgaaggagggcagtgttcttggatggcctaatttcatccttccaacaaattgttacaaagagcttgcagcatgctggccctccacaatgcccacctccccacatgccaagctccagccttgtgcacctgggctcacccctctaatcccagcactttgagaggtcgaggtgggaggatcacttgaccccaggagtttgggtctacctaaacaacatagcaagaccccatctctataaaaaataaagaattaggccaggcgcggtggctcacgcctgtaatcccagtactttgggaggccaaggcaggtggatcacgaggtcaggagtttgagaccagcctgaccaaaatggtgaaaccctgtctctactgaaaatacaaaaattaaccgggtgtggtggcaggcacctgtaatcccagctactgaggaggctgaggcaggagaatcgcttgaacccaggaggtggaggttgcagtgagccgagatcgcgccactgcactccagcctgggcaacagagtgacactccatctcaaaatatatatatatatataaattaaaagttagccagtcgtggtggcacacatctgtattctcagctactcaggaggctgaggtgggagaatggcttgaacccaggaggttgaggctgcagtgaatcgtgattgtgccactgcactccagtctgggtaacagagcaagatcctgtctcttaaaaaaaaaaaaaaaaaaatttaagagatgcaacttagtctttcccccatgttccatttcttagcctctgagtattttgtttcctgcccctccctccccactgtcggcaaagcctctaaatgtcagtggagaagctctgatccaagctaccatgtggatgaaccctcaaaaacataatgctgggctgggtgcagtggttcacatctgtaattccaacactttgggaggccgaggtgggcggatcacctgaggtcaggagtttgagaccagcctggccaacaaggcgaaaccctgtctctactaaaaatacaaaaatttgccaggcctggtgacatgtgcctgtaattccagctattcgggaggctgaggcagagagaattacttgaacctgggaggtagaggttgcagtgagctgagatcgtgccactgcactccagcctgggtgacagagtgagactccatctcaaaaaaaaaaaaacacacatacacaaaaaaaaaaacccatcatgctgggtggacgaagatggacaggaaaggcacacactgtatgattccacttatataaaatatccaaaataggcaaatgtacagaggcagacagtagctgagtggttgtcaggggctggggggaggcgggagtgagaagtgactgctgatgtatgcggggtttccttttggggtgatgcaaatgttctggaaccagatagaggtggtggttgcacaacactgaatgtgctaaatgtcactgaatcgtttgctttaaaatgatgaatttccggcccgggcgcggtggctcactcctgcaatcccagcacttgggaggccgagccaggtggatcatttgaggtcaggagttcgagaccagcctggacaacacagtgaaacccagtctctactaaaaatacaaaaattagctgggcgtgatggcatgcacctgtaatcccagctactcaggaggctgaggcaggagaatcgcttgaacccgggaggcagaggttgcagtgagccgagatcacaccactgcactcccacctgggtgagagagtgagactatgtctcaaaaaaaaaaaaaaagatgaattttaggttacgtgagatgcatctacagaaaaaagaaatattcttagagtccaggggcactgaggagggagaaggagagggtctctcctggggatgagcatctgtggaaactgaggcccaagtggccagggttgtgcaatgcggttcagcttcctgggaggaggtccctccttcaagaagcctggctccgaggggcagctgagctggccagggtcaggcgcccagcaggctatgaggtcagtgagttagggacaaagactcagtgtcctgggcctggcacagtggggacgggggccctgtgaccccatacaggacagccttctctggccccggggcccaggccagggtcagctgggggatggatgtgtgaggcctgggggaggggcagagacagagaaagggacagagatagagagatacataaagatggaggaggccaggcagggtggattatgcctgtaatccagcactttgtgaggccaaggcaggaggattgctgtaggctaggagttcaagagcagcctgggcaacatggtgagactccatctctacaaaaaataatttgctgggcatggtggcaggtgcctgtagtcccagctacctgggaggctgaggcttaagccagggaggtcgagactgcagtgagctctaattgcgccactgcactccagcctgggccacagagcaagaccctgctcaaaaaataacaagaaaggtggaggaaataggtagagatcagaggaaagtcatggccccctcctgaccatcctgagaccctcccaactccaccaattcctggagagtccctcacttgccttatttcacagattgggaaactgagtccaggggcactcagaccacctgaggccccagctggagatgaagagatggattcaaaccaccccttgtggagtatagttttgccccttccagagtggagaccgtgcctcagggcttcccccacccgcaccaaggttggccctctcaggcctcatctttcccacctgcaaaatgggcttttgtgagtatgaaggagggcttggcttgcagtgagcgctgtccacccgctggccagtgtgattagtcattgttgttgttccccagtggcctctgcctggcagctgctggaaaaacatcgagggagggagatacagggctggggaggtgaaaagctggacacagacgcccctagccccttgggatcaggaacagatggaggccgggtgccctgaagtggagcagggaggactgcctggaggagggacacttgagctagaatgtatagaattacagggcatctccggcagaggccacagcagaggcaaaagtccagaggaggtgctttggggaccaccaagatggacacagtgggtctgggtttctgtggggtgatgggctggggcctcgagcgccaggctaaagggcctggctttctccgagggcggtagggagccatggcaggtgtgtgagctggaggggtaccccagacaaaggtgaagtggtatttctccccttattgaagtcacaacctgacactccctctgaagttccccacatcccaccttccccttgccacatcttggcaagcccacctccttccctccgtctctaggcctgccaagaggccctgtgggccccttatggccccacccagctgccccagaagctcgtctgagataagttcccagggctgccccactttcaggtgccccacagactcgggggcgggtgaagcaggaaggatcgagtcacgagggccccagaaaacatgacgggaggaaccacagcacttccccacctcctcagcttccgccttctcagggagagagaccttcagcccgaggaggagggccgagcttccctccatgtggcaagagaccctaacgtcgctgaggatcatctaaagagggtgttgaaggatgcataggagttagccaggagacaacccatttgttaatttaacaaactcataggcatcactcatcaacaagaacaattttcatcattcaatcaggactttctaatgcctctgagggatcatttgaggatgtttaattattatttttatttgagacagggtctcactctgttacccaggctggagtgcagtgacacaatcatagctcactgcagcctcaacctcccagtttcaagctatccttctacctcagcctctgatatagctgagacacaggccaatgccaccatgatgcctggcttttcttttttttttttttttttttacttttgagacagagtcttgctcagtcacccaggctggagtgcagtggtgcgatttcagctcactataacctccgcctcctgagtttaagcaattctcctgcctcagcctcctgagtagctgggattacagacatgcaccaccacacccagctaatttttgtatttgtagtagagatggggtttcaccatgttgtccaggctggtctcaaatgcctgaccttaagtgatctgctggcctcggcctcccaaagggctgggattaccggcgtaagccaccgcccctcgaccatccagctttttttttttttttttcagtttttggtagaaatgtggtctcatgcctgtatcccagcactttgggaaggccgaggtgggcagatcacttgaggtcaggaattcgagactagcctgaccaacatggagaaaccccgtctctactaaaaatacaaaattagccgggcatggtggctcctgtctgtaatcccagctacttgggaggctgaggcaagagaatcacttgaacctggtaagcggggtttgcggtgagccaagatcgtgccattgcactccagcctgggcaacaagagtgaaattctgtctcaaaaaaataaaataaaataaaaatacaaaattagccaggcatggtggcacgcgcctgtaatcctagctactcaggaggctgaggcaggagaatcgcttgaacctggtaggcggaggttgcagtgagctgagattgtgccactgcaccccagcctaggagacaagagcaaaactctgtctgaaaaaaaaaaaaaaaaagaaatgtggtctcactatgttgcctaggctggtctcaaactcctggtctcaagggatcctcccacctcagcctcccaaagtgctgggattacaggcatgagccaccgctcccaaacagattagaggatgttttaaggaagactcaggaggttaccaagaaaaaagttcattcaaccaccacacttcctgatgtcccttatagagacatgtgaggagagttttgatgggtacatagaagctcacaagaataaaatgtatttgttcattcaatacaaggtcctctgatacttctcaaagagaatttgaagtggattttgaagaatatatagatgttaggccgggcacagtggctcatgcctgtaatcctagcactttgggaggctgaggtgggtggatcgcctgaggtcaggagtttgagaccagcctggcaaacatggtgaaaccctgtctccactaaaaatacaaagattagccgggtgtggtggcaggtgcctgtaattccagctactcgggaggctgagcgcaggagaattgcttgaatccaggaggcggaggttgcagtgagccgagattgctccactgcacttcagcctggccaacagagctggacttttgtctcaaaaacaaaaaacaaaaaaacacaaatatatatatatatatacttgtgtgtgtgcgtgtgtgtgtgtgtgtgtgtgttaaccacagaaaaactgcattcattcattcagtcagtccagtcagtcactcaataagcactccttcttgcccactgaggggttgttcaggaggcagttcagtgtaggaattctccagatggagcagcggatttgagacctctctggtggctctctccagcatgttcccacatgcccaacccaaccctggttcagggaacctctctttccccaggattccagtcaaagccccagggagggctctgataggctgagcttgggtcacatgtacaccttgaaccaatcacagtggctgaggtggataaacgagtctgagtcacatgtccaccccaggctggactaagggagaactttgaggcagagctgcccagagtcagaacaattggccattgcaggacatgagcttctcatcacttggggtgtgcaagctacagcctgaagttcacttagtgtaggactgccagataaaacacacgacttccccacccccattgacttctgccttctcagggaccttcagcccgaagagtggggagcttccctccatgtggccaagagaccctgatgcccctgaggggtcatctaaagagggtgttgaaggatgcataggagtttgccaggagaaaatctattcattcatttaacaaactcactcgtagtcattattcattaaataacatttaaattaaattcccagttaaattggaatttcagacaaccaacatattggtttgtgttttgttttgtcttgttttgttttgtttgagatggagtctcgctctgtcacccaggctggagtgcactggcactatctcagctcactgcaacctctgcctcccaggttcaagtgattctcctgcctcagccccccgagtagcggggattacaggcgtgccccattacgcccccttaatttttgtagttttagtagagacgcggtttcaccatgttgcccaggctggtctcaaactcctgacctcagatgatccacccacctcagcctcccaaagtgctgggattacagacatgagccagcacacacggccaacacattgttgtttaatgcaactatgtcccaagtactgaagggggcatacttacactgaaaaaacattcattgtttatggaaatttaaatttaactgggtgtttgctttggaaaacagcctggttgtcttttacaaatttaaaatatagagttgctgggcgcagtggctcatgcctgtaatcccagcacgttgggaagccaaggcaggaggatcgcttgagcccaagattttgagatcagcctgggtaacatggcgaaaccttgtctctacaaaaaatacaaaaaattagctgggcatggcggcatgtgcctgtagtctcagctactccgccctccagcctgggcgaaagagcaagaccctgtcccaaaacaaaacaaaacaacccaaaacatagagttacaccatatgaccccggaagtccattcctaggtaagtacccaagagaaccaaaatatatccacaaaggcagggggcggtagctcacacctgcaatcccagcctttcgggaggccaaggtggatggatcacttaaaggtcaggagtttgagaccagcctggccaacatggtgaaacccccgtctctactaaaaatgcaaaaattagctgggagtggtggcgggtgtctgtaatcccagctactcaggaggctgaggcaggagaatcaattgaacctgggaggcagaggttgcagtgagccaagatcccgcgactgcactccagcctgggcatcagagcaacacttcatctcaaaataaataaataaagaaataaatctatgcaaaaagttgtatgccaatgtttatagcagctctattcagaatagctaccaaaatgtgaaaaaatccaagtgaccaccaacaaatgagtggatcaacaaaatgtacatgtacatatatacaatggaatattatttggtcatgaaacggaatgaagtactgatatttgccacaacatgggtgcatcttgaaagcatgatgctgaacgaagccagacacataaggccacatgttatgttttcatttttatgaaatatccagcacaggaaaattcatagaacaggaagcagattggtagttgccaggggctgagagagggggaatgaggactggctgctaataggtacagggtttcttttggggatgatacaaatgtcctggaatcagatcgtggtgatggttacacaactctgtgagtatgcttaaaacactgaatttattgcacactttaaaagcgtgaattttatggtatgtgaattatatgtcaatttttaaaattgtatgagaaaaacaagttttccctggcatcctgtatttttatttgctcaatctggccaccataacttgatgcaattctacagtacctcatggacagtcaggcccagtgacccttcctagggtcccctcgagcctgaaagcatactccagtgtccacactgtacagtggggcagccgaagacaactgcggctgcagagaaagtgcgagtcccagggaaagaaaaaatgcaggtgctaagccaggcacagtggctcatgcctgtagtcccagcgctttgggaggctgatgcaggagcatcacttgaggccaggagttcgagaccagcgcgggaaacatggcggtactccatctctacaaaaaaaacccaaaaaaattagccaggcatggtggcatgtgcctgtggtcccacctactctgggagctggggtatgggggctgaggcaggaagatcgcttgagcccgggaggtagaggctgcaatgagacaagattgcaccactgcactccagcctgggtgacagagagagaccctgtctcaaaaaaaaaatttttttttaaatgtgggtgctattttgggactttgggcttttctcagcctcagtttcccctcctgcaaaatggagtagaacaattatcttcaaatatctgtgagagatggtgtttatgagacacttagggcaaaaaggcaatcatcctcaaaaaagaaactgacaactgcagcggctacctgcttttgtaagtaaagttttattggcaccagggccaggattaaagggaggcaaacaaggctgagtggtgcaaggacaagggtctgatcatgtcttaagagttttagtgttttggccaggcaaaacaccaaaactctttggcctgcaatcccagaactttgggaggctaaggtgggtgaatcacctgaggccaggagttcgagacaagcctggccaacatggtgagacctcatctctaccaaaaatacaaaaaatcagcctggtgtggtggtgggcacctgtagtcccagctactagggaggctgaggcatgagaatagcttgaacccaggaggcaggggttgccgagatcatgccactgcattctagtctgggcaacagagagactcgtctcataaattaaaaaaaaaaaaaaaaagttttggtgttttggccatatgcggtggctgacacctg

SEQ ID NO: 1264 - DNA, 109859 bp, Homo sapiens
gacttggcaatgatttcttggctatgacagcaaaaacacaggcaataacaacaaaaaaatagattggtcttcataaaaatttgtgcttgaaaaactactatcaccatctgctgcataatccacctctaattggcttgtgagtttcttttcttacacatgaaattcttgcattatttgaaatggtttcagagcaatttattcagcacgtatcccaccctcctgccccccgccctttccttagagacagggtctcactctgtccctcaggctggagtgcagtggtacaatcatggcttgctacagcctaaaattcttgggctcaagtgatcctcctgcctcagcctcctgagtagctaagacgacaggctcatacttccatgcacagctagcttccttccttccttccttccttccttttttttattttttaattttttttgtagagacagtttctcgctctgttgcccagactggtctcaaattcctggtctcaagcaatcctcccgccttggcctcccaaagtgctgagattacaggcatgaggcaccgtatttggcctttttttttctcattaatttgttcattgattcttgttcatacagtctttttacttccttaggttacaatccatttatacccagctgagaaagtgtctgtttctcatcttattttttccaaatattttatagtaatcttacttgttaatttcccaggtgaaatataaccaggaaaattttgtccatttctaaattctgattgtgttaaattcttctagaatttcatctggaagtggggtaaactatgaattactcaattactcagagaggaattgaagtttttaaaaagagcttcaagaacacatatttttatatatttactcaaatcttcttttatattttgtatacatctcacacatttatttttaggggtattcggtgtgttttttaattgctattgtggctggaatatttttttgccatcacaccttttaacaggttgtatagaaacaagttaaacagtaagtaaaaaaaaaaaaaaaaaaaaggcaacagcatgagagaaaataacctgcaaattatatatctgataagagattaatatccagaatacatggcaaactcctaaaactcaaaaacaaacaaatgaataaaaaacacaattcaaaaatgggcaaaggagttcaatagacattttcccaaaagaaatataaatgaaaaggtgctaaacataactaatcattagaaaaatgcacatcaaaactccaatgaaataccactttacactcattaggatggttactatctaaaacaaaactaaacaaaagtaaaggttagcaaaggtgtgcagaaattggaacacttgtacactgttggtggaaatgtaaaattatacaaccactgtggaaaacagcatgcagtttttcaaagttaaaaatagaataaaaaatagaattaccatatgaaccatcaatttcacttttgggtttacacccaaatgaattgaaagttgtatctcgaagatttatttgtacacttgtgttcatagaagcattatttacaatagctaaaacacagaagcaatccaatatccatcgacaaatgactggataagtaaaatgtggcatatccatacaacagaatattatttcagccttaaaaaagaaggaaattctgcaatatgcaacaacatggatgaactttaaggacattatactaagtgaaacaagccagtcacaaaaaaagacaaacactgaatgattccacttatatgaggtacttaagagcagtcaaaatcatagaaacaaagcagaatagtggtttccaggagctgggggcaagagaaaatagggagttattgtttgtttaatgggtatagagtttttattttacaagatgaaaagagttatggagatggatggtggtgatcactgcacaaaattatgaatgtatttaataccactgaactgtatacttaaaaatggtaagatgaggcctggtgcggtagctgatgcctgtaatcccagcactttgggagactgaggcgggcaaatcacctgaggtcagaagttccagaccagcctggccaacatggtgaaaccccatctgtactaaaaatacaaaaaaataagccaggcatggtggcacctgcctgtaatcccagctacttgggaggctgaggcaggagaattacttgaacctgggaggtggaggttgcagtgagccgagatcatgccactgcactcccagcctgggcaacagagtgagactctgtctcaaaaaaaaaaaaaaaacaaagggtaaggtgataaatgttatgtatattttatcatcataaaaaactggaaaaaatacataatctgccttatttcatttatttctatgtaatctctcttttcattatcaatgctttaaatatatctttatctttggtattatgcagtgtctagtcatgaatcgctttattctgatgtatctaatcatgagttgctttttaaaaaaaaaaaccctaaatggtatacaatatgcttcctcagcatgtggactcatgtatttcatcaattctaaaagttctcagccattatctcattaaatttgtccctccttcattttctttagtcctttcttctagggctccaattatacatatattagctcttctcatactatcttctaaattataaacttctttttcatatttttatctcttctcttctcctctcctctcttttcctccacttgccctttcctgaattctaggcattttatcctgttctgcttccagttaatcagttctctaatcacctaaaccactgttaacttgtccattaatttaagaaatttctacaattatactttcatttctagaagttttcattgtttgtattaaaaatagtcatttattatagtctacatactcatcttttgtgaagtatgctttatttctttaaatatttatacataactttcttacattatgtatttgaaaatgcccatatctgtagttcttaaagctctaaatctatcatttgttgctgctgctgactcttcctcatggtggcttacctccatgcatgcctagtgacctttgattctcttgaccatctctttcccattaacttataagaagaaacaaagccctgggagaatatttggaaattaaaggagtgctcccattctatttctgtctttgtttctgtatctgtctctctgtcttcctgtctgtctttttctctcccctcgacctcttctcagttcacaggttctttcatctctgtttctctctctatgtcatttacattctctttcctttttctgaggccatgcagttctctacttctttttacgttttatagaagatggctgtcccacagtttatataatcctcagtttcagtcacacacggggactaactgactgagaaatagaacctgactgatccatctcaggcaaatgtaccccctgatccaatcagctgtaactacaggtcaggaacacatagcacaaagatggctgtggacttcccagccctgaggaagagaggaccaattctcagacaggaataactgagcaaaaatatgtcttccaaacaccctgtcctctcaatccctgttgttgtttctgccttcattcatcatttcactatgaatggctgcaaacatttcctgacaacttgcctttcttccagccttttcttctcaatccactctctaccagagtgatctttgtacaatgaaaatcgcatcatgttactttcctaatgaaaacccttcaagaattctctataacctctatgacaaattccagacttcttaggttggctggaagaagtaatttactaatttgagtcctaacgcctaatctttttctttaccataatccttccaccctaactccagacattccaaagaatattttgcttcccaaaatttcctgagtctctcattcctctctgctttcactcatgatgctccatctacccgcagggcccttcttccccttgccagcttggcaaatatctatccatctatgaagaaacaacttgcttcttctgggaggcttttttcctaaatccaattatctattgggaattgacctcattttttgtgtcatccctattcttttttattttttattttttctttagacagagtctcactctgtcacccaggctggagtgcaacggcatgatcttggctcactgcaacctccacctcccgcgttcaagcaattctcctgccttaacctctcaaatagctgagattacaggtgcctgccaccatgcccggtaatttttttgtatttttagtagatacagggttttaccatgttggccaggctgttctcaaactcctgacctcaggtgatccacccgcctcagcctcccaaagtgctgggattacagacatgagccactgcacccagccatcatccccattcttataagccatacagtacctttcacactctaacccagtgatttgtttgcctgcctgctccagtcgtcattgaactattagcatttttaaggtaggaactgtgtcttattatcttcatatttccatttcctaacacagaacctggtacatacagtgttcaaagaaatgcttgttgaatagatgaataattccttcttcctgtgcttctgtggatgtttcaaatcaaaggatctcatagcccttggactcatattctgaaagaaagagctaacatagaatgccacctctaaattttttctagaaatatacatattgtatctttttcaaattgccaatgttaattccctctgaccatggaggatatctgtgagtggactagaaattaagttttctaaagctctcaatgaaagaccccaagccaaatagagaaccagtggcattttcaatctaaaataatttaaaaccttcaacataggtgtcactgaactaaagctaagtgaggagagcttaaattccagcccactaggtaaaatggcatttgaataatcaaattccaggaagggcgccagttcagggctcagcacacatctgagggcctcaactgtgtgtgtgtgtgtgcacacgcgcgtgtgtgtgtaatctccacatttcctaataagatcttttaagtgaaaattactgactgtaattttttcaaaatacagaagtaatttttaataaaataaacaaaaaaacaaagttaactttatgtgtactcagcacacacatacacaaacacagctttattcaacatcttattcaattgtgtaagctgcattcctcactcaacatatttctgtgttaatcaagtttttatgactccattatattccacattatggatgtatcataattcatttatccaattctctattaatagagaatagtgcttactatgagtcctagacatcttatatatacaaacctgcttattattcacaacaatcctatgaagtaggtactattattatccacattttgtatataggaaaattaaggcacagagaacttaagtaacttgcccaaggtcagatactttatacatggtagaggtaggctccagagtctgcttttgatgattatgcaatattatttctctgaaactggggttaaattgattagtagctggttgtgagcaaggataagtaggaaggttacattttgctgagactttgtgttaaatatggctaagagcacatgttctaagtcaggctgtctggcttcagatcccacctttgctacttatcagccctgtagctttgggttatttgattcacttcctatatctcacttttctcatctgtgaaacagggttaataacagtgcctacttcagataatgctattagcgccaactattaaatacttaagccttcagatagatgataacttttattagaacaccttgattcaccatggggcaattttcctgaattgtagaatgactcccacaaaaaaaaaaaaaaaaaaaaaaaaaaaaaaacagaaaaaaactgcctttttaaaactcacttagccttccaagtccaatcttaggagataagagaactagccctaactagaaataatggaaaacagaaagaaacatatctgcaaatcagtggtgctatattacatatagtggggaggaaatggttccataatgcccaaaaaggtacctgaactgaagtcactatccttaaagttgagtctttgacattgtgcattttctcctgatgtcaagagggctggctcaggttccagagaaatctagacaatggtggagtggaaatgacaaggcagctttcccaagacagaaaagcatgtgaaaaagtgagcattaaccctttttccccactagcttttaaatttgttaatttttggcatccttaaagtctcacttccctaaagcacagccttaattaccctgccttagctgtgattcaataataaagaagagttattgagtgcatgaaataagctagcacctacacttgacatttattatctcattaacttaccgcaacccagtgaggtggaaggagccaatgtatgccagaggttttgtgtgtgcggttttttgttttgttttgttttgtttttaagagacaggtctctctatgttgaccatgctggcactcctcctaccttagcctcccaagtagctagaactacaggtgcatgccactaccccccacagaaaaagttttaaatggcatgcccaagttgacttaggtaacaaatgacagagccagaatgaatccaggaagcccacacacttaatggcacagttttacatggcacagcttctccgtgtggtaatggtcaaccagttagaaatgttaaagatggaaggagccttaggaattccctaatccaaagtttcccaaagtgcaatatatatccctatctagtataagaggtgactttaaggggtgtagagataaacattttaaaagtaatatgtatgtttttatattaacatatagtagaaaatatagctaacatatcaaaactgtgatttcagtcacaatgtattaatatgtgtaaagtgttggtatatcataagtgttgtgtaagtgtttgctatgatgacctagatcattatgatgagactaattttttaagagtcaatcttgaaaataataatagtaaaagcagtacacagaaatagcaaaagtcataaaattgattcttaagttactaaagtttgaaaatactaaactcttccaacttctttgtaacagcacaagctttgaattactgttcggaattattaggttgagccatattaaattgccatttgtatagcatcagtatggtcaagtactggaaatgccgtttggctcaacctaatattcaaggctcttcctatacttattaactgtgagaatgtgggtaagttatttaaccaggcaatgaagagggtccagctctttgtctatattggtaatttttgctccttttgcttctcttgctaaatgtctctgctctcaggcctggtcctgcactacgtataatctcctgctctgggtgggcccagagaatgccccattgtggcattctttccactgaccacaggcatggccatggaggctttcactgcctttctcaagaccagaataattagtggttgcctcttcaggtgtctcctagccaccccacgctgagggtgctatgagcaacttgggaataatctttatcattcatgaaaaccttgattcagtgctgggaaagctaacctttccactccctgatcaggtttgttttccctttatcaactcacagtataagcttccatccccatctgctgtactctcattaggctgagattaccttataaaaacataggtggaagccgtcatcctatcatatgacaatttctgccctgaaacacacagaaaattaaccatctgctctgatttaaaacaaaacagctccaaactcagactactaaagctggtgtattctacctataaggagatgcagaaagtaaaaggtatttttcattgttgtgtgaccttcttatattggtaaggacttgactgaaattgatatctggaagtatcctgccacttggacctttctctattagtcttggagtgatatgaaaagaatattatttcaagtattgccggggtaggattcagtgaggcaataaatcacatgcacaaaaggtatttttctttgtgaagaataagaatgtgagctaccagatcaaaactgacttggaaggcagaattttaacactttttttttttttttttgcaaactaagtgaaaaagacacatttggaaagtgatcacatgctgttagtgagcaacttaatcagttttgttctgagtttgagggtaattaactaataagaaatcatggttcaaaacaataaaactttaacacacaacatgaacatgttcaaagatggtcatgaatgtccatatttgtgaacatagaaatgtttaggcaggtacctgaccttccctcaaatcatagatcccactgagagtctcctgttttctgtgcatattctcaagccacaggtgttaactccctttcaacttctactaaagttttcccgtcctctgatagccatttttcacatgtgaaaactcgtttccatctttcacaaatgtaatatgctacagtgagtgaaattcagcaaaggcaagacgagacacagctgagcggtcagagaggcatgctctttgtcaaagtaactccagctttaaaataactctcattcaggatcacttgagcccaggagtgagctaaagtgattcaagtggcctcacaatctgttcaacaaatattttggcattacaaaaagaaccttttcaaatttattttttagtttccttggcaaacgggttaaccaaaaggatcttctgtaagtggacaaggattgagaaaactaaggaatttgatccattgaacctattgtcacggaaatgcagtggttttgtatggacctaaataatttgggcaacatagcgagaccttgtctccacaaaagaaaaattgaggccaggcgcggtggctcacgcctgtaatcccagcactttgggaggccgaggcaagcagatcacaaggtcaggagatcaagaccatcctggctaacacggtgaaaccccgtctctactaaaaaatacaaaaaattagccgggcttggtggcgggcgcctgtagtcccagctacttgggaggctgaggcaggagaatggcgtgaacccgggaggcggagcttgcagggagccgagatcgcaccactgcactccagcctgggcgacagagcaagactctgtctcaaaaaaaaaaaagaaaaattgaaaaatgagccaggcatcatggcatgtatctgtggtctcagctatttgggaggctgaggcaggaggattgcttcaagcccaggaagttgagcctgcagtgagccatgattgcaccactgcactccagcttgggcaacagagtgagagcctgactccaaaaaattaaagaaaatatatgtaaataagtgaaacaataaataaaaaatactcaaacacacatgatgggaaggtatgatctcgaatacacatgatgggaaggtgtgatcacttgcaaagagttatcattgaaaaagttaaattcataaaagctaagtgtctactgcagcaaaaattacatatcaagtgagaacgtaattgtttaaaagtgcctgagacaggtgcagtggcacatgtctgtattaccagctacttggagagctgagatgggaagattgcttgggcccagaaggtggagactaccctgggcaagatagtaagatcctgtctctaaaaggaaataaaagtggctgaaagaaaaaaaaacttgctgaacattcttgtgaacatccttgtgttccagtgccccaactgcagtccatactatagaactgttcagagcctagaagctgctggagccagagggtggagatgagccataggagaaaactgaccagagctgctagaagaaataaacaacaatttgacctaataacaagagcacttaaagagatataaatatagcaaaatcaaaatatactggggggctaacaagccattatttatgaacctcccttcccacccaagtcacctcctttatgtgtggtaggatgtccccagtctaagatttaatctatgttcaacgttccaggttctgttttgggatttccgtaaaaactaacccttttctcaccatggactttcaaaagcctggttttaaactcagagctgagcaatttctttctgcctagacagtatctgcctttccttctctagggcaataaacctcagcctcagaggctaatcttcctgtcagaggggttatgagaagaatccattatcaagaaaagaaaatacttcaagtggtattttgacatgataccaggacacaagaaatgattatacccaattcccagataaaattatattatgagcacctcctcaaatttgcattctctgggacctagggatacgtcctttaaaggtgcatcaggagggaacatgtcagagctcaatgctcttcctttcctaagtcaagtgcatgagaccccacactccttctgattgtatggccttgaactcaggaactgtgcatcatttttctttgtatcctctgtgctttaagcagcacagtgcacattgcagttgtttaggtccatatagaaccactgcatttctgccacaataggttcaatggatctaattatttagttttctcaatccttgtccacccacagaagatccttttggttaaccactttgtcaagaaaactaaaaaataaacttgaaaaagttctttttgtaatgccaaaatatttgttgaacatattgtaaggccacttgaatcacattagctcactaaaacgtctatcgcaaagtcacagtcttatgttactgaattcttagaattcttattctcctctaatcccacagaaacaaaaattgcttaaagttcaatctatctttaaagaaaaatattaaaatttgtaatgtctgtggataactaggaggcaagaaagttgaaaactgaaatcctgcgtcatatatcactagtaggtcttacctctcattgttttttgacataaagcaattattggataattcagcttggtagagaggctgaattgtgatatttggggtgtcataaaaggcagtatttgcaagatcaagtgggagacataatacacagagtaaaaaatatacagggataggaactgtaagggaaaaaaacccaagagactacaggctaaataaacctaacccatggataactgaagttctagaacgagaaataaaaacagatagagacaaggtaataatactaaactattagaagaaaattttcctgaaattaagaaaattttaaatctgcagtttgaagtattcaagttatgtataggaatgctggaaaaataaaaagcctgataaaatttctaaacttttaggataaattttaaaacttccagacagaaagaatctatgctattatattaataaagatgctttctggtggtgagtatcagaaacatcaaagtgactttaaaaataaggaaactgtatatatacatatctcatatacacacacgtgcacacgtacacacacaaagcccaggggtaaaaccactctagagttagttaattcagtggcctaactgcaccagtaaagacagaccaggtttttttcaaactaataattctgctttatcctcagactaccttctttcatggcaaaaattacagcatcacaatgtccaaaagcagcaaacgaattgtctctcctcttgtcttagtggcagtagctgttgattacctatccaagatccaccatcttagtggcagtagcttagtggcagtagttgttgattacctatccaagatccaccatcctcttcttcttcactaaaagaaccttgattttgtgcccagctaaacacactttctaagacttctttttggtcaagggtgaccatgtgatataattttggactataagatgtaagcagaaagaagtttgtgtgatggttagttttatgtgtcaacttgactggaccatggggtccccagatgtttgtttaaacattattctgagtgtatcttcaagggtgtttatggatgagattaacattttaatctgtaaagcaaattgcttgccataatgtggctgggccttattctatcaggcctaaatagaacaaaaagtctgactcttccctgagtaagagagaattttccagcagatggcctttggacttcatcagaaatatcagctcttcctgactgatgacctttaaagtgggacatcagctatccttgagtccccagtctgccaacccattctgcagattggacttgccagctttcataatactgtgaaccattccttatttatatttattcatcatatatatgtacacacacatatatgtaaatatatatatttacattatattccatatatatattctgtttctctgaagaaccctgaccaatctaatatattttgctaaatggtttctgggaaaccataagctttcttgatatgaaaggacagtagcatgtggtacagacattatcctacctatttttccttcttcttgctttgaagtgatgactggagctagaactgcagcagccatcttgcaactatgagggaaaggtcaaagaaactagagatgtatatgccctgatatcagaaatgcaacatcagcaactgcctgcctctgggctttttgctatctgagaaaactatcccccaatttttaaaggtcatttttgttttatgttattttgaattgaaaactttcctaattgatagagtagtgatctcaaatgctagaaaacttttctaaaaaatatttcttactagactttccttgatgtatcattgactagagcagagtcacatgctcactcctaagctaattagaagtaaatgaccttttcatgattgacttaaacaaatcaaaatctacaattccagaacaagaaatgggataaataccatggagaataggataatacctgagaaaatcagtgctgatgttaggaagccagtagatgttgagtgggtaaccaagtgtgtctgccacacttacaaaggaaaaagaatcagataggcatcaaacttcctgaatacatactaaaatctaaaaatgaattacgttatttctataggctacctccaaaagtgagctgaaacccaaaaattcactgtctagccctgtcaggataaaaatatatatttgcagaaactcaggaattcagagaacattaatcacatacttcatgtgagaaaaacactgctaaactacaaatgttaggacagagatttcaaaatgaggggagaggagaagtaataagcaatacatctggctctatatgtagaaaaatataagtgaatagtggcagagtgaccaagaaattataattttaattctaaataaggatttttaaaacaaaaactacatattgcaaggaaaaatataagaatctttgggtcttagagtactaaatatttcaatacttggatcttaaaatatgattttaaaaactctaggatttgatagtagtgggtggaaaacagattatgggaaatgaaagcattctaacaacaaattaattagttacagtttgttttcttttctgtgtggcttgttttcttttctttacagctggttttcatttcctttcaaatttaaaagagtgtatttaacattccatcttaaggcaatgtgataaccatgaattctttgtgtgagaaaggaaagagggaggttaatttttaatgaaagtcgatagtgtagaggaaagagggtcttccctggcatccttcagccatttacaacattttacaaaacaatgcaggtaagggaaaagctttcacccataactagaggaaaaaaggttctagctgcctaggttacagcagcctgtgatgtgactcaagcctcataattcacattttttaaggctcacaataatttagagttccaacagctttgactttgaattacttattttcacaataacacaaacaaaacttgatataataaatgcatatatccttagaattgacaatatatattttatatgaccatgatttgtacaaaaattgtatttgctgcaaaaaacattaaaatataaaacagtaaagatttttaaaaccacaaactctgatcctcatccaataaaatcagaaatatatcatataaaaatgaagtgacaagagggcagaatagaaggtaacccgctcatatctccctataagaattctgcatccatccatggtaaaaagtcactctgcaggagcctcaggattgaggtaggagtttgtgaaaccctagtgaagtccaagacatcagaggatcatttgcagagggaagacctacacataggtggctgatccaccaagcttgttcctgggttcaagccagaaaatgacccagtctcccaaggggtttggatacaaccccacttggccttgatcctgcaaccaaagccatctgccgaggagtcaagaaggaattgtgcacactaatagaaaggctcatctacccactgacagtcgtgttggcagtcaatctgaacgttgctctctggttctgctccagccccctcaggtgaggtcccagctcagagctgcttacataaggatccagagggagacttgcccataacttgcagcccagtagtctgagcctctcagacaggctagagcttgtaaacctctgttccacaacagataccaaggaggcccagtctcagctctggcctctcacactgcaaccaaggaactattccatctttacagaaacttgctgggagaatgtgtctctctgagccaatgagacagggctctccaggttctgccccacagcagatgtcaagggggccccatctcagcaacactccatcctgctgcagttggggaactatcccatctatgctgatacctgcttggagatgtatacctgtttaagccaatgagaagggctcttcagcttgtcccacagcagatcctgaggggccctagtaaccgctctgactccccctgctgcacagaactatcccatctatccagagacctactagaagatgcgtacccatataaaccactgggataagcatgccagtgtctgtctcacagcaggtcccttggaggtccagcctcagctttggtctttcctgctgcagtcgaagaactaccctgcttgtgcagggtactgctgggtgacatatatctgtctgagccaacaaaataggcccatcagcttccttcccataacagatcctgagagggaccaatttcaactccagcctcccttgctgcaggtggggacccatcccacatgtgcagaaacctgctgagaggcatgcacaggtgggatgggtccccaactggggatagccatccatcttggccaccaggacagtcttctggattcaggtccctgtccagcattcccacacagcccaagtaccctccttgagtcttcccctgatccttctgggctggaaagctgtgccaatctcatagtcctcatgagacttgcagcaagcctgtacttagagcatcttctactgctgagatggctgcagaggtcagaggctcagagaaaacaatagtcagactgtatagaatccctacaaggataagcacaaagaaagctagactacaaagactaaaatattaaataaatacttaacctatcaatacgcagacatcatttcatgttcacagcattaaaaacacacacggaaatatgactcttcatatggaaaaactaaggtgccagaggctgaccctaaagggatagagatatgcactttcttagacaaataatacaaaatagctgttttaagaagcttgattgacttctacaaaatacacataatcaattcagaaatgtatcagagaaatttaacagagattaaaataattaaaaaaaaaaaaacccagaaatcctggagctgaaaaatacaatgaatgaaaggaaaaatgcaatagatcagcagaactgatcaagctgaacaatcagtgagcttgaaaacagaatatttgaaaatatacagtcagaggagaaaaaagaatgaaaagtataaagaaagcttacaggaatgacaggacaacaataaaagagcaatcattcatgttacttagttaaagagggaaatgagaaagacaagaaggtagaaagctttttcaaagaaataataacataaaccttccaaacctggagaaagatataaatatccaggtacaggaaggtcaagggtcaccaatcactttcaacccatataagaatacccttaggtattacaatcaaactctcaaagatcaaagacaaagaagcgattatgaaagcaatgagaaaaaagaagcaaataacagataaggtagatctgaaatgcctggcagcagacttctcagtagaaactgtacaggccaggagaggtgagatgatatattcagagtgctgaaagaagtaaactgcaaagcaagaatactgtttccagtaaagctattcttcagaaacgaaggagagataaaggctttcctagacaaacaaaagctgagggaatttgttgctaccagacctgtcctacaagaaatgctaacgagagttctttaggccaaaagaaaaggataccaatgtgattgttacactaatattgtaattgtggtgtgtaaatcaattaaatctttactaagaagactaaaagataaaactactaaaaacaataactacaacaatttattaagagattagcaatataaaaatgtaaattgcagtatcaaaaattcaaaatgtgtgaggagaggggaattaatatgtataaggttttattttgttagtttgtttctttttgtttttttgtgatcaaagctaagttggaatcagttttaagtaacttgttataactatagaattttttgtaatcttcatattaaccaccaaacaaaaacttatgatagatatactgaaaataaaaagcaatgaattaaaacatactaccagagaaaatcacttaaccacaaaggaagacagtgagaaaggacggaactggaggcctttggtaagccaggcacagaaagacaaatatcgcatgttctcattcatatgtgggagctgaaaaagtggatctcatggagatagagattaaaatggtgcttaccagaggatgtaaaagaaaggcgagggaggtagggatgaagagaagttggttaaaggatacaaaaacatagaaggaataggttctagtatttgatgtatagtagggaaattatagttaacaataacttattgtatatttcaaagtagctggaagagaagatttgtaatgctcccaacagaaagaaaagatacatgtttgaagtgatggccatcctgattaccctgattttctcattacacattatatgcaggtatcaaaatattgcatgtacaactattaaatatcaattttttaaaaatttaaaaatcaaaaacacttttcaaaaagaaacctgtaagtcctaatgatggtggagtaaccataacactcctatactgcctataggagtatagaaagaaagaaaaatgaaagtacacatgaaagaaaaataaatttctatttggataaaagaaatagataatataaataaatacgatcttaaaaattagaaaaagcaatcaaaaacccaaactaagaaaataaaagctaaaattgatgaaatagaaatttttttacatggaagaagaatgcatcaactgaaaaactattcctttgagaggaccaataaaaacaacaagcttcatgagcctgattatggcaaaaataaaatatgcccacaagaaaaaatatacatgattaggaatgaaaaatgataactatcaaagaaagagattttttaaaaaattgtaagagccaggtatgatggctcatgcctgtaatcccagcactttgggaggccaaggcaggaggatggcttggggccaggagttcaaatagcctgtgcaccatggtgagaccctgtctcccacaaaaaaactaaaaaactagccaggcatggtggctcatacctgtagacctagctactcaggagcctgaggcaggataattgcttgagcccaggaggttgaagatgcagtgagctataattgtgccactgtactctagcctgggtagtagagtgagaccctgtcacagaaaaaaaaaaaaaaaaatatatatatatatatatatatgtatatgaatattatatgcacatctgtcaaaacaaatttgagaaccaggaggaaattgctgatttcctagcaaaatacaaatgtctaaaattgacctaagaaatagaaaacattaaaaggccaatttccatagaatagatttgaaaggtgataaaccatagctgtccaaagatgtctgtgttctaacccctgaatatgtgaataaagtatgttattttatatggcaaaaggaactttacagttgtgattatgttaaggatctagacatagagaaagtaccttgcattaattccaggtggccccaatgatgtaattgcaagggtctttataagagggagtgtggtaggctgaataatggcccccaaatatatcgaagtcttgatccctggatcctatgaatattaccttatatggcaaagggattttgcaggtgtgattaaattagtaattttttttagatgaagagattatcctgtattagctgggtgggccctaaatataatcacaagtgtgcttgtaagaaggagaaagagggagatttgaccacagtagagggtgatgccatcatggaagcagagagagatttgaagacgttatactgctacctttgaaaatgaaggaaagtgcaatgagacatgtaatgcaaatggcccctaaaagctggaaaaggcaaggaaacggattctcctccagagccttcagagggagtgcagtcctgctgacaccttgactttagcccagtgaagctgattttgtacttatgacctctataactataagagaataaatttgtgttgtcttaagcccctaaatttgtggtaatttgctacagtagaaataggaaactaacacaggtgaatttttctttaattttttaattttttattttttattattatactttaagttttagggtacatgtgcacaatgtgcaggttagttacatatgtatacatgtgccatgttggtgcgctgcacccactaactcctcatctagcattaggtatatctcccaatgctaaccctcccccctccccccaacccacaacagtccccagagtgtgatattccccttcctgtgtccatgtgttctcattgttcaattcccacctatgagtgagaatatgcggtgtttggttttttgttcttgccatagtttactgagaatgttgatttccaatttcatccatgtccctacaaaggacatgaactcatcattttttatggctgcatagtattccatggtgtatatgtgccacattttcttaatccagtctatcattgttggacatttgggttgattccaactctttgctattgtgaataatgccgcaataaacgtacgtgtgcacgtgtctttatagcagcatgatttatagtcctttgggtatatacccagtaatgggaatggctgggtcaaatggtatttctagttctagatccctgaggaattgccacactgacttccacagtggttgaactagtttacagtcccaccaacagtgtaaaagtgtacctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattgtctcccattttgtgggttgcctgtttactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtcgaacatttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtagatatgcggcattatttctgagggctctgttctgttcctttgatccatacctctgttttggtaccagtaccatgctgttttggttactgtagccttgtagtatagtttgaagtcaggtagcgtgatgcctccagctttgttcttttggcttaggattgacttggcgatgcaggctcttttttgtttccatatgaactttaaagtagttttttccaattctgtgaagaaaggcattggtagcttgatggggatggcattgaatctgtaaattactttgggcagtatggccattttcacgatattgattcttcctacccatgagcatggaatgttcttccatttgtttgtatcctcttttatttcattgagcagtggtttgtagttctccttgaagaggtccttcacatcacttgtaagtttgattcctaggtattttattttctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctaagacaatggggttttctagatatacaatcatgtcatctacaaacagggacaatttgacttcctcttttcttaattggataccctttatttccttctcctgcctcattgccctggccagaacttccaacactattttgaataggagtggcgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgtccggctttggtatcaggatgatgctggcctcataaaatgagttagggaggattccctctttttctatttattggaatagtttcagaaggaatggtaccagttcctccttgtaactctggtagaattcagctgtgaatccatctggtcctggactctttttggttggtaagctattgataattgccacaatttcagctcctgttattggtctattcagagattcaacttcttcctggtttagtcttgggagagtgtacgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttggtagcggtctatcaattttgttgatcctttcaaaaaaccagctcctggattcatggattttttgaagggttttttgtgtctctatctccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgctcagttcccatgtagttgagcggttttgagtgagattcttaatcctgagttctagtttgattgcactgtggtctgagagatagtttgttataatttttgttcttttaaatttgctgaggagtgctttacttccaagtatgtggtcaattttggaataggtgtggtgtggtgctgaaaaaaatgtatattctgttgatttggggtggagagttctgtagatgtctattaggtctgcttggtgcagagctgagttcaattcctgtgtatccttgttgactttctgtctcgttgatctgtctaatattgacagtggggtgttaaagtctcccattattaatgtgtgggagtctaagtctctttgtaggtcactcaggacttggtttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacctctgcctttttttgttttccatttgcttggtagattttcctccatccctttattttgagcctatatgtgtctctgcatatgagatgggtttcctgaatacagcacactgatgggtcttgactctttatccaatttgccagtctgtgtcttttaattggagcatttagtcgatttacatttaaagttaatattgttatgtgtgaatttggtcctgtcattatgatgttagctggttattttgctcgttagttgatgcagtttcttcctagtcttgatggtctttacaatttggcatgattttgcagcggctggtactggttgttcctttctatgtttagcacttccttcaggagctcttttagggcaggcctggtggtgacaaaatttctcagcatttgcttgtctgtaaagtattttatttctccttcacttataaagcttagtttggctggatatgaaattctgggttgaaaattcttttctttaagaacgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgctttgctagattgggcaagttctcctggacaatatcctgcagagtgttttccaacttggttccattctccccgtcactttcaggtacaacaatcagacgtagatttggtcttttcacatagtcccatatttcttggaggctttgctcgtttcttttgattcttttttctctaaacttcccttctcacttcatttcattcatttcatcttccatcactgataccctttcttccagttgatcgcatcggctcctgaggcttctgcattcttcacgtagttctcgagctttggttttcagctccatcagctcctttaagcacttctctgtattgattattctagttatacattcttctaaatttttttcaaagttttcaacttctttgcctttggtttgaatgtcgtcccatagctcagagtaatttgatcatctgaagccttcttctctcagctcgtcaaagtcattctccatccaggtttgttccgttgctggtgaggaactgtgttcctttggaggaggagaggcgctctgctttttacagtttccagtttttctgctctgttttttccccatctttgtggttttatctacttttggtctttaatgatggtgatgtgcagatgggtttttggtgtggatgtcctttctgtttgttagttttccttctaacagacaggaccctcagctgcaggtctgttggaataccctgccgtgtgaggtgtcagtctgcccctgctacggggtgcctcccagttaggctgctcgggggtcaggggtcagggacccacttgaggaggcagtctgccggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagactccgtgggcgtaggaccctccgagccaggtgtgggacacaatctcctggtgcgctgttttttaagcccgtcagtattcgggtgcgagtgacctgatcttccaggtgccgtctgtcacccctttctctgactaggaaagggaactccctgatcctctgcgcttccgagtgaggcaatgcctcgccctgcttccgctggcgcacggtgcgcgcacccactgacctgcgcccactgtctggcactccctagtgagatgaacccgctacctcagatggaaatgcagaaatcacccgtcttctgcgttgctcacgctgggagctggagaccggagctgttcctattcggccatcttggctcctctcaggtgaattttgatctaccattaaaacaaggtgccaggaccggatgtttcgtaacagtgctctctctaactcttaaataacagatagttctaatcctatttaagctccttcatttattttatgaagtcagcataatcctaattccaaagccagatggagaatataaaaatgtaaaactcttacaaatgaatctagatacaaaaattctaaataaattattagtaaacaaaatctagcctctaataaaatgaatattaccaagttgtgtatattttaggaatgcaaatgtatgatctaaaatcaatcacttatcactcattacaacagcaaattaaggaagataaactacataatcatatcaacacttgctgaaaaggtgttgataaaattcatccatctcccctaataaaacctcaacataacatagaaatagaaggaaatcgatgaaaaaaaatgaatggcaagtacatgaaatataataagctctcattcatttaatatatacttaagtagttcctagtaccaggcacactctggtgatacaacagtgaacatgatagatacaatctgtgctctgcaaggcttacagtacagtgggagtgactggaaatttattggaggctttgatgtggaagaaggatatggaaatccatgagaaaacactatgcttagtcagggccatgtgacaatagaatttctgcagacagtgacaattaaattgagatctgaaaagtgagaaagatgtatacagattaaagagaggttggttggagaaaatatttctgggatagagaataacccttacaaaggcctggataggagagaacgaaagtaagttgagtatggcgaaagtacagagcaagagctcaggatgaagtgtgtaatacaaactgcgaagaaaggctcagcccagatcaggaaggctttggaagccaaatttaggagcttggactttaccctacatgcaatgtgaagacatggctgggtgttaagtagaagagttgcactggttcttttgtttcccatacctccagatccattctctgccctggaaatcagatccccatagggtctgtcacccactctcccttgcctactggcttccagatgggttcagccaatgcggtgccttttccctgggtccccttgcttcagtgctacacccgatagtaaatgtatccctccttgaacacaggtcctgccaggcagcccttttgtggctccagctttcactgagtaactatttcttgtctcttcagacctacagataaatatggcttcccctgtttctagtctctttcattctgcccacacctctgtaagtagccctttcatcaaagcttttcatttgaaccatctgaattaaagtctatttccttttgggaccctgactgatacaggcatgattaggtcagatttgtgttttataacaatccctctggctgctttatggaaaacagattggaagatggcaaagaccggctccaaggagaccattaaggaggctgctgtaattctggaggtaagagaggatggtggcctgggctcaggtagcagaactggggttcaggagtgaggagtttaactcctggccaaaaccgtatgtgtgatatttcaggcccagccacaggcaattgcaaaggctttgcctggaaggcctcataggaaaagctgcccttcccacaccagacttggtacagagccaatgcattgcagtgtctgaggagagttgcagtcaaagattcaggcctcctggccagctatgctcttatacatatctgcattcatggcccaggcacctccatttggaagtcttcttcttttcagggaagcttgaagacactttacccactctgactcagtactcgatattttctacttgcagccctcccattcttcctcacttctggctccagggtccataaaactgcaggtgccttttggttggagatccctaaacagtgagttgactccaccaacacactgttccactgggggaaatgaaacaaaggggagtcaaggtttgactgttactttcattttggctatttttaatcagctactctaacgcctgaaagcttagctgagtggctgatggaaagaagcatgtagattccagagatatttggacgatagagttgacaggatttggccatttattagattgggggatggggtaggatagagaacagtgagggaaaataaaaagccaaggaaactgcataggtgatttgggcaatagagtggatggtggtgccattcactggaccatgaaacaaggaacaggagctgagtggcaggaaaatactttcatctggggcatgacacttcagagaagcctgtgggtcatccaaggcagatattcagaaaacagctggatatgtaaaaaggaatttagcggagaggtctgaattgttatgtagatttgagaatcattcattaataaatggtaagtatagatattggcatgaataaaatgaagctgggagaatacatagaatgagaagaaaagatggcctgaaactgaggctcaccatggtctctttttagacttgtcctcttttggttctctagataattctccaatgatatgtttttctatgaccctctcaaaacctttcttaaacttactaaataaaatagagacagcaggttataatgacagagcttggaacattatagatactcagtaaatgtgcacaaccttcctttctaactctgtatttctcaggattgtgttaagaatcctgagttaattaaggttcctggctaaagacaaagctatgtctaaatgaaggcagctgttatcatacttgcaggtgctatatttctttaaataatgagttttatatatttactgtaaaggattcttttagttcacatattatttctcctaaacagcaaaggataccacctttaaaccaaaccaaaccaagtcatgcctctgagtgaagttgtagaataatttttttgaaactttaacattttaattttctattagcaagctaaaacaaagcagaggctaaattccatagtctccagaaatatggggatcgctatatgtaagtgtattagtccattttcatactgcccaagactgggtgatttataaagaaaagaggtttaggagccaggcacggtggcttacacctgtaatcccagctacttgggaggctgaagcagggaaattgcttgaacctgggaggtggaggttgcagtgagccgagatggcgccactgtactccagcctgggtggcagggcgagactccatccccaaaaaaacaaaacaaaacaaaacaaaaacaaaaagggaaggaaggaagggagggagggagaaggtgaaggggaaggggaaggggaagggggaggaataagaaaaagaaaaagaggtttaatggaatcacagttcaacatggctggggtggcctcacaaccacggtggaaggcgaaggaggagcaaaggcatatcttgcatggcagcaggcaagagagcgtgtgcaggggaactgccctttataaaatcatcagatcttgtgagacttattcactatcataaaaacagcatgggaaaaacctgcccccacgattcaattacctcccactgggtccctctaatgacaagtggggattatgagaactacaactcaagatgaaatttgggtggagacacagccaattcatatcagtaagttcatcctgaaaggctgagagtaaagctatcataaagatggggatttcctgcttttctcattctgtttatatttttacatcctgttttgtctaaagtgttcttttgaaacaaagacctggaaagaagtccaagtagactctgacctctcttgcatctcctgtacccatattggaggtaatacatatcccatacttctatgaaaagaatgcaggtcttggaatcaggctgacttgggctcaaatatgaacttcatcactaactagatatgtgagccttaattcttctgtctttgtaatgagaacttctttggggttctgatctggattaaacaaaacattgtgtataaagccccaggcacatagtaggtgctcaacatagtaagtgctcaataagtggtagccacagtgatatttattatgaagtgggccagactttgggaggaagaaagaaggtaaagaaagatatagaccaaatgggaagataatgtcatggctttaattcacttttcatggaaattagaagagattgtgagtaacagaaggtcacttggggagctgtccagggtgcagaggatgccaagaaatatttatctgattgaagaagagagttgaaagttcattaaaacttctgtttacatttgagcaaaacctgctcttaataattactctcaaaagttgcaagctaaagtaactagataattcaataaatatatagataccaggtctgaggctcagaaggactgtccagggtgggtcaccaagctccaggccaccagactagcgacaagagttaggctgcaattcccaggaaggaagaatggaagccattatcccagaggaatatagaataggctatattctatagggtggagggaggaaagtagagaacagtacctggtaacagggactgcaggggtagctggttttgtttgtgtgttttctgctcaggaacaatttccatatctttgggtgacagatccctattttactttgccaaaattacctctcctagtgaaggtgcaggccttcccaaggttaccaattcattttcttcctttgaatgttgaatcttcagtagatatttaaaaatgaaaaatggttagtatgaattcctctgagctttgcagcactcatcccggggacactgactcacaacacagtttatatgaaaagaggggatgctcatcatcccctgaagttcaagacgaggctgagaaacatagtgggactctgtctctacaaaaaaaaaattctaaaaattagtcatgcttggtggcacacacctgtagtgccagctactcgggaggctgaagccagaggataacttgaggccaggaggtcggggctgcagtgagccatgattgcaccactgcactccagcctgggtgacagagtgagactttgtcacaaaacataacaaaacaaataactaaataacaaaacaaataacaactccctgggaaagctgacttttagcttaattcctgcccttcaatattctctatattgtaaggtgctaaaaatttacaaactagattcccaagtttcctaactaggtagtttccagttagattttcccaaaggcaggtctcagagaaagaccagaaggcaaaagggagaagctattttatcctccattttctgtttctggatctggcagtagccacaggcagccacaggatccagacgtcttggcagtgagtccagtaacatcaaggggactatgggctcccaagttcttgcagcttctgtaaatgtgcaaattctcagcctcttgaaaggtaacagcagcagtggtttcaatagcagcagcagcagcattaacaaaaggatgctggcaacctcagcaacatagctcttttgaattctgggtaccatcactggccctttttgcccctccttggattttattctctctgtttgaatgcctagagaaattctgcctttctaattgaacaccaattaataactgagagtgatttactattacacttttggtgggaatgttaacacatgagtacaatcagtaagatgcagtacaattgaacagacttgtgtttaaaccaggctcccccacctattagcagtgttatcttaggcaaataacttaaccaaacctcagttttccttatctgtaaaatagggatgatagaatccctcataggaatgttacataaattatgacgtaacgttttatatgtaatgatataatgtatgtaaaaagtacctggcacaaaggcgttcaacaaattttggtttcctacatctctttcacccagcacttgcttggttatggcttaggtgcatgaacacagacacattccagagatgtttgactcagtcaagcttctatcaggaactagggtacaatagaaatggattacatgaggaagtcagatatggaggaaaaatgaagtagttgctgacagggagtgttaaatgggatttctagaaaggacacttctcagaagagaaacatgatgcacaacaaattttaaacccttacttagtgacagcctaattcaaatcacaaacataggtctatactcagaaaaattatgttcgtacacactctttggaagagagaaaccctggctgctggtcttattgtggataccttcataattcacttggaagatggaacagattattattattattattatttgagacagggtcttactctgtcacccaggctggagtgcagtggcacaacctaggctcactgcaacctccacctcccagactcaagtgatcctcccatctcagccttccaagtagctgggactacaggcacgtcaccacacccagctaattttttgttttttgttttttgtatttttgatacagacagcatttcaccatgttgcccaggcttgtcttaaaactcctgagctcaagcagtctgcctgccttgccctctcatagtgctgggattacaggcattgagccaccggaccctggccagaagatacaaaattattttgtatctgtccgtggagacatttcacacttattataatttagtataagtcatggtgaatgtaaagagacaaatatggcttttcacaaggtgcccctttgacccttcagagcactagatctctaaaatgaagtatttggagtccaaaagatataaataagaataagaggtcatgatggtgtcttcatgagaaaagattgggaattaaagatgtttatgctgaaatagaattataagatactagtagtggatgatgctttaaagactctcacctctcatattttagatcagagaacctaagctcagaggaggaaactgttcttaaattacacaaaaatttggaggcagaaatgtcaccaggtttcttatatctgggaaagagaccaaaaaaaaggtattatccttctggaacagtcttggccagagcctttctcctctaagagtgggactggacaatggagccaggtcagtggtgggtctgtgccattgactagtggagagctcccacataaaaatatgccaccctttgagtgcagccacggatgttacaatctagtattgagtaaatggacacttgattttacatatctccttcaatatatttcatcataatattaactgtcataactacaaattatcaaaaattccctacttttgaaaaatgtacataaaatgaagaatgatggctctcctctgtcctagcaagggacaaagattggcctagaaagcaggtctcttgatatccagtccgatgtcctttccagtttccccaaaataatagtagcattcaaaggtattaaaatatagtgccttacatgggtccaaaaggcagattttgttcttgcttgaaaagagagctgtaataaatagtctaaatttctagcaggcatagtagaagaacctaaggtaaatgttttaattttatgctaatggttactaaggattatcatagaattaccatttttggggaacttgaaaaataggtgtgacaatttgagggatgaaaagataaccaaaaaataaatttagctcctgctgttgccactgaatgtgatgacaaatgatacagagaggtcattctcacaagacctaggctaggccaaggagaatgaagaggagacatcacaccagcatttaacttaagaaatcagctgtgtgggtggctgttgtggttgcttttaacgactagttaaaaaaaaaacagatttattgaaataattaataattcacatacacacaattcacccacttaaaagtgaacagatcgatggtgtttatactatattcacagttgtgtaacttcagccagaatattggaatattttcatgacctcagatgaaaccccatacccattagcagttcctccctttctctcccttcttcccaccccagaccctggcaaccactaatctactttctatctctttggatttgcctattctggaccttgcatataaatggactcacacaaaaaactcactgatacgtagtctttcgtaccttgcttctttcacttaacataatgtattacaggctccttcatgttgcagtatgtaccagtacttcattgctttatactgtcgaataatattccattgtgtagagcgtatactgaggagtgaataactgggtcatataagaactctacgtttaatcttttgaggaacttccagattattttccaaagtggctgcaccatttcacatccctaccagcaagatctgaaggttccaactctccacatctttttcaatacttgttattatgtctcttttatattttaaccatcctatcatgtatgaagtgatatctcactgtggttttgatttgcatttcctgatagataatgatattgactcttttcatttattgttggctatttgcatattttctttgagaaattgcctttttttgaaagatagttttgctggacataaacttgttgattgacaactttttgtctttcagtaccttcaaaatgttaccttcttgccttctggcatccattggttctgatgagaattcagctgtaagcatcattggcattccactatacatgatcagtcctttttctcttacgctttcaatatttttgctttggctttggctttgaacatttttacagtaatgtgttgtgtgtggatttctttgcatctatctcacttagaattcattgagtttcttagatatgtagagtaataatttgtatgaaatctggggactcttcgaccatgaattctttgaatactttctgctctattttctgtctcctctccttatagtacaccaattacacttatgtctgcacggttaatggtgctctgacacttttttcccattatttttctctctgttcttgagatagcttaatctctctcagtctctcttcaagtttacccatgtttttcttcctccaaaaccaacaactgaaggtaccaaatagagaataaaaacagatagatactgagggaagtcaatgctgggcagaaaagaacagacatcaactcccattttgcgtatgtgtgttttcaccatgtggggtggctaaaactcttatagaaaatcctagttttactggcttaagaatcagagaaaaggacttgtgtttggggaactagatccactggaaagtgaagaagaaactcccagaaaggagagagccaaacaatgggtctcatattctaggtacaaaattttcccaaatctctgagtgatccttgaacatgactattggggaaagactcaaagcaaattagttaaagttaaaggaattgaagtaaaatttcagctacactcatcacagtggaaatacagtgttacagtttcattctataaaagttaaatatatgcttaaaatcagtactattcagaggaacattcagattccggaatttttacaacacatcattcacaatattgaggatgcaatccaaaattatgcaacattcaggccggatgcagtgcctcacacctgtaatcccagcactttagagggctaaggcaggcagatcacctgaggtcaggacttcaagaccaacctgcccaacacagtgaaacctcatctctacaaaaatacaaaaattagctgggcatgatggtgggttcctgtaatcccagctattcaggaggctgaggcgggagaatcatttgaacctgggaggcggaggttgcagtgagctgagattgcattattgcactccagcctgggcaacacagcgagactccatctcaaaaaaaaaattatacaacattcaaagaagcaggaaaacatgaccaattcataggagaaagattaatagaaaacaagctaggatgacccagatgttggccaacaattatttaaaactgtatattaaaatgatgctcagtagtaaaaaggaaaatatgctcacagctaataaaaagtgggaaatttcagcagaagaaaagagattatttttttaaagcccaaatagaaattctagaactgaaaaacaaaacagctgaaatataaaattaactgggtaagcttaagaaccaaatggaatgatggaggaaagaaacaatggacttacaagtcaatagaaattatctgatttgaagaaggcagagaaataaattttaattaacagagcctatggatctgtgagacaattcaaaactgaagacctgaaagaagacgagagagagaattgagaggaaaatcatggcccaaattccctaaacgtggcataaaacatatagttacaaatttatgaagcttagacagaattagtagaaaaaacactcctatttacatcataatcaaactatggaagaaaaatatttgaagacaaagaaaaatgacacattgaatacagggaaacaattaaaatgatggctgctttctcataagaagcaatagaaggggagtcacaagacagtgaaacagagttcatgtcctttgtagggacatggatgaaattggaaatcatcattctcagtaaactatcgcaagaacaaaaaaaccaaacaccgcatattctcactcataggtgggaattgaacaatgagaacacatggacacaggaaggggaacatcacactctggggactgttgtggggtggtgggggggagggatagcattgggagatatacctaatgctagatgacgagttagtgggtgcagcgcaccagcatggcacatgtatacatatgtaactaacctgcacattgtgcacatgtaccctaaaacttaaagtataaataatgaaaaaaaagaaaagaaaaaatgtacaccaataaattaaataacctagaaaaaatattaaaaagcataatcaaactaaaaaaataaataaataaataaagtacaagggaaaagcttgtccacttggaattctgcattcagcaaaaatgtctttcattattgaaggtgaaataagagtatcagggaaagaaaaataagagaatttataaccaccatatcggtggtgaaaccaaacaaacaaacaaacaacaaaactgaaataaattcttctagtctaaaaggaaataaaccttcctatgtgccagggcccaccttaggcacggaaatacaagtttgagtataatgaggttcaccatggagtttatagcttatagatgaaatggaaaccaaacattgtacttcatggcagtaccaatgggagcaggaatgcctggcctcaataacaataggagccagaaaccacacatgtatttactaaaatgtctttcaagagggcacacctgtaagtctctgcattttgccacttatacaacttcatctttgagcgcttacatagggtcagattacctaacaatagctgtaagccaagacaaaattggaggaggagagaattagtagatacctgatacaggatataagggctaagctttagatttttctatcctgactcgatccagggtatttggtttctattgtttttcactaaataaagataggtctttcaacaatcccagcttctgtggaattagctgaaaataaaccaagagctagagactcaaagtatttacagtagatacatttgagtaggtatattgctcaagtcacactgtaactgcccagtgggttcattttgcctgctgcccagataaactcaatttattaagacagaggaattgtaatagacaaagagtttaattcatgcacagccagctaaacagaagacagaaaattcagagattggagttttttaagggcaatttggccggtagggggccagagaatgaggagtgctgagaagttgggttggagatgaaatcacagggggtcaaagtgggttcttcttgctgtctttggtttttggacaggattgcagaactggtttagccagattactggcctggatggtgctagctggtgcatcagaattttagggtctgaaaaacatttcaagcactaatcttgggttttacaatagcgatgttatccctaggagcgactggggaggtttggaatcatgtggcccctggctgagtgactcctaaaccaaaatttctaatcttgttgccaatttgttcgtcttacaaaggcaatctggtccccaggcaagaaggacattcatttctggaaagggctgttatcatctttgtttcaaagttaaactacaaactgaagtcctcccaaaagttagtttggcctttgcccaggaatgaacaagggcagtttggaggttggaaataagatggagtcagttaggtgagatctctttcacatcataattttctcactgttacaatttttgcaaaggcagtttcaataccacagttagatcaacaaatattttgaaaatgggaaaaagggccttttcaaattaattttttaaagagataaccccagaaggtcttgtatggggtggaaaagcaataggaaaattatataatatgatgattctgtgaaactagtgggtcagaaataagtgtttacaggccagggcctggtggcaccagaatgagctcttggaagtagctggctttgtgtgttgggtccatatgctggtgcacccatgtggctgcatacctgatctgggtgggtgccgaggcattgtcacccctgagcattgcctaggcatttctcgtggcccgctagagaccagtcccactcccttgtcccctccttcccctgcactctctaagaagttcatctgctccttccaggactgtatgtagcaccaattacaataaggtccagatgcttgaagagcacctatgcaagcacacgaggaagagaccattcatttgtgactatgaagggtgtggcaagattttcctcagggtctaccacctgagtcacaacatcctgattcatatgggagaaaagctgtttatgcactagtggctgtgacagaaaattcaacacaaaatcaaacttgaagaaatattttgaacacaaagatgagattcagcaaacaacatatatgcaattttgaaggctgtaaaaagatctttaaggatcagtagctgaaaatccatcagtgccagcataccaatgaacccagaaaggatgtgggaaatactgcctgacccagcaggctgaaacgacacacggaggttcaggagggctagatgtcaaaagagatgttcctttgtggcaaaaacatgggttgaacttctgaaatatgtgaggaaaaaaaacccatatagaggaaataacatgtgaatatggcagaaaatttttaaacacaaagattatcttaagcaatatatgaaaactcttgctccagagagaaatatttgccaatgttcaagagaaggctgtggtagaacccacatgactgtatttaatctacagagctgtatcctctcttttcatgaggaaaggcacctatttgtgtgtgaccatcctggctgtggcaaaaggtctgcaatgaaagtctcacatagacataccattgcaacaagaagaaaattaaactcagagtaaaaccaactcatgaaaaacggagttcggtggggtgtaatggctcatgccactttggaaggctgaggcaggcagatcattgaggttaagagtttgagaccagcctgggcaatatggcaaaaccccgtctctactaaaaatagaaaaattagctgggcatggtggcgtgcgcctgtagtcccagctactcgggaggctgaggcaggagaattgcttgaatccgggaggcagaggttgcagtgattccagtcacgccattgcactccagcctgggtgatgaagcaagactccatctcaaaaaaaataaaataaaaagaaaagtacaaagggagtttggcctctggtctcagtggatataccccttctgaaaggaaacaaaaataaggtttacctttgtctaaaaatagaaagacactgaactgtactagagacgtggtgcaataacttaaacctcaactaaatatcacattactttgtttaaaggactacaaaccagtgagctttctttctttcagaggcgtattttttaattaaaatcactgatgcagaacaacaatgtgttttccatgtgcacttggtcaacacctatatctttactgtgtctcctatgagcaggtactggacacggaggatgtaaaaaaaaaaaagaaataaaaatgaggcaccatcagggatttcctccaggaggcagtgtcactctagaaagacatgagtgacccagggattatgtcgccagcttcaattcagtctagattcctggccctcagagagacatgactgctgagggcagtagcctaaaaaaggaaacccctggccttttggctggatgcctctgtgcacccctccaggcccactctccacctcccacaaccctgctttatgaccacagaggctgactttctaggctgctccactgggcaaactttctctcagtcaaggtggtgggatttagtgagctttcactaagtgatgcttcatggccaacaacctcagattattacgataaatatcacttcctatttcacgttacataagggctcggggtaggtggtacatctgtggctgtgtggctcagctgcaggtgtggtgacaccacaggtctgttgcatatgtctgtcttctcatccagggacccctactgaaggatcaatcattcttggggcatacactgaggttagagcttttctttcctgagcttcctccttaccaggattttgtggttggcagattccctgtactgaatccttagctgctgcctaacaaccccttcctagagctgtgttctctgggcccagtctctgctccttcttgactcttggctacagaaagtagcaccatccttgaaagaaatgcaaccctgccagtaccgtgatctttgtctggtgagcctggtgttggacttctctgacctgtaagattatacatttgtattagtttgagccactaggtttgtggttatttattatggaagcaatagaaaagtaataaaatctctctcctgttttcaggtagtaaaggaaatcttgagccttgaaaagcacactcctgggatgatgaaaagaatgcaaccactgagtgtgccaagtagcttagcatccgcttagctcttcccgagattgtaaaccactcttcctgatctgaaccactcttcctgagattgtaaacattgctcaaggctatttaccttagaaataaggaaatttgcagactctataaaacatcccttacagttggtaaaacttactgctgaatcagttaaacaataaggccttgcgtgaaaggaaaaataacgtgagttggggcagcccaagtgggaaatgcctctgcataggggagtggcatgagaaaacgacactagtggaaaggagtagggggtgttccatggcggggatgaagttgcccaaagtaaccaccctaacaatagatgatctggaagaaaggaccatagactggtacagaagctgtatccaaagtcagactacaaatcctcgacttatcttctcccacctcatttctcaccacgctcagtccagcaatactccaaggaagaacacttctttggtgtagctcccacatatcttctctcctggcttgtgatatgcacctgtcataacttcctgggaggggaagactgaaggctgtttctcttagaacatgctgtttctcttagaacatgctgtttctcttagaattttctcaggtatgaaccaatgcaggacattcctatagattggtggttttcaaatctcttctgcagaatcctagaatctcgaggcctcccgcaactgggatagtttaagcaatagtgatcttattccccttacttctcctttgactacaggagctctgcatctatatgttgacatgtatgaattctgtgttgagattttatttgatgtaagtttgtgcttttaagaaaaatctgaaaactactgagcaaaatcaagtgtagtagtgcatggagagaatattttctgtcccagacttgcctgagagctcactgtagaaaagattgggcatttgatgccaagtatagtagtcccccttatccatgggggttacattccaagacccccagtggatgcctgaaaccatggatagtaccaaaccctctatattatactgtttccccccatacatacatacctttgataaagtttagtttataaattaggcacagtaagagattaataataactaataaaatagaatagttataacaaaatactgtaatcaaatttatatgaatgtggtctctctctcattctcaaaatactgtaatattttcagaccactgttaactgcagaaagtgaaactgcaaataagcagggagtactgtacctgctatttctcaattagtgcagcttatggattacttttctaggcaccagggatggaaacagagagggaacttggcctctgtgatttccacaaaacaaacaaaaacgaggcttattggtgtatagcagactagacagttctaaatcctggcaccattcaattgacaggcagcactttcctttctagctacatctcttatcaaagaaagaatgaactagcaaacaggttgagagtaaaatcaaacattggcttgatgatctcccaggaagggcagttgtctgctgcccagcacttctcttcacccataaatccacaatacagcgcgttgggatctgtccagtgatcactgaacaaggggcatgaggagcacaggtagactacattttccagagattttcatgtttatatactggatgctaatgagcaaacctctaatggaggacccactgattatttttctaaagggttaaatacgtgttctaaaaaaaaaagtgttaagtaaaatttttcagaattggctgtggagcacgtaactcactcttcataccatgtggggatggtaggcattctagaatgtcttccttctatccctcagctcctctctctctcccccttcttctcaatcccatcatcttcccctcacagaactctcactatgtatcacttcctggtgtccctgttcccttcctcaagacataccatccttacctctccacaatacaatgtagatttcagccctaagtcatccagaatcttgcaacctgtcgtcacctgagacttcgtatgcctgtcactaggggatctgctctggcttccgctcagtgtcctccacgaggaaactctggtccctttcaaagggggaggaaggaaatggtggtgcttcgatttcagctcagtctctttccacgaaagtttcttcacaagaaggcaaacacaacttattaatgaaagaatgtctcttttcttcctactagctggtctggtctatgtgaagaacatagatctttatcatctcgattgtgacctgacttcttatgaaataatcaccctggtgtaatggtcctaaaatactagacttctttcctgacctggatttttcaaattaatggtgttttatcataatctttttattgtaaggactagcttaattgccttgtgaccagagaacatggtttgtttgaaacagcaaccctcatatattctgttgggagtgtaaaatggtgcagccactacataaaacagtttggcggttcctcaaaaagttacacatggtattaccatatggcccagcaattccatcccaaagtatatactcgaagaattgaaatcaggtatttaaatgaaaacttgtacctaaatgtttacagtaatgccattcacaatagccagatggtggaatcaattaaaatgttcaccaacttatgaataaataaatagaatgtggtatattgacataacagaatattgttgagacataaaaaggaataaggtactgatacttgctacaacatgaataaaaacattatgctaagtgaaagaagccagacacaaaatatcacataatgtatgattccatttatatgaaatatccagaaaagacagtccacagaaataaaaagcaaattgatggttgccaggggctagaggtaagggaaaatggggaatggatgctttatgcatacaagatttccttttggggtgatgaaactgtttggaactagacacaggtaatgttacacaatattgtgaatgtactaaatgctactgaattgtacattttaaattggttaattttatatcatgtgaattttacctcaattttaaaaaattacttttaagtggacatttttgtaaaagctgtttcatattctccacatactcaacaatagttatttttcctttttttttaaaaaaaaattacatgcatcctagtgggtgaaaagtagcatttcactgtggttttgattggcatttccccaatgactgatgacactgaacatgttttcatgtgcttgttagccatttgtatatcttctttggagaaatccccattgaaagcttttgcccattttaaaattcggttacctttttggttttgagttataagagttctttacatattctgcatattagatccttattagatatatgatttgcaaatatttccttccatcctgtacgctgtattttcactatcttgatagtgtcattgaatcacaaatattttaattgtattgaagcctagaggtggtggctcatgcccataatcccaacactttaggagtacaaggcaggaagatcacttgagacaattagcttaggaaacattgcaaaaccctgtctctataaaacatacaaaaattatctgtgtgtagtggcatgcacctatcatcccagctacttgggaggcttaggtgggcggattgcttgggcccaggaggtcaaggctgcagtgggccatgatcatgccactgcactccagcctacgcaacagagcaagactctgtctcaaataaataaataaataattgtaatgaaattcaatttacctattttgtttttacttctgcttttgttgtcatatctaaaaaatctattaccaaatctaaagtcatgaagatttactcctatattttcttctaagagttctatagctttaactcttacatttagatttttaatccattttgatgtattttgtatatggtgtgaaacagaggtccaacttcattcttatgaatgttgatattcagttgtctcaacactatctgtcaaaaagactattcctcaagacaattcctttcctcattgatttttactcccttgtcaagaaccaattgattatagatgtgaaggtttgtttctggactctcaaatttatttcacttatttatatgtatatcctctgtcagtatcatactttattactgttactttatggtaaggtttgaaattggaaaacatgagtactccaactttattctttttcaagattgttttggcttttctgggtctaaaattctgtatcaattttagaatcagcttctcaatttctacaaagaatccagctggaatttggcctagagaatgtgtagaatatttagatcaatgtgaagcatgttgctatttaataatattaagccttcttagtgataaacataggatgtctttccattcatttaaatctttttaaatttatttcaacaacattttgtagttctcagtattcaattagttcacctccttagttaaatttattcctaagtatttcatttttgacacaattgtaaataaaattgatttcttaattttcttttctgagacattgatattgtgtaaaaatacaattgtttcttaagtgctgctcctgtatctgtagctttgctaaattcatttattacctctaatagttttttgtgggttctttgggattttctatatatagaattatgtcatctgcaaataaagataattttatttcttcctcttccaatttgtctgtcttttatttatttatttatttattttgcctaattgttctggataaaatttctggtacgatgttgaacaaaagttttgaaaatgggcattcttcagaagacacctcatacaggaaagccctggctggcatctggcaggtgcccctctgggacaaagcttccagaggaaagaacaggcagcgatctttgctgttctgcagcctccgctggtgatacccaggcaaacagggtctgaagtggacctacagcaaactccagcagatctgcagcagaggggcctgttagaaggaaaactaacaaacagaaatgaagagcacctccacttagagaccccatctgaaggacaccaacattaaagacaaaaggtagataaatccaaaaagatgggaagaaaccaaagcagaaaggctgcaaattctaaaaaccagaatgcctcttctcctccaaaggatcacaactcctcaccagcaggggaacaaaactggatggagagtgagtgatgaattgtcagaagtaagcttcagaaggtgggtaataacaagctcctctgagctaaaggagcatgttctaatccaatgcaagggagctaagaaccttgaaaacaggttagatgaattgctaactagaataactagtttagagaagaacataaatgacctgatggagctgaaaaactcaccatgagaactttgtgaagcatacacaagtatcaatagctgaattgatcaggcagaagaaaggatatcagaggttgaagatcaccttaatgaaattaagtgtgaagacaagatcagagaagaaagaatgaaaagcaacgaagtctctaagactaacatagtctctaagaaatatgagaatatgtgaaaagaccaaacctgcgttagattggtgtacctgaaagtgatggggagaatggaaccacattggaaaacactcttcaggagattatccaggagaacttccccaacctagcaagacaggccaacattcaaattcaggaaatacagagaacacctcaaagatactcctcgagaagaacaaccccaagacacataatcgtcagattcaccaaggttgaaatgaggaaaaaatgttaagggcagccagagagaaaggtcgggttactcacaaagggaagcccatcagactaacagtggatctctctccagaaacctgacaagccagaagagactggggggcaatattcaacgttcttaaagagaagaattttcaacccagaatttcacatcctgccaaactaagcttcataagtaaagcagaaataaaatcctttacagacatgcaaatgctgagcgattttgtcacctctaggcctgccttacaacagctcctgaaggaagcactacacatggaaaggaacaatcggtaccagccactgcaaaaacataccaaattgtaaaggccatcgacagtatgaagaaactgcatcaactaacgggcaaaataacccgctagcatcataatgacaggatcaaattcacatattacaatattaaccttaaatgtaaatggactaaatgccccaattaaaagacacaaactggcaaattggataaagagtcaagacccatcagtgtgctgtattcaggagacccatctcacgtgcaaaacacacacaggctcaaaataaagggatagaggaacatttaccaaacaaatggaaaacaaaaaaaagcaggggttgcaaccctagtctctgataaaacagactttaaaccaacaaagatcaaaagagacaaagaaaagcattacataatggtaaagggatcagtgcaacaagaagagctaactatatttaggatgcatccaatacaggagcacctggattcataaagcaagttcttagagacctacaaagagacttggactcacacacagtaatagtgggagactttaacacccaactgtcaatattagacagatcaacaagacagaaaattaacaaggatattcaggacttgaactcagctctagaccaagtggacctaatagacatctacagaactctccaccccaaattaacagaatatacattcttctcagcaccacatctcacttattctaaaattgaccacataattggaagtaaaaccctcttcagcaaatgcagaagaatggaaatcataacagtctatcagaccacagagcaatcaaattagaaatcaggattaagaaactcactcaaaaccgcacaactacatggaaattgaacaacctgctcctgaatgactactgggtaaataacgaaatgaaggcagaaataaagatgctctatgaaaccaatgagaacaaagacacaatgtaccagaatctctgggacacatttaaagcagcgtatagagggaaatttatagcactaaatgcccacaagagaaagcaggaaagatctaaaatcaacaaactgacatcaaaattaaaagaactagagaagcaagaggaaacaaattcaaaagctagcagaaggcaagaaataactaagatcagagcaggactgaaggagatagagccatgaaaaacccttcaaaaaaatcaatgaatccaggagctggttttttttagaagatcaacaaaatagatagactgctagccagactaacaaagaagaaaagagagaagaagaaaatagatgcaataaaaatagatataggggatatcactactgatcccacagaaatacaaactaacatcagaaaatactataaatacctctacacaaataaactagaaaatctagaagaaatggataaattcctggacacatacaccctcccaagactaaaccaggaagaagtcgaatccctgaatagaccaataacaagttctgaaattgaggcagtaattaatagcctaccaaccaaaaaagtccaggaccagacagattcacagccgaattctacaagaggtacaaagagaagctggtaccattccttctgaaactattccaatcaatagaaaaagagggaatcctccctaactcattttttgaggccagcatcatcctgataccaaaacctggcagagacacaacaacaacaaaaagaaaatttcaggccaatatccctgatgaacattgatgcgaaaatcctcaataaaatactggtaaaccgaatacagcagcacatcgaaaagcttatccaccatgatcaagtcggcttcatatctgggatgcaagcctggttcaacatacgcaaatcaataaatgtaatccatcacataaacagaaccaatgacaaaaaccacatgattatctcaatagatgtagaaaaggcctttgacaaaattcaacagcacttcgtgctaaaaactcttaataaactaggtattgatggaacatatatcaaaataataagagctatttatgacaaacccacagccaatatcgtactgaatgggcaaaaactggaagcattccctttgaaaactggcacaagacaaggatgccctgtctcaccactcctattcaacatagtattggaagttctggccagggcaatcaggcaagagaaagaaataaagcgtagtcaattaggaaaagaggaagtcaaactgtctctgtttgcagatgacatgattgtatatttagaaaaccccatcatctcagcccaaaatctccttaagctgataagcaacttcagcaaagtcccaggatacaaaatcaatgtgcaaaaatcacaagcattcctatacaccaataacagacaaacagagagccaagtaatgagtgaactcccagtcacaattgctacaaagagaataaaatacctaggaatacagtttacaagggatgtgaagaacctcttcaaggagaactacaaaacactgctcaaggaaataagagaggacacaaacgaatgggaaaacattctatgctcatggataggaagaatcaacatcgtgaaaatggccatactgcccaaagtaatttatagattcaatgctgtccccataaagctaccattgactttcctcacagaattggaaaaaactactttactcttcatatgggaccaaaaaagagcctgcataaccacaacaatcctaagtaaaaagaacaaagctttaggcaacacgctacctggcttcaaactatactacaaggctacagtaaccaaaacagcatggtactggtaccaaaacagatatatagaccaatggaacagaatagaggcctcagaaataacaccacacatctacaaccatctggtctttgacaaacctgacaaaaacaagaaatggggaaaggatcccctatttaataaatggtgttgggaaaactggctagtcatatgcagaaaactgaaactggaccccttccttataccttatacaaaaattaactcaagatggattaaagacttaaatgtaagacctaaaaccataaaaatcctagaagaaaacctaggcaataccattgaggacatacgcatgggcaaagacttcatgtccaaaacaccaaaagtaatagcaacaaaagccaaaattgacaaatgggatctaattaaactaaagagcttctgcacagcaaaagaaactatcatcagagtaaacaggcaacctacagaatgggagaacacttttgcaatctatccatctgacaaagggctaatatccagaatctacaaagaacttaaatttacaagaaaaaaatgcacaaccccatcaaaaagcgggcaaaggatatgaacagatacttctcaaaagaagatatctatgcagcccacagacatatgaaaaaatgctcatcatcactggtcattagagaaatgcaaatcaaaaccacaatgagataccatctcatgcccgttagaatggtggtcattaaaatgtcaggaaacaacagatgctggagaggatgtggagaaataggaacacttttacactgttggtgggagtgtaaattagttcaaccatggtggaagacagtgtggtgattcctcaaggatctggaactaaaaatactatttgacccagcaatcccattattgggtatatacccaaaggattataaatcattctgctataaaggcacatgcacacatatgtttactgcagcactattcacaatagcaaagatttggaaccaacccaaatgtccatcaatgatagactggataaagaaaatgtggcacatatacaccgtggaatactatgcagccataaaaaaggatgagttcatatcctttgcagggacatggatgaagctaggaaccatcattctcagcaaactaacacaagaacagaaaatcacagaaaatcaaacaccccatgttctcactcataagtgggagttgagcaatgagaacacatggacacagggaggggaacatcacataccggggcctgtcagagggtgagggactaggggagggatagcattaggagaaatacctaaagtagatgatgagttgatgggtgcagcaaaccaccatggcacatgtatacctatgaaacaaaactgcacgttctgcacatgtaccccagaacttaaagtatataaaaaatttaataaaataaaatgttgggctaaaaacaaacaaacaaacaaaaaacaaaccaaaaaaagaaaatgggcactcttgtctagtttctcatcttaggaggaaagctttcagtctttcatcattgagaataatgccactgtgaatttttcataaatgtcctttatcaattgagaaagttcccttctttttctagttcattgagggtttttatcattaaagggtgacagattttgtcaaaagctttttctgcatctattgagataattatatgggtggggttttttccttcattctatgggtgtgatttattacattgattggttgttatatgttgaaccactcttgcatttttggtataaacctcacttagttatgacatagaaccttcttagaatgttgctggatttatgcagcagttcttatagggcaggtctactagtgatgaactccctatgttgccctgtttttctttatctgataacatcttaatttcttaatgtcttacttactctctcatttttaaagaatagtttttccagatatagaatttttggttgacaatgtttttctctcagccttttaaatatgttgtcccactgtcttctggcctccatggcttctgaagagaaactagctggtaatcctacacatgagtatcccttatacatagtgagaaacatctcagttgctgctttccagatttgctttttgtctttggcttttaaccgtttggttatagtgtatctcagtgtgaatcttttgagttatcctgcttggagttcattgagtatttcgaatgtttaaaatcttggttactaatcaaatttgggacatttttaccatcattttgccaaatattctctctgttccattctctctcctttccctataggactctcattgtccacctgttggcatgcttgatgatgtcctacaggccttttagactctgctcatttttttcccattctttttgctttcttttcctcggactggaccatttcaattaacctatcactggttcttgcttctgactgctcaaatctgctactgaatccctctagtgaattttttatttcagttattctacttttcaacctcagaatttctatttggttcctttttataatttatatctattatttctattattgatattctctatttgcaaagacataattttcatggtttcctttagctctttaaatatatttaagacagctgatttaaaggctttgcctaataagtcatatatctggtctttctcaagaatgattactgtcactttttaaagtccatacttcattgtttgagtgtctcataattttgtgttgaaaggtggacattttgcacattataatacagtaactcaggaaattcagttctccacatccccatggtttgttgttgttgcttgtagtgggttgttgttatctgtctgtttagtgacttttctaaaacatttttctacagtctgtattctttgttatgtgtggtcactgaagtcggtgttccattagcttagtggtcagctagtgttatgacaatgatttccttaaacaactagagccaaaaatagaagctgaagaaagaaaaagaaaaattattcccctagtgttttcagattggctctgtgttgggacatgccttcaacgcatagcaaagccatttacaactctgctttggtcttcacttcctgcttgcatggaacttgaaagtcagccagaggtgaaagcctggggtcttctcaggacttttctgaacatgtctaccttcctagcaatgagtgttgtcttcttgattccccagtatatgtgggaacttttcaaagtccttattcccctcatgtatctccttttctaacctctttcttccctggcttttttgatatgtctattgcttgttctgactgttatcccttgccccaggctgctgcagccaatacttttaccttttaatgcctttggcaaatgccacctgagaagccatgccagccctggaaacactttgaatcagatgaaacaaaggcaactcgtcacactagtccttaagggagcccccagacaggctgaaacacacaatcacaattatttgagaaaaaggtccatttagtccctctggcactagcagcatgcacctggaatatgggcgaccatcctgataactgccattgatctgggggatggcagatgagggatagcaagtaggcaatttaaaatgccacagcactctcttctgcaatgcatcaacttcttctttcttcattaacttttccatggctgtcataagctttcgactatatgcagagttctgtgaaagttgattttgacagttttcgccagcttattagttgtttttgcggagagatagaccttgaagttccttattctgccatttttggtgacatcaattgaaataattctacaactgacttgatagataagaatatgtttaattttgcaaatgttccatgtgtgcttgaagggagtatgtattctctgcctgttgtattgtgttatttatatatccatgtgtcccagctcattgtgtcaaccaaaatttctatattcttcctaatgcttttcctgcttgacaacgttgctaagacataacaaatttcccattaggataatagatatttgtatctctctctgtaattacttttattttcattttatgtagttaagactgtgttaacaggtgtttgtgggtggggatttatttcttcccaatgaatttaattttatcattattcagtagcctctgttttgttttgttttgttttgttttgttttgtttttgagatagtgtttcactcttggtctatgcctaggctagagtgcagtggtatgtttaaagctcattgtagccttaaactcctggtctcaagcactcctcctgcctcagcctcccaagtagctgggactacaggcatgtgccaccatgcctagctaatttttaattttcttttgtagagacaaagactatattgtccaggctggtctcaaattcctgggctcaagcaatccgcccaccccagcacccaaaacactgggattacaggaaggaaccatcatgcccgatatattggtcagggttctctagagagacagaactaatagaatagatatataaaggagtttagtaggtattaacttacagaatcacaagttcccacaataggctgtctgcaagcttgaggagcaggagagccagtctgggtctcaaaactgaagaacttggagtctgatgttcgagggcaggaagcatccaggacaggagaaagatgtaggctgggaggttaggctagtctctctttttacatttttctgccagctttatattcgctggaagcttattagattgtgcctaccataactaagggtggatctgccttccccagtccactgactcaaatgttcatcccttttggtaacacccacacagacacacccaggattaatactttgcatccttcaatccaatcaagttgacactcagtattaaccatcacacctgaccagtaacttctttgtatctttagtatatgtctctttaaaacagcattacatggatcttttcttttcaagtctaagtatcttagcttcttcgactggcacctttagtccatgtaatgagattattgacatatttgtgttaaatctatcatgctttgttttttctcttggtattacctttactatgcttttttgtctcttctttcttgatttctgctggatagactgctatttttttctcattctgtttttctcctctaatcatttggaagttagttatatgtccaatttctattattctgaattttttctagaaatttaaaaatgaatacagagctcaaaattcagcaatatttttaccctcttcctgagcaatacaatatacttgagaactctcattcctatcatcatctctccagacatataggctatttttgtaatgtatttagttctagtttgtttttcttaaccttacaagatattattgtcagtatttaccgttaatatgtcttagcattacctcaatatctatcatacttttgattcttcaattctgcttatattcaggcctaccatttgggttcaccttcctccatgtgaagtataccctttaaattttcattttttaaggtctgttggtagcaaaacatcaatttgaactttcttcctttgggaataaaattgtgcaaccagatcaagtatatgtctatgagtcagcaaaattttagacagtcacccatataccttgcatctaccctgaaaggaggaagttaataaggcagatttgggatttgggaagtagtggggttagggatgaagaactataaaagtcacaaaacctggggtaaccatatctcagtgttttcctattattctggtcaaatgattaataacattcttttcattctcaaaaatttatgattcagataacaaattatacgattactagaataaagtctgtatgacctaacccttagtcgtcctgccttctagagccatgctttcatcttcattcaactagctacttgaatagcatggagtaacttgtggcagtccaatattaccattgagtacaaccagaaaggcagatcaggagagagctgctgaagcacgaaggatgaggggctaagattccatggagagattagctaacagtagttagctactttttaatagttacgagagcattggccaaggcagggaatctgtattttaccaaggtaggaggtcactgccaggagacagagaaatcactgttgatcggtgttgtgggaatgaagagacaaaattggaaattggaagggccaggcccccagcaagaagagagggctggagaactgaacctacatataatgagtttcctcttcaaaacacttgccgaattacgcagctgcatgggggcaaaggcaaaaaaaaaaaaaaaaaaaaaaaaaatcagcctcttaaaagcagagctgtggttttagcagcctttttggttttgttcttgtttcataaaaagtcaagagttatagttcatgactgctgggagaaaattgaataatttttagaaattgtttcatccaggccagacacagtggctcacgcctgtaatcccagcactttgggaggccaaggggggcagatcacgaggtcaggagatcgagaccatcctggctaacacagtgaaaccccgtctctactacaaaatacaaaaaattagccgggcatggtggcgggcgcctgtagtcccagctactcaggaggctgaggcaggagaatagtgtgaacctgggaggcggagcttgaagtgagctgagatcacgccactgcactccagcctgggcgacggagcgagactccatctcaaaataaataaataaataaataaataattgttttatccaaaaaagagcataagccagggggacaaaatagcagagaaaaaaagtaagatagtagaagcaaattcaaatatatcaataattacaatagatgttccagttcaaagacaaattattgtcaaactgggaaaaaaaaccagtatactacttatatgtgacacatctttaatgtaaggacacagaaagtttgaaagaaaaaagatgaaaagagatacactatgtgaatactaaccaaaagaatgtttgcaaagctctgctaatggagaaagcagacaaatggacaaagcagactttaaggcatgaagcataattagagataaaaagagaaatttttgaaataatgaaggagggttcaatatacataataaagatacattattcatcctttgtaatttcctcagtatttgcaagaattcccagagtagagtatgctaatattcccttggctgttacttgtcacccctccctcctatttattgcacacagctcaattcctgattcattcttgtcatgttggcatcctgtccgcttgcttcactgctttatccaaagggcagacatagccatctttcttcattactcacaaatgcaacactatggcttgtagcagatgattgctcaggtttggggatgattaaaggggattactgcacagaaaatgaaacaactttaaacaagataacagagttccttagttgttttttccaaaggggactccatcatagtcacattttcccaagcctggtcagccatctgttgctgtctcattttctctttcccctggattccagaaccctaacattctatccttcaacatgccatgagaaaaactaaaaaattcctatttcattttacagtaaacttttttctgctgcccctttgtttcaaggtcacccttctaatcttgtagattgaatggatgtagaggcttgctagggtaacagtccatcacaatatccttctaagtacagcagcagtcttccttccaatgtgtgatcttaggatgtggaatcagtccaagtcttaaaagagcattacttcatccctttattttctgctacagatgccaaacgagatggagagagggtgagtaggagcaaaatttctcatgaggtaagaagaacaacttctcatgggatctatagtacaggatttgcttttgtgataaagtattatcttctgcgagatttttgagatgaatagaaagaaaagatgaacagtggggagcaggaaagcccgtcagatatgttggaatacagagtatttcagagcttttatttgcagacgagctgcttattactgataggccaaagggggtcgcaaatttctattataaaggaatttggaagaatacactgatctcttaatgaagtttgtaaattaagaagccaacggccaaaagtgaatatataaatggcaacagaatttcaaaatggacagtgctgaagttgaagtttaggagttcaactccaaagagagccaaaacataaagtttaggggcagaagaagaatcataattgctggtttaaaatattcagatggagggaggacgcagaaagtagtgagccttagatgttgacagaattgtaactctgttggctctttacatgagatttcaagcctgctaaaatctcacccgcccagatctcccttctaaggcaatttgggtctctgccaaactttggctaataaaaagagtctacagactcctccgaacacagagctgcagctcttcagggaagaaatcaaaacaagatcacaaggtaagactgaatattctgggagatttttagtcagattttgcaaagttaaaccttgggaaccatggagaactgtgtttttttttttttcctgaaaaataaatgataaggccaatttgttattattgctaatagcagtaaaagtcaatgacaatagctgttactaacttataattccatttgctttcctttgggtgatttgtaaaattaataaattgctgaaagagattgtaatagtttttatagtaaattctgccccctccatgaaactttattttattttattttatgttttttaagagatgggatcttgctctgtagcgcaggctggagcacagtggcgtgatcctagctcactgcagcctccaattcctgggctcaagcaatcatcccatctcagcttcccaagcagctggaactacaggcacacgccactatgcctgggtaatttttttagtttatgtagagatagggtctttgctttgttgccaggctggaaactttataaagcaagttgataattctacttctaactcctaatgcttactcaagacaaacatgcttgcaattgtttacaagtggttttcagtaaaagggggacatcactaagtgtggtggttcaagcctgtaatcccaacactttgggaggccgaggtgggtgaatcgcctgaggtcaggagtttgcagccagcctggccaagaggatgaaaccctgtctctactaaaaatacaaaaacaaacaaacaaaactagctgggtgtggtggtgggcacctgtaatcccagctactcgggaggctaaggcaggagaatcgcttgaacccaggaggtggaggttgcagtgaggcaagatcatgccattacactccagcctgggtaacaagagctaaatgtcatctccaaaaaaaatgatggaaactttgaataaaaaatagcttcacaaagaggattagagatgcactaaatgaagtagtttggaattgttctttagttcttttttcttaatgggacctgaccctggactttaatctctgatctgcacagacaaaaccaattcactgaaaccatggcatggcagtgaagagtttaattgacacagggccagccagccatgccacagaggattcaaagttattattcaaatctccccaaaaatttggaggctagggtttttcaaggttagtttgatgggcaaagggcttaggggaataggtgctgctgattggttgggaataaaatcacaggcatgtgaaaaatggtcctcgtgtatgcactgagtctatttctgggtgggagccacagagtagtcactggtcatcagaaatgcaaaagcctgaacagacatctctgaaggtcaatcttagcttatacaatagtgatgttatttacagtagtcactggggaagttgcaaatcttgtgacctccagaatcatggctagtaatcattttactatgcctacatcttagcagaattcaggaccctctcaaactcctaacttggtggtctttcattatttttaccaaggtggtttacttttggtgaagggttattatcatttaaaccataccctaaatttctcccaaagttagcttggcccaagcccaggaatgaccaaaggcaatatggaagttaaaagcatgatgggggttggttatgtcagatctccttcactgtcataattttctcactgttatttctcactgtcagtttcaaatacaagaattgagaggtaccaccccctcaaaaataaacttttgtggaaaaacaaggaattgataccctaagtggagaaattcaaaagctcatcagttttgctactattcttcatttacagactttcctttgaagattgttttcttttctttattccttgctttctgcctcctcacaattttctctgccttttctttccacacatgaatatatgcctccagactattttaattaagaaaatagcacaaatccaaaagtatgtcctgtggctgcatacaagtcagagacttgagagtgaagtgtctagggcaaagacccgtatttcctcctctgcactgtgcttctcccgctgaagcatccttctgtgccacactggggtcctatactgtttccaacagtcttacttattgcttctcaaatttgtcttttgaatacttaatgctcctcttttgatttccacccagaaaatgtacctctctgagttcagaaaacttcagaatcctctatttcccaaagtttagggtgattgaactgaatcacacagctcggtattgtctgaaacagttaagaacttctagcacaagcatcgcactttcctcagctcatatttcacattttctccattcttctctgaaaggatcctggaccttctaccaatctttgattggttacttcataattgatttcttaagtaacctagatgtttatctctttcacatcattgtttagcttacagtatctacagccagaaagcacctctttccctttcccatttatagagagaaaagaatcctgaggcaaactttcacttagggattgaaatagccagaactgaaaacaatggaagagattgagaaacaggaaatgtcactcttggccagggtttcccagtgattaaggaaatagagcttacaactaacttcggggaaataggcatgaaattcaattgtgaaaagttaagctccatcagggaattaaatcattacagggaaatactgaagaagggtcagcattgagataatatatatatgcatatatatatatacacatatatattctccctatatatatattttttctccctatacatatgtccccatatatatatccccatatatatatgttctccatatatatatatgttctccatatatatatatgttctccatatatatatatgttctccatatatatatatgttctccatatatatatatgttctccatatatatatatgttctccatatatatatatgttctccatatatatatgttctccatatatatatatgttctccatatatatatatgttctccatatatatatatgttctccatatatatatatatatatatatatatatatatatatatatatatgtctacatcagaaaatttatatgtcagtaaatctgataccataagggtttttctggagatgtcagtcagactgtgccaaaatcaatgtatctttcattcaagttgaaattttggcaaacatggtggaaatcaagaggttcattggaattcaccttctttgtatctcagtttgtagcaggaacatttagaaacattaagaccaaatataaactcctgaaacagcagaaagaaagggaccttaattctatcaacaacaaaatgattgggttgggttcaagaacttcaggaaatcatggtagaacgtctaatctcttcggtttcctgtagattctctggtgctgatgtctgcaagcaaaagtaacttttaaggggacacaaccttagtgggcctcaaaaagttcaggcaaagttcagtatgcagggagtggtaagggggagtgaggaattgggggcgcttcctccctatagcggactcctggcacatgctgctcatgttattatcggtagattacagtatacctacgaaggtatttatttttgttttgtattttttaagtgaagagtgcagtatagcataatagtaaagacacaaatttttagaggcagtcaggcctccagtccatcatccatcattgaccagctgtgtaattttggatcttacttaactttcctgagcctgaatttttttctcttgtgtaaaatgtgaaacaaacaagcaacaaaatcccactcaagacaggtgttgtgatgggtaaaacaagttagaagcagtcatcaaaggtaatttattaatcactgaccatttactaaaagtgagacatttatcttccacattatccctcacagcacctctgtgaggtaaatattatctccatttatgaaattgagacagtgggatttgaaaagattttaatactaacccaaaatcataaagtcagtaaatttcagatcagagattaaagtccagggtcaggtcccattaagaaaaaagaactaaagaacaattccaaactacttcatttagtgcatctctaatcctctttgtgaagctattttcttattcaaagtttccatcattttcaaatatgaaaatattgatgaagtgacattaaaaccttctgtctatttccttcagggctacattcaccttttgccctagggaaagagttcctgccagccattgttctcttctgtaacttttttttgccattcccattgctatttccagaactaagaagttcacccacaaacttggctgagcgctttacttttaatcagcacccagtttacatctaattcccctccactttgaacattccataaattaaatgattgtcataattttccctagccatattagtgcatctgagaccttttgcaatggtaagaatgttttgctcattatttccgacatagttcctagcaaagattcaatatttccttagagtttaacagaacttcatagttttgtgtgtctgctgtgctcaaatctcagccactctaacttcttagcctgctggcttattactggcaattgtttaagaaatgctatttaagctgtttgtaatttctttttaggggactatatgcttttctccacttgttcttttctttggagaattattagacccaaacatgaacttcctcaaatctgaatttattagttccaaagtttttcctccctaaattttatttttccattatctcttatacatatatattatttgtccacattctttagcaatcctgtttaacaatacttgatcagtagtcagcataactgcttcatatttgtaaattattgttattgttattattattattatttatttttgagacagagtctgtcacccaagctggagagcagtagctcgatcacaactcactgcagccttgacatccggggctcaggctatcctcccacctcagcctcctaagtagctgagaccacagccatgtgctgcctcacctggctaatttttttacattttgtagaaatgaggtctcactatgttgcccaggatgatctcaaactcctgggcttaagtaatcctcctgcctcagcctctcaaagtgctgggattacaggtgtgagccactgtacctgacccataattgttaagtttcctttagtaatatttcattctaaacttttgaacaagtttcaggcacagaaataagtaccaatattcattctgatgtaatttggtgactatctccagcttcctgttttttcccccataagaaaaaaggtccatattacctgcacgtatggtggcattattttttcttcactgacttattcaagagccatatggtttgtggaaacttaatcacaattgtcagtatgtggtggtcatttaatataaaaaattagatgctattaactcaaaggagtataagctgttttacaaaaaatgtttggaggataccgtgcctaggacctgacaggtaatgcttacatctggctgtccaattattactactttccattatgtcaagtggaagaatttctgctcagtgctataaggcccatgaaagcagattcaacatttagaagcattaaggtcatttgcactgtgatgtgacagaaaaaaatatttttaagtctttatatttcttaattcataaaagtataaaacttagaagtctattattttgtcagcatccaatttttttctaggcatttatggcaaaagctggtaaaagagcatctgggtttagacccgttggttctccttactatctaggtggaaccatgcagcaactagtaacctctagaatggcagttcgctgtacatattttatgaaaagtgtcttggcaaaggaaaggctaccaattatatttatttctctgtgcatcagtgggtacactcaagaagaagtcatatctgtccagagtgggaaaataatttagccttatctttggggagaagagaggtgtttaacagagtcttttcattttagtagctttcacactaagcccagctaccaggtaagtaaggctgagccaactaagaattccacagagaaataatgaagtcagcaatttggggaatagctggagtagcccacaaaggaggcaaagtgaaaagcttgtcataccatggtggtcaagcttccagacctttgagttgcatttttagatcaccgcacaaggcagttctgttaaaactttatggaaatgaaatatccagggtgcagattgtggcttattttattcagataaatgaccaggaagtttcatatctatgagaagaaagcctctgtactcttcagttttaaatggcttgtaataatcaaatttaatttcatctaacaatgttgtgtgttagcaggcagccatttggttgtacaataaaatctcatgctttctacccaggtgatattcaaaatatttaatagctggcatggcattagcaaagagaaataagaaaggaaccagccttgcagcataccagctaaataccagcattgagagggactctcattttggcttttgactatgccagctaagttgaatggtgtggcagtgaaagtgttgtggaatatattacatgctttacaaaacttttcataacctgttctataatatcagttatttctgtcgctattcaataagcatatctcaaacatgagaaaaaaagcctgcaaaagttatgctttctgtaactttagtcttggcacaaggaaaaactttcacatattttttgttttagtcaaattgtcacaatttagcacatggaatcccctttatactagccaacttgttcttttaaaatataaccacagaattttaaataatgcattcctgctttcaggcagcaatttctttttaattttgaaagtgttgatgttgtattaactgattttttttttacttggtagctacatttgttcctggagaatagggaacagttgactttatgagtagaatgttaactgaagattgattttctttctttcaagctttttaattcagaaatatatcatacacataaactaatatgtggaacgcatatgtaagtgtaagttctggagaaaaataataaaacaaatacctgtgtatttatcatccagtttaaaaaatagaatattccttatacctttgaaggctcctctgtgtcactacctaattgcatctcctttggtttcccccagaggtaacaaccaagaatttgtgtttatttttccttcctttactttagaattttatgaagtttgattttcaaagtcttggcaattcatttcattttgtcactatttgtcccacaatgacttaaggcatgatttacatgtatatgatattcataatcattttatagacaaatttataaacacaaaaattttttgtaaatgaacgtaactgatgttttactgttttgcaaaaatagaatagtaataacagtactattactggtaatctgcacttttttttttaaaagagtacctcaaagagttacttataagtttttaaaatcttgttctgatacaaaagattttcagtttattttttctattttttgatatatcatgtttttctatcatatataatattattttcttgatttttagcacaggaatttacatatccatgttatactaaaattttctttaaaacataacattatttaaacattaaaatgttttaaacaattcaaccataaagatattattaaggcaatgtccagaatacattagttgtttgccatttctttaaaggatttagaaaaagtcaatgcagattatacttacatgaaaaataaagataatttatatcacttgatatacttttagctgcaactggggaacacagaactgaacaaggcttaaaacttaaggacactttttgctcgcttaatcagaagtttcgtcgggcagtttcagagttggtgtcaaaaatcaaggatatcatcaaggactcagggtcttcccacccttctactctaccatcctcagagcatctatgatctctcttcatgggaaaaaatggttaacccagctctgagcatcagatactcagaggagccaaaggagtagaagccaagaagcgcttactcctcacatgccccttatttcaaggagaaaaatgttcccagaagtcctaggccaaccccttctcttggtcctaaattttagagactaaagtccttctttccctatttatataagcacttaattcatcctttcagaaactcctcttgttattccttgctatttcctaaagctgccttcagatgaaggctcccagaaccaattccagtagcatctagtggcatatctatgtagtgggaatagaacttaggcacactttcactggctctaactatataactgtaaaatctggaattaatatcttattaatgttttatgtgtttgagaaatgtgccatacccaaattagcctgcttttctacaaaggaactaatttaaagatatatattgcatcctgttttgaagatgggtatcaaaatccaaagctttgccatctgaaaatctcatgcttctctttcaaaacaaacagcaaatcagctgataggatttagagtactgcccaaagaactattcttgttagcatttgtaattaagtcatgcaaaccactttaggctttagaatctgggtactattcccagaatcaaaagtgacttaataggcaagttctcacccttggttaagcaatctgtttgattgtattgttgccaatttcaaatgctctcctactttttggcatgtatttgtggtgaattatgaatagaaataatttttcatgcatacatgcacatacatgcaatagtatcttttcatgaacaaacagggtgatacattttgatatatcggcattacctacccttgcaaactgttttcctttgtggatctaaggtatgaacttttcagaaaacaatccaagccaggtccaaagcagtgaactcaggcagaatagattttttttttttacagttttgtgaatttatttgatctactgactcaggtatatataatacatgctgtggcttggcacctgcctttcccctgtgtatttctcagcaaagcctttgtatatgctgagatttgcacccacctcttgtcaccctcaccaccttctacagaatgctgtgccagaactgatttccatgactgagatttaatcacattttctaaaactttctcacactaccctcacactgtgttataagctagaaggaaacaaatcaagactgcatcctcttacccccatccaaaaaatgtgagcagtttcattggttcctggtgatgggatattgccctgtgtaacaattattcaaacaattattaaattctatacatgaaacataaggaatcaccaaaaagttccatgataaactgaaactctacttttcttcacattttatttttctttgttgttgctgaataaagaaatggcagcaggatagagggaagagcagtcacaactattgctctgtgagttgagagacctgagttctggtcctggctccaccacatacccatttactagctgtgtgaccttggggaagaccctccgccggctctgagtggcactttcctcatctgtaaaataaggagttttaggccacctctgcagtttttaataatgctcagttgactgcaagaagcatcttggttctgcaaatatcaaatgtttatttcacaagttctagggctactctaagactgtaaacttccatccatattggacgggtgatttttttcctcctccaaatagttttattgtcctcaatgactgacattacaatcttctcttttctctttccttttgaaacaaggtctcactctgtcacccaggggctagagtgcagtgatgtgatcacagctaactatagcctggacctccctagctcaagcgaccctcctacctcatccacctgagtaactgggaccataggcacataccaccatgcacagctaatttttcttttttacgttttgtagagatgaaggctcattatgatgccctggctgatctcactttttttctttaatattctgcaatttcataactaatatatgaagatgtggatttttcttctctctctctctttttagagacaagctcttgctctgtaacccaggctagagtgcagtgacataatcctaactcactgcggcctcaaactcctgggctcaagcaatcctcccacctcagcctccccaccagctgggactacaggtgtgtgccaccacacccagctaatttttttaattatttttttttaagagatggggcctcgctatgttgcccaggctagtcttaaaactcctggtctcaagagatcatcccacctcagcttccaaaagtgctgggactataaggcttgagccaccacccccagccctttctttctttctatctgcttgaaattcattgaaactcttggatctaaggattaggatctttcaacaattctggaatgttgtcagccattatttctttaaatgttgttccatctctgttctagcatctccttctaccattccaaatagttataaaacagtctcatttttcttccaagtcttttaccctcttttcatattttccacctccaagtatctctggattgtattctaaggaatacttcagatatgttctctaggtcactgactcttttcacttgtgtttaatcttctgtttaattgaaccattgagttttaatttcagtaatatatcttttatgtctagatattctatttggatctttttcaaatatacatgttcactgttcatattttcaatcttttagaatactatctaacaatattaaaatcagttatttctgcttgttctaatacacaaaggctttgtggctttctgctacctgttccttttgtgggttctcaccatggtgtctggtattctcgtttgctttgcaaattttgactgcagactactcatttgtcctgaagacttttctgtgggaatgtttggtggtttgtgtagcagctgagttcttcaagataagacttgtatttgccttggggcactgccaacctaaaactactttatacttaattttctatttcaggcttttggaagcacacaagtagtttgatttcagactacaaagccatgtaggggctgacttgtcctgagaaggtaaattcttagagatatgtgtttccttccagcaagggctggagttgagacagacaaggtttctgggtattcccttctgccgagtttatttatcttgatcacccttctattgtgaatgtagccctttgagagtccaggtttatgcagcagtttactgttagactctccatcttagacatatcctaagctttatctcctggtcctgattctttatgtaattcttcctctttgtctctaggatatagtagacaactttagaaaaaagccaagtttgctagcctcccattcatgccccctcaatgttgtttgaaaagatatttaaaaatacatcttgcagcattttggttgtttttatcaggagggctgttcatggtaactaacccattattatgctggaaacagcatatttcattaaataactttataatgagtaaatataaatgtaaacttatgaagcatatttatattaataagttaatgattttgtcttctgttatctattaggcttccatgcaatattcttttttcagaaaaggattctactctttacaaagttttgaaaacttcttccaaccattaagtgtaatgctttctccttataatgctactaaatcttctctagcttgactaccactgatggtatatgaactgagcctcagtctatcaccctccttacaaggtcaaataattcaggtggaatgggcctaatgacatattttcaaacttttaattttgttttcttaccagtaaaacctcttctacctagaaaactttctaggtaggggttttctgctctggatgcaggggctagggaggaagatctggaatgcaacggatttggattcctccacccctttcctgaagtacctcatgaactctgaaaatgttcgcttagggtttcagctatgaggccttgggcatttacttgatccctctgtacctcagtttcctcatatataaaagagggataataataatgctaccctaacaagattgctgtaataattgaataagttaaatatgtgaagcacttagtacagttcttggcacatagtaaacactatataagggctaattgtaaaaaatacaggagagctaggcatggtggctcatacctctaatccaagcactttgggtgaccaaggcaggaggatcacttgaggccaggagttcaaggttgcaatcagctgtgcacttcagtcctggttacagaccaagactctgtctcaaataaaaaacaaaaacaaaaaaaggagaatttttatttaactctacatgcttttgctaagtatttcatactcctttgaatttttacaagattcagaatttttacattacttgtccaattttatgtaaaatgcatttaaaaagtaaaagaagaaaatgatctcaactttagagttaaactaaaaccaaaggtctctatgttccatgttgtttttttttttccatacattgctttcttctagcagtgagaactttctgaatccattaaacaacagccaggcatggtggctcacacctgtaatcccagtgctctgggaagccaaggtggaaggatcacttgaggccaggagttcgagaccagcctgggcaacaaagcgagaccctgtctctacaaaaataaaaatttagccgagtgtggtggcacacacctgtattcctagctacttgaagactgaggcaggaagatcccttgaacctaggagttcagtgaggcaatgatcatgccactgccctccagcctaggtgacagagcaaaacactgactcaaaaaaaaaaaaaatcagctttcagatatttgggtactaaagaaaaaaacaagtaaaaacaaaaaaccaaaaaatgctgcagactctgtggacttttcttttcactgtaattttgtcctgctgtaaggttagtagaaaggagaagaggagatcacaaggctgaggcagaatttgtgtgttttctgaggatggtaccctttgtgtgaataaggggctagtgcagctgccagtatagaaggggccctgggagaaggaaataaatgagctaaatgaggaacctgtacaggagcacaggaaagagtcaaggaggaaaatgctggctttcacataccctccttgttttgaagacaaggaaactgagacctggagagctgtagggacttgagggaaaggagaaaatcctaggtctaagcttgggaaggggatgccaatctacctttgcttcttcaaagattactacagacttgatccactggggccctcaaagtatgtgaggcatgggagggggcccaggaggggaataaaacaacttgtactgaataatttgaaatgttcagtcacactaaaactgcagagccacaggccagctggaaagtcagcttttaaaaatgctttacaaagagcactgacccaagaacaagaagacgtgcgttctattagactgaggcatttaagactgtcatttctgtaagtcaaaatggtgaagtagtgccagcttcataacagctcaaccagggaatctacctccactgctctgcagatctttgggatttgggtagggtccccacatctgtctagtggatgatgcctgccttacttagtttatagggtttctgtaagcactgatccaaattacacaacatttactgagtgcctgctgtggataatttctggggaaataaagatgactaaagcacaacccttgttcccaaggacctagcagtggaggaggtaggaaaacaaacagagttggatctattattatatatataatagataaggaagggagagaggaaacaataaagtcggcttgattgtgggttgtcagggagatcaaaacatttgaattggcctccaatggttaaacagagtttcccagacaaagggatgaggtagcactagcaagaggaatagtttgagcaaagccatgaaggtgtgcaagtgcatggtgaattgaggaatggtaaacagtctaattggtctaaatgtagagagtatggagggaggggtaagtaaggttggaaaagttgatggggcaggtagtgccaatgtatagaaatgactggataagaccacatccaggaaaaccatggcaaagcacagaagtactttacaagtgataagtactgtttaccttaaagacataaaacaaagcttccctaaaatctcacactatccctccctcttctcacgagggctttggcttgagtcatagattgatctactaggtatctttatagagtatttcctttccctaggagaagtgttctccccagggtccaggaaagtggcagatggaaactttcagagtggtggagggtaggggacaggaagtgatccagattgggtgaggaaggtgctgtctcattattccccaaacttctatcttccctttttccatatcatgtattctaatctcccttaagaaagaagtgaaactgctacacccaagggagtagaggattggtgtgtcacactcccctgtgctcccatcccccgcttctcctccacttctgcccctttgcaaaatctcccagaatgaagtcatattgtgttggcaaacttagtcataatccccatttcctctccttatcagccaggacctgtcttcttccactgattccactggtattgcttccagtacccagcaatatgttcattcatcccactatatcctcatagatcctcttcccattcaagagaaaccaagcttgacaaggagatgaatcaaatataaggtcctgggattcaattatgccccattctaccaatgttctccatgaactaagagaaagagccagatagccctaatatcagattctggctttgctacttcttacctatgtgacgttttgcaagagccactatttcttcacttctaaaagggagacaatcatatccaaactccagaaacacagtgacattagagataatatacatagagcatcagtcttacagaagacgccaaacattgcagctactactatcatcattatcatcttcaccacaaccaccattattaagcatctgaattaatgcagactcctggctggtctcatcccttccctcttattgccctccatctgtttctcacatgatagtcacagcactagtttaaaaataaaaatcaaatcacatcccatgttactcaaaacccttctttggcttctcaatgcactctgaatgaaatccaagcttcttcctttggcctccagggcccagcccaaccaagcttctgtccccttctctctacagccccttcacattatgctctccccattgcccgctctgctccagccacactagcactctctgttcactgagcactgcggcttctgtccatctcagggcctttgcccctgaggttttctcttccctgtgtctcttccctttcatatgttcctcacgccctttgggtgcagtttaaatgtcaccttctctgactacactaccttagtaccattctactttatcttctttaccagtccaattcttttttatcactgttcattaataacatatttgtacaactatgtgaataacttctatctccccaatagaaagtaaactccaggagggcaagacagtttgctttgttcagtactgtatccccagcacctagcccagtactagaagtagtattttatttattaatgtttttaggcagcactccatgctgtagtacaagcaaatgcaaatccagcatcatttgtgccctcaggatctcgaggaggttaggatttccttacaatcattcccagttgtgtctcttttcagagaatttactctctaggacatcaaaggtcaaactttctcttttctgtattatctaaattttccacaatgagtatgcatttttagtaagaatttctcataaactcagcattgtaacaagactcatcacagcaaatcagtctgattaaatgaatttattttgaaagtaaaattcacaataaaagaagaaagtccaacagccaacttaacattcttaaaggtattagcatttaaaagtgggaaattgctaatcaaagagcattgtctgacatataagaggttagtgattcaataaatgattttccagctgatcagatgtagataatatgacaatgtgaaatgaaaacattcatgcagcaccccatgagttaatgatggtggaatacatagtccttggcatgcaaagggtgctcaatatttgttggatgtaagtttctggaagatttcttcagccaaagagaaaactacgcaaatttgcatctttgaaaatgaaaatacctcatatatttctcactgttgttgttgttcagaggtgaatgaccaactaataaatttctatttaaattattttatttaattattatttcttgacagattaaaatctttcaggttgtttccctaatttaaatgtatgtcatttcctctgggatgttccccacccacacacaagcatactccttactctctccctccttttccttcaaaagcactatttcctatgattatctaaaatgtgactttcccctggtgatgccatattcttaaaacccactccattttcttgtgtgcacatttcccagggctagtagagaaagcctttctaaccccatccccaaccctgggcccaactacttaaactaatctctttcctttctggtcactagggaccctgacctccttttctgttcactattgcctctgctgctgtcacccttggtgatttcattgctgttgtcacccttagtgactgctttgactctttaacactcctcagcagttcacccaaaaaatctcattctgaccaccatcatcatcagaacatctttctctctaagataaggaacactggaattcttctgtttatgaacaaactcccatctttctacttcctccactcccatttaaaaaattcctttttgaaccattttttaaaattgtggtaaaacatacataatataaaatttaccattttgaccatttttaagtgtacggttcagtggcattcacattgttgtacaaccataaccactctccatctccagaacatttttttcatcttccaaaactgaaactctatgctcactgaacaataacaccacattccaaagttaattcttttttatattctctaaggatctgtttcagatttttcccacttatacttaaaacttcaaaccaatgcttatttctcttaatctccgtctctttcagaacctacattacaaagattgaagccattttataagacccttaagttcacatccctagaccttaaaacttcacatcttctctcattctctcactagttcctcctctactgcaggaagaagtgtgcctcctccttttcaaagctgatccttccacttgtgttctttccccctctcttctgtatctcctctggaaatattatgtaagttttcctcttttcattggctactttctttctgcattgaagcatactcaagagtctatcacatcccaatataaacctcaatattaatgacaataataataacaaacatattgagtctctactgtgcaccagctactgtgctaagcgctgaaaatatatcttctcatttaattctcacaacaacctaatgagttaaattatgaaattattatgggtaatataacagttattatgaaaattttcattattattaagaaactgaggcttcagagacatcaagcaacttgtccaaggtcacctagctagtaagtagcatcttcccttctccacactactgtgtaaagataccattctttctttctttgttccctttcattactgtattatacttcttggaaatgtcttacttcctccttctccactctgcgcagtccagtgcagttgttttgagattcccaccatacttaaatgactcctccaatgtctcttaatcttcaaccaggtctctatagtactcattaccaactgttcctgctttttgagacagtgttctctcttagccttcataatatgaactcttcttttttctgcttctctgtctggtcttcttattaacttcgtttctcctctttccccttacatgttagatattccagagtttcatcttcttacagctttctcttcctgctccacactcagccaagacaatctcattcactcccacacaataaactatcatgccttcacaaatgaagagcaaatccacatggctaagtttggcctctggccacctagttccaactccctgctgaaatgtccatataactgttcctcaagtacctcaaactccatctgccctacatcaaactaattccctgtccctgtcactgaactccccacctgagtttcctattattaaccactggaattatgtccacttcccttcaccaccctgcttcccctcatccccagtccagagcaggtacacccacatccagaaagagccgaggaggcattgtggcagacgtgcccctaaactgggagtgagacttgggttttaatcctgactcagccacttggtaactgcatgacttagtggtacagaacaggaatctctggggcccttactcacaccaacctgcaaggactctatgaagtacctgtagcactcatcattccatcccctcctcgttagtcccattaacattgccctcactaggtcctcactgctttttgcctgggatattttaactggcctcctaactattcattctttttgcctccgtctccttctttccttccttcagatggtgcttcacacagacataaaattatattcacaaaacacactctagatgatgtttctcatttgctttagaaactttcaaaagattcgtgttgtccacaggataaaattcaaactccttattgtagcattcatagtcctctgcatactggtcccaacataacatgtgaaacttcactttgtctgaactgaatttcaaatgtagttgtggtatgtatttggaaggaaaaaaaaatcccaaatgtattcttttttcactatctttatttttttcatttttggtgacaagagtctcactctgtggtccagactggagtatagtgctatcagagcttactacaactttaaacttctgggctcaggtgatcctcccacctcagtctcccaagtagctaagactgcacgtgcacaccacccagtccagctaatttttaaaaattttttctgtagagacaggatctctttatgttgcctaggctggtcttgaactcctggcctcaagtggtcctcctgcttaggcctcccaatgcactgggattacaggcatgagacacacacccagccctgacttattctttataccaaaagtaacactgagtcaatcaaagatttatgtataaactattaaacattaaagttttagataatatcataagtaaatttatttataatcttggaagagaaaaggtattttgaagcagaacacaaaaccagaagttctcaaagaaaacactgattatattttaccacataatatttgaaaacttatgtatggccaaaaaatgccattagtgaaatctaaacataaatgacacaggggaaaaagttgtaacacaaatcacagacaagggtctaatttcttagtttaggtagagtccttaaaatcaataatttatagaaattaacaatacacattttttaaaagatgctcaatctcatgaaataaaggaataaaattcaaaactatcagatagtttacactctttagaaaggcaaacatttcaaaggtaatgacactcattgttgctagaaagatggagaaaagggtactcccctggattgttcacaaaactgttaattaatacaagtttttggaagtcaattcattaatatctgtcaagctataagatacatgtaccctctgatccagcaattccactactaggagtttatgctaccaataaacttataaatattttcaaagaatcacaacatacacccacacccacccacacccatacacacacacacacacacacacacacacacacacacacacaactgtcagttgcaacactggcaatattagaaaacaaaaacaaaaataaaatctggaaacagccagtgttaatcaataaaagactcgttaagatatatttctatgattgaatgctatttataatgttacttgtaaaagaatgtttctaatatgtgaaaatatttatgatatagtgttaattggaaaatgcaaaaaaaagcttaaaatatatttgcagtatgattctattttttaaataaaagagatgtgtataattttttacatagaaaaaagaatgtcaggatctaccacgcatacactttcctgtcatttacatattttctaagtgcacatgtatcttttttataatcagaaaaaaattactttaaatgttttcaactttctgtagaaaagagaaaggaaattaaacaatctgtgtccttctatattatatgttatgcaataaacactgcctagagcctatattgcaaagattttataaaagttaatgattaactaagtgtaactctttgacagtgctacaactaggccgggtgcagtggctcacgcctgtaatcccagcactttgggaggctgaggcaggaggatcacttgcggtcaggagttcaggaccagcctggccaacatggtgaaaccccatctctataaaaatacaaaaaaaattggccaggtgtggtggcatacaccttgtagtcccagctacttgggaggctgagacagaagaattgctttaatctgggaggtggaggctgcagtgagctgagatcgtgccactgcactccagcctgggcagcagagggagactctgtctcaaaaaataaataaataaataaaatgaaagtgctacagctaaaataatctctgtttaggatctgacggtaggaaaaagataagctcccacacgttctaatgcatttaagtagctccatctgcattgcctcatacatcaatactgtcatccaatgttgcttaatccatgtgtgtgtgtgtctatataagtagaactgggatgtaactgccttaaatactacaattgctgactacaggaaacctcatcatctgagaccagcactttataaattaggtgagtatcataaccagtgtgcagggatatctgctgtatatcattgggaatagcagcaaaaaagaacaagtgatgttcctattgccatatgttctgaaatatttctgatataaaaataggggagtaatgagtcaattttagtatgaaaaaaatggtgaaaagagtgatcaaggcaaagaatttgcaggttatttgaagaaaatactttttcagaataggatttgaaaatatttcctgactatgcttttgacttatcatgtggttctataaagggtgttgactttctctgtgtcaatgactccattgtaaatgtggtattttcagcttctctatcttgctcaattatacaagccaatactggtttacagcaaagttcttccaagtgcgttctctcaaactagtccatgagggtgataagacgggagaaaaaggttatgagatcaaataactactgaaaacaatagttaaacaaaggtacccatgagtcttcaataaaggactatcaacaccttttctatgctaacatgactctgactctcctagagatagaatgtagattggaacatttcccatatttatttgaaaatataactttttgttaaaatattctaagattattaaaaaaagtaacttttttgaatgaccaggaattgttttttctaggatataagtatctttgggtagaagagaaaacaaacaacgtcaaggcaatgcagtttttatgttagtaaagtgttacttcattatctactgtgtgcaggttactatttaaactattttatatacaacttaaaatacaactacaattgggttccctatcttattattccaaatgcgtgattacaaattaacaaccatattcagaaacttattatttcaaagaagttggacaactgctttgtgtataagaaaggctgagtgtttggagttaaattcccagttctgattattttcttcctgttttgaggcggaaagggagaaagaatggagggagacaggatagggaagtactggcatcaagatggaagtcaggaggctagattctgttcctggttctgtttcataatcctgggtgaggcacttaatcttcagagtttcagtctactcatctgtaaagttaggggctcagtaaaatgatatgtaagatcctctgcttctaagcattcttgaccaaaaaaggtaggagaatcagaggaagaaaataaaagttcatgtgaggtcttcaagctgtgtgagcacaacatttactcccatggcaagactgagggacagaataggtagtcttcaactggctgaccattgaggattttgcacatgggactggatgtaaataggtggcatgcacataatgttatagcagttctacctagacaagatcatctggagtttcagcctccagaggtttgtccagggacaaaatagggtgcctaaagtttaccttctaacgagtcctctaatccaagaactcaatgctcttcttttaactgctagaagagattattcatatgaagctcataagagatttaaattgtaaccactgctgggataatttggtttgtttgtttgtttgtagtgtggcaaaacaggaggccatacttaaaaagaagaagcaataattattgatagaattgcaggcaatgtcagagagtttaagactggagaagaagtcctgctccctccacaaaccacagcacagtgtcataccctgatgtcgaagccagattgcagaaccatactaagagaatatggaattttctgcaatttatgatacagaactccatattttttcagtacgatacagtgacccagcttgatcatcaaggtatcacatcgattgatgtcccttgcttgaatcaagtattaaattgggggttgcaagatggtgatttgtctgattctgagagagaaagaacaaagaaaccagctaggcaaatagggcaaagtcctcggcagaactgctcttctaacaaagagcagcctgagagatcaagccgcaaacatagaaaaggaagcaagctccagcacaaaagagtgccttctgtgtaatcagcaaatttcaaatttcatatacattcagttggcctcagtgaacacattcctttccttttttggttatattcaaataaggaagcttgctcaggagggcatgcttggaacatgcctacagctacacagataaggggagttacactgagctaggcatgtccacaatggaggattctatccccaacacgtgcacagtaagggaagtcaaacaacatgaagtaacttaggctacgagcccacatgcacactggaaggacagcgtgggggttgtcagaaattcatgccttctgcaaatgacacacctagtcctaaccagtttttcacaccttatgtaaataaagtaccccctccccactagctcatttataaaaacccttgtattccactatagaatagcaaccctttttcagggcccctctctgcagcagagagctttctctccttctttcatttattaaacttctgctctaacctcacccttggtgtgtccaccttccttgatttcctcagttgtgggaccaagaactccgggtggcatcccagacaatgaggcctatttcaatgctatcattccttctgtaatgactagacccctccctattcaactagcctcactagttttttagtgactctgctttctggcacaacaggatgttccatgttcaccactactttaccagctccagatctggagcagctgttcctttcggtggagaaagtactaagaaactaagatatgggcacactgatattgctgactcatatttaacattccataggttttctcatgacttcttttatgtttgtgtctcctttcccctacagtcaaaaccatgtaacataatgtatctacttatttgctctatactaaagtataacaaaacagtctcagaacttcagtaccagtatttccactatctacaaaaagagtccaactttgtaaaatagttgaagagatttattctgagccaaatatgagtgaccacggcctgtgacaaagccctcaggagatcctgagaacatgtgctcaaagtggttggtgtgcattttggttttatgcattttagggagacatgagacttcaatcaaatacatttaagaaatacattcatttggtccagaaaggtgggataacttgaagcgtggggtggaggggttcagctgggagatgggtaagggataaaagactacagtcaactgggatcaataaaaaggaatgtctgggttaaaataaaggattgtggaaaccaaagttcttatttgcagaggaagccttcaggttgtaggcttcagagagaatagattataaaatgtcaattctaatacagtggtatttgtgtatctaaacatatctaaacacagaaaaagtaaagtaaaaatatggtatgaagatttaaaaatggtgcacttgtattgggcaattaaccatgaatggagcttgcaggactggaaaatgagtctaggtgagttaataagtagtgagtgaatgtgaaggcgtaggtcgttactgaccacgactatagacttcatgatcactgtacacttagactacactaaatttatttaaaattgtttcctttttccataataaattaaccttgcttactataacttttttactttataaacttttagtttttttaatgttttgactcttgtaataacacttagcttaaaatacaaacatcatacagctgtacaaaaatttcttcctttatatccttattctataagcttttttctattttaaacatttttaattttaattttttactttttacgctttttccttaaaatctaagacacaaacacacacaccctagtctaggcctacacagggtcaggatcattaatatcactgtctttcacttccatatcttgccctactggaagttcttcaggggcaataacatgcatggagctgtcatttcctataacaatgtcttcctctggaatacctttttgacagaactgcctgaggctgctttacaattaacttgttttttaataagtagaaggaacacaatctacaataatgataaaaagtatagtatagcaaatacataaaccagtaacatagtcatttgttaccaagtattatatactatgcatgattgtatgtgctatacttttatacaactggcagtgcagtgggttgtttacaccaccatcaccacaaacacgcaagtaatgaattgttctaggatgttatgatggctacaacagcactaggtgataagaatttatcagctccactataatcttgtgagaccaccattgtatatgtgcaatccattgaccaaagcctcattatgcagtgcagagtaccatatcctagcatgaatgcatagttagaatactacgttcaaactttactgaaataattatttcctctatatggttatgttaccaatttggtagtgagctagccacagttgtttccgtttgtttttaagttgagacaaatgaactaatattatattttaatccaacagaatactgaaaaatgaagcctaaaatgaagtattcaaccaacaaaatttccacagcaaagtggaagaacacagcaagcaaagccttgtgtttcaagctgggaagtaaggacttaagttatctctgaatgttttacgcactatttttatctgttatcaaatatttatactccaatgtttatacatgctatcttatcaaaatctactaagaatacaagaactaaaataaaaagagatggcacataagggtataatacagcagactggttttgaaccaaccatatatagccaactttggcatatttgatacatcaccaggcaggaatagctgagataatctgaacctgtgaatagtgataaacttaattatagccttttatatcaaccactttttgctccacacacctcctgctgccaaacccccaaaaccttttccctgataaactagcaaacttttaagcaggtccacttttattcaacaaatattcattaagacctttggtggtatcaggcatgtggtcttaacttgcgactactgatgaagaagagaataacagatgaagatatttgaataatcatcttagtcaatttgtgttaccatagaaatatacctgaagctgggtaatttaaccctttttccatttagaaaaaaaagtgcagcttgctgccagcgcttatttaattttacataaacatctctttgaggctgaagcaaatctgattttcaatgcaaaaatagaatacaaaaactgttcttggagttatttctaaacagaactaccatcagcattgtctatttcagaaaaaatgagattcaccaaatgaaacttcagcaagcaactaactgttcaagaagtgttcaagaatgttaacatcacatgtaggaatgctacattttccaggatttgacattttcagcgatcaagaattactatattttatcaatgaaaataccactactaaaaacataaatagaatgatgtcttttgtttccaaagttgatatactagagagatgtaaaaataataataaaagcaagatctttcgtggcaaagttatcttaaacactgcagaagcactgccagtaattattctctgggcaaatgggaaagggttaaaaacaaaagaggtttatttggtttacagttctgcaggctgtacaagaagcatggtgctagcatctgcttctggtgagggcttcaggctatttccactcatgatggaaagggaagggaaaccagtatgtgcagaggtcacatagggggagaacagagggagaacagaagcaggagaaagaggagaggagggaccaaccttttttcaacaaccatcttgcaaactaagagtgagaattcgctcttgtgagaatggcaccaagctgttcatgagtggtctgccccatgatccaaatacctcccacaaggccccacctccaacaatggggatcaaatttcaacaggagacttggtgggaccaaaccaaccaaagccaaaccatagaaataaagcagaaccaacaaatgatgctcaagtctatctagctgcaaactcagagtttgtagtaagacagaaggtaagtaaagtcaggtggcagctatagctctgagattaaagggctgtataactctttgatccttaaaattatctgtcctaggaaagaagcatgcaaatttatttatttatttattttctgttgagacagtctcactttgtctcccaggctgaagtgcagtggcaccatctcatctcactaaaacctctgcctcctggttcaagcgattctcctgtctcagcctcccaagtagctggaattacaggcacacaccaccatacctggctaattttttgtatttttagtagagatggggtttcaccaggttggccaggctggtcttgaactcctggcctcaagtgatccacccgcctcagcctcccaaagtgctgggatcacaggcatgaaccaccgcacttggccagaaagcatgcaattttaggatctgtttttcatatgggagtagtaacacaaaagtaagttaatggagccttggtgaacaggaaagaaaatggaggataaggaatgatggtggggactggcataaccttgtccttcatgctcctttccatttctctgtacatctttaaggctagaaaagaaagcagagttaatatcatttctgtctcattctgtcttccctgaggctgtggcccacccacactgttctttggtgaccagggaaagcactaatttgactgtggtttctgaacaaccaggaaatcacagcagaaccaatccttttacttgtagctgagtcaaaatgctctctgtagaaacagtgactcagtgactttgcatccctaaattgcctctcataaaaagtacattttctttgtacctcaggaagtatgggctctttatagaaactggaatgagggagtgggctagagtttatgccagagttggtggtattgatacaaaagttaaaatgtaacccctcctttaagggaacagtggccctaactacttacctataccatttagaggacagtgataaaaataatctcaaactcatttgtatggctttacaaatacatcacattattttaattggcccttaacagatctttctttccaataatattggctcagttaaatattgtcctcccctcttatttgcaggaaatatgtaccaagacacccaacagatgcttaaaacaatggatagtaatgaaccctatatatactatgttttttcctacagatacatacccatgataatgtttaatttataagttaggcacaatgagagattaacaataaccaacaaaaaagtggagcaattagaacaacatactgtaatgaaaataatgtgaatgtctgctctctctctcaaaatatcttattgtatttcactgtgggtaactgaaatcatggaaagtaaacccacagatgggggcaagcaggatagagttactgcactaaaactgtgattatttaaacaatcctggtgaaaaatttgacagatatctctggggtatgtgacaggtgtaaactgcttctcaactcaaaatgcaagatatgtcatatcttgtttttctaaataagctgctgctctaagatgccaagacacaaggcaagaaagcacatttaattccttctcttctcttgagctaccaggatccaacacaagccacagttcacaatgctacaaaacttagtagccaaccactgcaggtgtccccacagtcagtcccacattgtggtcacccacagggcattttgcctctaatgccagcagggtacaggacttcatgacctggaggaaagcctctcacaacccttcccttccccgtttccaggaagctacttccctacttcccagggtcaggctttcctcttctcctactttctttcccccacatccatcaacactttctcttccctaaaaatccagccgtcttcattcatggatctagccagaggtcacaatatgggagccttgggatagatccatccagcaggagtattttattaggattgaacggtgttattgatattttctaattgagtcaatttttaaaaaataggatatttttaatgaaaatctaaatgtgtatagtttctctaaaaaaatccaaagatctagaaacactgggtccatatcttgcatggcaatagttggctagaactgagtagagatcaacccctttagtttgagtctatccatagaagatctgttacagtaaaggagatttgactttatcctgtagacagtagggaatcattgaaaatgttgaactgaggaatgataaaatatttttactttacagagatcacattggtgaagtgtgatgatagtagtgtgatgataaagtgaggaggcaagagtagaaacagaaactggttagaggtctactgcattaatctaagggactaatgatgaaggtgtgacctaagacaacagaatagagaggacggactagatttcagatatattcagaaggtgaaatcaaaaagacttaatgacagattgaatgaattgtaagaatggaaagaaggaaaaataaatgattctcagctttttgatttaagaattgggtagacgccaggtgttgtggctcaagcctgtaatcccagaactttgggaggctgaggcgggcggatcatgaggtcaagagattgagatcatcctggttaacacggtgaaaccccgtctctactaaaaaatacaaaaaattgcctgggcatggtggcgggcgcctgtagtcccagccacttgggaggctgaggcaggagaatggcatgaactcgggaggcagagcttgcagtgagccgagatcacgccactgcactccagcctgggtgacagagcaagactctgtctccaaaaaaaaaaaaaaaaaaaaaaaaaaaaaaaaaagaattgggtggataatgatagatagttgtactatttctcaagataggcaattcaggagaaatatattgggggcagaaaaagataaagacattttttattataaggactgccatggtttgaatgtcccctccaaaactcatgttgaaatgtaattaccattgcgatagtattaagaggtggaaccggctgggtgcggtggcttatgcctgtaatcccagcactttgggaggccaaggtgggtggatcacgaggtcaagagattaagaccatctttgccaacatggtgaaaccccgtctctactaaaaatacaaaaattagctgggcaccgtggcgcacgcctgtagtcccagctactcaggaagctgaggcaggagaattgctggaacccaggaggcagaggttgcagtgagccaagattgcaccactgcactccagcctgacaacagagcgagtctccatctcaaaaaaataaaaataaaaaaaaagagaggtgggacctttaaggggtgattaggtaataaaggctctgccctcattaatggattaatgccattgtcatgggagtgggttagttattacaggattgggtttctgataaaaatgatgaagttcagtccccatcctttctttgcctcatgtgcactctcaccatgtgtgatgtcttccaccatgtgatgacacagcaagaaggccctcatcagctacagcccctcaatcttggacttctcaacctccagaaccagacaccaaataaaactcttttctttataaatcacccagtccatggtattttgttatggcagcagaaaagagactaagaccagtgtactttagtttaaggtagctgcaggtcacccaggtagagatatccagaattcagaagatatacacagaaagagacagctatgcttcaaagtagctgggtcaaaatgacttggggagaaagaaaaacagatagaaagctcaggaaaaagaccaaagatagagttacagtttggggagtcatcagcctctaaaaaggtgattgaagtcattggagcaagcatgattgcccaggaagaaagtttaagagtgagagaagaaaaaaagtcaaaaccctgaggaaaaccaacatttatgagcagacagtagagggataactaacaaagagacaaggtgcagtagtcagagagaaacaagaagaacctagggaaactggtgacatggcataaggaaagaggggttcaaagaaagaagtggtcctgagagtccaatgccacagacaggtcaagggtagtaagcagttaagaagacaccttggtaaaatccgtgcttggggaagaaacgaaagacggagtgattcacctctgtggtttcctatcagccatagtctagttctctgagtggcagaattatagaaagatttccagggcccttcctatttactcacaagaaatccctgagggattcatgctgctgttatgattaaattagctatgggaattttcttaaaattcatactaagccattgccctcagcgagcaggcaggatagagacatggaaagtggtaacagcccttatatacatttgagctggctctttgaccccagtggagtgctctctcctgcaaagtccacatgtccaggccagctttgcactttcctctccagaacacaaccctcacactttcagcttcccaaaacaccaaagcatatgttcttcaaaattctcctgatgcaaagtgttttcaatacttcaaatgtagtaacccccatccttgaactataaccagtgcttgtcctactagatgctagcccccacatgtacatctttaactttcttatctcctaaagacttccacatcttcagtacttcctcagtattgtgaccctcacttttaactacccaagactgatatcctgttccccccagagtccacactcagtattaggcatgcctatcacgttcccatgtgatgctgactaaaatataaagaatataaggagtgagtgttctttcagttatcatattatgccttttagctctgaaaagacaatgtgatatagttgctatggtttgaatgtttccaccaaaactcatgctaaaatttaatcaccattgtaacagtgttgagaggtcagatctttttttcttttcttttctttttttttttttttttttttttgagacagagtctcgctctgtcgccagactggagtgcagtggcactatctcagctcactgcaacctccggagaggtcggatctttaagatgtaattaggtcatgagaactccaccatcataaacagattactgctgttatcatgggagtggtttggttatcaagagactgggtttgttataaaagtgagttctccggatttcctctctgacttactcactgctgccttccaccatcagatgatcctcaccagatgccagcataatattcttggatttgcctgcctctagaagtgtaagaaataaatttctatcttttttttctttttttagagacagggtcgcactctgtcacccaggctggagtgcagtggcatgattatagctcactacagcctcaaactcccaggctcaagcaatcctttggtctcagcctcccaagttgctgagactacaggagcaggccaccatgcccagctactttttttttttaaattttttgtagagacggtcttactgtgttgcccaggctggtcttgaatgtctagcctcaagcaattttcttgcctcagcctcccaaagtgctgggattacaggtgtgagccacagcacctggccaacaaatttctttgctttataaattaccaagtctatggtattctgtgatagtagcagaaaatgaattaatacaacagtcagtaaagtattgtattaaattacttgtcaggagaataagtacaatgctggctctggcactagttttctttatgaattatctttgtaagtgtaaaagcactaaaatataaatacaagataccaccgttgatatttctgcattaagaatcaatggtagagagttctagagtgggtgtgaatataattaagtggtctccccttattaaatcagttgaagatagttaaaggtacctactcatctgaattggaagcaagatgtggattaattcaaaataatagctaataaaagcttttccacttatctttaaaaagcattattttaggaaggcaaatccactggagaatttttttaactcataaaatgaatcccagagtcacaaataatattttattttctgaattactgtgactaattgaaatttgacttcattgtataaattgcttgataattcatttactacataatgttaaaaattgagatcctatgactcatgtgttacaattttcttttctacctgattctgaaagactttttatgattttccaagtagcaaatttaattttctttttgagacttagatttttctttagcaaaatgaaataattactgaataattaacttttttactttgactgatttaatttgaatttgcattttgttagtccctcaaattgtagtgtagcattttcttagatggcggtaagtggatggtggtggaaagaataggtttgattttaggcacacttcagtcacaacttctcgccagctctgtaatcttgggcaagtgtcatgactcctgagagcctcagattatcatctgtaaaatggggacaataatgcccatcttgcaagattattatgaagaattaaatggagacatatgtaaaatcattagcacagcgtttggcccactgtagacacttagcaaatggtagttattttaatatcagtaacctttgtagacttcagcaatccctccaaaattattaaaagtgttctagacaaggagaaaagattgcacatttcatatgagtaaaagatacccctcaattaggcaaaggttgatatatgttggatacaggttcacactccctcatatggaattctgaaaaccaaaatttttttctaaagacctaaagtttttcagaacttatttgacagcaaaatatgacctaaactcatttcttgttcacatcaactaactcctgatgtgaactaacataaggtctttatttcactttgtgtaaattttcctatgtttcaatataaaattaactaattttgattatggggtgctgcccccatctcttctggggtgctacatatgtgcactatatgctctatattacaatcctaaaatctaaaaaactccgaattttgaaacacagctgagttaaggatttctgataagatactgtgaacctgtacttgctttcttggtctgctacactcaggatttgtagaaggataaagatgaatggaatgaaacagtctcacaagtttttcaattgtttagaatcccaacagaaggccaaagaagtttgccccatgtactttatgaagctccgctctggccttatgataaaaaaggaggcctgttactttaggagagaaaccaccaaaaggccttcactgaaaacaggtaaggggaaccgtacattctctggcaatagtgataagtatctgtttgccttcacttaccacatctaaatatgcaattatttttcctcactccaaggttccttttggaaaatattaagaatgatgaactggtttttagctatttttaaaagggcatataaagaattttcaatagcatgagagaaatgattatgttataatgttaagtgaaaacaaaagatacataactatgtgtaaatatgtttacaatatttttaagtgtttttttaatttaaaggaaataggtttaagcattaatagtgcttgccttttgggtgttgagactgtgggtgactagttttcttcctcctgatctctaatgagtgtgcttctactggggaataagtgtgccaagaggtatcaatccctttggaccatgaagtggccaaagccctggagtcaatcactactctcagcaagcagccttaactgggaatcctcaaaggggcatttgtgcagagtggggattgatggtctatccctaatcccatccggtctgcaggtagaaagcacaaaagacatctggtactcgctgcctgtcaacagcagtctactgtggagtgctttgcctttggtatatcaggggtccagaaatatactagagcacttcatgattcaagtatcacaggtatgactggttacaggggtgatgtgggagtgaggagggaggtatgacacaggaccccggaaagtgctactccaggtagcagtcccaagtctgtgtctttaatgtgtaccagaaacttctgcccatttgcagctgatgtacccatctaatagtatccaaagtaggtgcaaggtagctgttctaataatgtacatgcattctctagttagcactccatcattattttgaaatacttgcaatggattggaatcccatggtcattagttttggtgaaaatatgttatcttttgggaaaaaaacacattttccccccaaatttcaatattttgaccatgaaagaaaagagctattatatttttaaatataattctaacactttatacattttaagtagtagttaagatggttttaaattttatcacttccttgtataaggttccaagttgatgatgacttcaagaagtgaagagatcatcattaaaaaaaaaacttggccaggtgtggtggctcacacctgtaatcccagcactttgggaggccgaggttgatggatcacctgaggtcaggagttcaacaccagcctggccaacatggcgaaaccctgtctctactaaaaatacaaaaatctgttggttgtggtgatgtgcacccgtaattccagctacttgtgaggctgaggcacaagaattgcttgaaccttgacagaggttgcagtgagccgagatcatgtcagggcactctcgcctgggcaacaagagcggctgtctcagaaaaaaaacaaacaaacaaacaaaaaaaaacccaacaaaaaacaaaacaaaacaaaaaaaccaactttacctggaaattgcatttgccatttcaagcattattcctgctataaatgtcctaaattcccagaagcaacactgaagttttctcattaagtatttctaaatcatttactttagaagttcatgtacaaattcagtatgtaacattctccttaatattttgtatactatttttttccaggccccatctgagtagtccctaaatctgctccagtttacctcagcaggctataaaaatattatcattttctatgggtattttgacactttttaaaagttgggagcactgcactaagtgtccctgttatttagccagaggagagaacagggcttatatccgcattctccaggactgtcagaaacttctgggtaactccatactttatagatgaacatttatttatccatgtctatcaaaatacagtcccttctttaccacagtccccagaccaagtggtgtcatgaagtgaaggtttcctcaagcaatgtctgttgctttccattttctttttccccaccaaaccctcccataagcacactcacatggcctcccagggccttcatgcaggacactagcacctttaatcccattcaagggtcacatctcagccttttagctatgtaaaacttgtatcaaaggctttaatctagccaacagtgacatacaaaatgcaactcaaattgcaaaaatgttttttgagggagcattttttaaaaaggttgccaaaagaattgtgcctgacaaatttttgaattcttaacaacaggaatttcacctattacagagtatcttgcttctctaagcacatacaatgatcaatccattacttttgctttggaggatgaaagttatgagatatatgttgaagacttgaaaaaagatgaaaagaaaggtagattattttctttttctataataatgtaataatgactaataaaagtaaaacattttaataaatctaccaaactttaaacaatggattaacttagacatggcaaacaggtcatgctgtgtgctaactctaatgcattggcagtgggtgcctgaatccacttctatgtcaagatggattcagaagctttgtcacgttcatcagagaagaatgctgacattgaaatgcagtatctgttgtgaaagatggaaagaggggccacatgtatttgctatctctaaattatccaccagatctttctagccctattagtatcaccaaagtacaacctttatgccactgctatgaaaaatattttaaatattttaataacaactatattggagaattcatcagagcatattcgtgcatttttgagacctttctcaaaaccacaaaagatttgtttttattgatatataataaaaggggaggatattttctgatgttatgtgtgtgttggaactgaaaacttaacaaaattgtgtctcaccagagggattttatgcattctctttcagataaggtgttactgagttactatgagtctcaacacccctcaaatgaatcaggtaatttggagggctgggtagctgtagtgcttgaattcttaagtatggggtaaagataaatccaaaaaaatcctttttgccccataggaaaaaagatagtctcagaaggttatctccaacccaagctcatggtaaaaccttagattctcagaggatgcattctcatccattttacagcttaatcgttaggataaagttttggctacacttaatacagatccaaaacaagagtggtttatgctagataaaactttctgtcttagccagggctgcaatggctcaacaagttgtccagggaacccatctccttctatcttgtggttctgccaacatctacatggttcaagagtacttgggagcatgacaatgcctggtcagcaggacacagaaaaacagatgtatgcattctatttccctttaagggtacaacctagaagttgcacctaacacttcctcttatctcacattggtcagaactcagttgtattactacacttagccataagaaggcaagctggggaatgttctattactatcccaaaagaggaatgaatattgggtgacactatgagtggctttacatgcagacaggaaagctgatgccccgagaagtaaccattagggtcacaactctccaattaaaaagcatataagaaaactaatttctctccggtttataagtaccctctacttatcagtgcctcttgaacttgggtacaaatacttctaagatacctgttagtgaatgaagtaattattttatgtaacatcttagacttttttcctgggtgttgaattcatttaaataaagatgagttacagttcttaactttatcatttatactttcttaattgtaaggtgacggtgttgatggtaagatgttaatggtaaccctgagtcctacaaaagacttctggttgcatgccaacaacaaggaacactctgtggaggtaaaaaaaaaaaatttatctatatctatatatatgattacagaactgtcatgaatgactccaccaacttgtgtagatttgggtgttggggtattttgcagaaggatttttttgtgtgctattgtatataaagcacaatcacttactacaaatgacttgcttctagagtaaggaagggaggaaagtggcatgtatggctttgctattgaaagtctgctctctgccagcagcagagcatcacctgggagcctgttagaaatgcaggattctaagccccccagaaataaatcagaatcagcatattttaataaatctccaggaaattcatatgtgccttaaagtttgagaagcactgttacatagaatgatctcaaatcctttctgtttggctttaggaactactatgttcctctaggaaacgtttctttgtataatatcattttcttaaacaaatacaaaaaaaatttccattctgagcctgcttaagggagagtcataagcgtttccatgtgccaagatttataaataacctaacatctacattctgaacatagaattaattgcatattcttctttagttagcaaatggcattattacattggtcatgatgtgtaattataactattttgacaaacaagccaaaggtagaggcatggaagaaaacagaagagagcataatatagaagataaattatacaaacacagaaaaatataaagctaactaacacagccatgtaaggccttattaacataaatagtggatagtaaccagcatcttcctaagcaaaacattcctaaacatatataatctagtgtttggcatgtataactactcaataatagagctacttagactgagctctattatatagcaagcactgggctaaatgttttacaaatattattttatttaatactcacagtaactctacaatggagttgttgtattggtcaactgttgctatgtaacaaaccatcccaaaacttagtgcctcaaaataataatcatttatatttactcatgtctgtagatattttgaggattgactgatctagaaaactggttagactaaaaaaaatgaggcttgagagataaagcaacatccccaagatctcagagatagtacatgtcaaaagaagggtacaaatccagaactgttgcatccagatccaatcaccctaatccatactgcctctctatgttgactatcagtgaatcaaatcaaatccacccactacccctctggccctctactcacttctccccctcttccctccacaactcactaagcaagcttgctagaaatatcaagtcataaataagtattcccctttagtttccaatacaggcaggtaaagttgactctgaacttcccattcacatatggattgctttctctcttgtttcctcagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtatgtgagactataatgattttatcatatgatgactcaatattctgaaatttctttttttattatactttaagttctagggtccatgtgcacgacatgcaggtttgttacatatgtatacatgtgccatgttggtatgctgcacccattaactcatcatttacattgggtatatctcctaatgctatccctcccccttcccccaccccacaacaggccctggtgtgcggtgttccccactctgtgtccaagtgttttcattgttcaattcccacctataagtgagaacatgcagtgtttggtttttagtccgtgcgatagtttgttcagaatgatggtttccagctccatccatgtccctacaaaggacatgaactcatcctttttatggctgcatagtattccatggtgtatatgtgccacattttcttaatccactctatcactgatggacatttgggttggttccaagtctttgctattgtgaatagtgccgcaataaacatacgtgtgcatatgtctttatagcagcatgatttataatcctttgggtatatacccagtaatgggatggctgggtcaaatggtatttctagttctagatccttgaagaatcaccacactgtcttccacaatggctgaactagcttacagtcccaccaacagtgtaaaagtgttcctatttctccacatcctctccagcacctgtttcctgactttttaatgttcaccattctacccggtgtgagatggtatctcattgtggttttgatttgaatttatctaatggccagagatgatgagcattttttcatgtgtctgttggctgcataaatgtcttcttttgaaaagtgtctgttcatatactttgcccactttttgatggggttgtttgagtttttcttctaaatttgtttaaattctttgtagattctggatattagccctttgtcagatgggtagattgcaaaaattttctcccattctgtaggttgcctgttcactctgatggtagtttcttttgctgtgcagaagctctttggtttcattagatcccatttgtctattttggcttttgttgccattgcttttggtgttttagacatgaagaccttgcccatgcctatgtcctgaatggtattgcctagggtttcttctagggtttttatggttttaggtctgatatttaagtctttaatccatcttgaattaatttttgtataaggcgtaaggaagggatccagtttcagctttctacatatggctagccagtttccccagcaccatttattaaataggcaatctttccccatttcttgtttttgtcaggtttgtcaaagatcagatggatgtagatgtgtggtattatttctgagggctctgttctgttccattggtctatatgtctgttttggtaccagtaccatgctgttttggttactgtagtatagtttgaagtcaggtagcgtgatgcctccagctttgttcttttggcttaggactgtcttggcaatgcgggctcttttttggttccatatgaactttaaagtagttttttccaattctgtgaagaaagtcattggtagcttgatgggatggcgttgaatctgtaaattaccttgggcagtatggccattttcatgatattgattcttcctatccatgaacatggaatgttcttccatttgtttgtgtcctcttttatttcattgagcagtggtttgtagttctccttgaagaggttcttcacatcccttgtaagttggattcctaggtattttattctctttgaagcaattgtgaatgggagttcactcatgatttggctctctgtttgtgtgttgttggtgtataagaatgcttgtgatttttgcacattgattttgtatcctgagactttgctgaagttgcttatcagcttaaggagattttgggctgagatgatggggttttctaaatatacaatcatgtcatctacaaacagggacagtttgacgtcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttatcatagatagctcttattattttgagatacgtcccatcaatacctaatttattgagagtttttagtatgaagggatgttgaattttgtcaaaggtcttttctgcatctattgagataatcgtgtggtttttgtctttggttctgtttatatgatggattaaatttatggatttgcacatgttgaaccatccttgcatcccagggatgaagcccacttggtcatggaggataagctttttgatgtgctgctggattcagtttgccagtattttattgaggatttttatatcgatattcatcaaggatattcgtctaaaattctctttttttgttgtgtctctgcccagctttgttatcaggatgaagctggcctcataaaatgagttagggaggattccctctttttctattgattggaatagtttcagaaggaatgttaccagctcctctttgtacctctggtagaattcagctatgaatccgtctggtcctggacttttttttggttggtaggctattaattattgcttcaatttcagagcctgttattggtctgttcagggattcaacttcttcctggtttagtcttgggagggtgtatgtgtccaggaatttatccatttcgtctagattttctagtttatttgcatagaggtgtttacagtattttctgatggtagtttgtatttctgtgggatcagtggtgatatctcctttatcattttttattgcgtctatttgatttttctctttttctttattagtcttgctagaggtctatcaattttgttgatcctttcaaaacaccagctcctggattcattgatttttttgaaggtttttttgcgtctttatttccttcagttctgctctgatcttagctatttcttgccttctgctagcttttgaatgtgttagctcttgcttttctagttcttttaattgtgatgttatggtgtcagttttagatctttcctgctttctcttgtgggcatttaatgctataaatttccctatacacactgctttaaatgtgtcccagagattctggtatgttgtgtctttgttctcattggtttcaaagaacatctttatttctgccttcattttgttatgtacccagtagtcatttaggagcagggtgttcagtgtccatgtagttgagtggttttgagtgagtttcttaatcctgagttctagtttgattgcactgtggtctgagagacagtttgttataatttctcttcttttacatttgctgaagggtgctttacttccaactatgtggtcaattttggaataagtgcaatgtggtgctgaaaagaatgcataatctgttgatttggggagttctgtagatgtctattaggtccacttggtgcagagctgagttcaattcctggatatccttgttaactttctgtctcgttgatctgtctaatgttgacagtggggtgttaaagtctcccattattactgtgtgggagtctaagtctctttgtaggtctcttaggacttgctttatgaatctgggtgctcccatattgggtgcatatatatttaggatagttagctcttcttgttgaattgatccctttaccattatgtaatggccttctttgtctcttctgatctttgttggtttaaagtatggtttaccagagactaggattgcaacccccgctttttttttgttttccatttgcttggtagatcttccaccatccctttattttgagcctatgtgtgtctctgcatgtgagatgggtctcctgaatacagcacactgatgggtcttgactctttatccaatttgccagtctgtgtcttttaattggagcatttagcccatttacatttaaggttaatattgttatgtgtgaatcttatcctgtcattatgatgttagctggttattttgctcgttagttgatgcagtttcttcctagcatcaatggtctttataatttggcatgtttttgcaatggctggtaccagttgttcctttccctgtttagtgcttcctcaggaactcttgtaaggcaaggcttgtggtgacaaaatctctcagcatttgcttgtctgtaaaggattttatttctccttcacttatgaagcttagtttggcaggatatgaaattctgggttgaaaattcttttctttaagaatgttgaggccgggcgcggtggctcacgcctgtaatcccagcactttgggaggccgaggcaggcggatcacgaggtcaggagatcgagaccacggtgaaaccccgtctctactaaaaatacaaaaaaattagccacgcgcagtggcgggtgcctgtagtcccagctactcgggaggctgaggcaggagaatgatgtgaacccggaaggcggagcttgcagtgagcggagatcgcgccacagcacttccgcctgggcgacagaacgagactccgtctcaaaaaaaaaaaaaaaaagaatgttgaatataggcccccactcttttctggcttgtagagtttctgccgagagatccgctgttagtcttatgggcttccctttgggggtaacctgacctttctctctggccgcccttaacattttttccttcatttcaactttggtgaatctgacaattatgtgtcttggagttgctcttcttgaggagtatctttgtggtgttctctgtattttgtgaatttgaatgttggcctcccttgctaggttgaggatgttctcctggataatatcctgcagagtgttttccaacttggttccattctccccatcactttcaggtacacgaatcagacgtagatttggtcttttcacatagtcccatatttcttggaggctttatttgtttctttttactcttttttctctaaacttctcttcttgcttcatttcattcatttggtcttcaatcactgataccctttcttccagttgatcaaatcggctactgaagcttgtgcatgtgtcacatagttctcgtgccatggttttcagctccaccaggtcatttaaggtgttctctatgctgtttattctagttagccattcatctaatcttttttcaaggtttttagcttctttgcgatgggttcgaacatcctcctttagctcagagaagtttgttattaccgatcttctgaagccttcttctctcaactcgtcaaagtcattctctatccagctttgttccattcctggcaaggagctgcgttcctttggaagagaagaggcactctgatttttagaattttcagcttttctgctctggtttctccccatctttgtggttttatctacctttggtctttgatgatggtgacgtacagatagggttttggtgtggatgtcctttctgtttgttagttttcctcctaacagtcaggaccctcagctgcaggtctcttggagtttgctggaggtccactccagaccctgtttgcctggttatcaccagtggaggctgcagaaccacaaatgttgcagaatggcaaattttgctgcctaatcattcctctggaagctttgtctcagaggggcacctggatgtatgaggtgtcagtcagcccctactgggaggtgcctcccagttaggctactcaggggtcagggacccacttgaggaggcagtctgtcagttctcagatctcagacttggtggtgtgagaaccactactctcttcaaagctgtcagacaggaatgtttaagtctgcagaagtttctgctgccttttcttcagctatgcccttcccccagaggtggagtctacagaggcaggcaggcctccttgagctgcggtgggctccacccagttagagctacttggccactttgtttacctactcaagcctcagcaatggcgggcgcccctcccccagcctcactgccatcttgcagtttgatctcagactgctgtgctagcagtgagcaaggctccgtgggcatgggaccctctgagcaaggcacaggatataatctcctggtgtgccatttgctaagaccattggaaaagtgcagtattaggatgagagtgacccgattttccaggtgccgtctgttatggcttcccttagctaggaaagggaattccccagccgcttgtgcttcctgggtgaggcgatgcctcaccctgcttcagttcacaatccatgggctgcacccactgtcctgcacctactgtccaactagccccagtgatatgaacccagtacctcaggtggaagtgcagaaatcaccgtcttctatgtcgctcacactgggagctgtagacttgagctgttcctattcagccatcttggaaccaagaccccgatattctgaaattcttaagtgaaagtaagcatattccaatctaccaatgttggtatccggagtaggtcattacctgataattttggttattcaaaactaagtaatattttcaagagaagagattgtgtctttttcacctttgtactgtcagtgcccatactggtgggtggcaagaaggtgttcaatgacttttactcagaatcaaacatctaacaggtacctgcaccagaaccttgatctgatcattctgactccttaggtagataactttcaactcagctcacttattttctgtgtttaagtttcctttttttaaaaaaaaaatttccaccatcattatagtcagtataatttgattaaaatattcaaatatgaggtggcatttttgtcacttacctgtatgtgttttcatggtccaaatacacattactggaaagaatttgttcatttcattgtatcaggaaggataattgtgtcaaaacttactttttcctcattttatttgtcttctttaggtttttatgtatttactgactatcttgaaatactgtcaagaaaattttatttgaacgagtaaaatgacttagaatcgggaagaaataagtaagagttgagattcagggggaatttggaaagaaaattgccaacctaatttgaaaacagcagcttgatttaaaactaaaacaatttattcataatccccacttctgcagaacaaaataagccaaaaaataatttcaatccttgtgcctcacactgaaaaatttcatgatggatagaaatcttcagctgcaatcccattactgggtatatacccagaggaataggaatacaaatctttctaccataaatatacatgcacacaaatgttcattgcagcactattcacaatagcaaagacacggaatcaacctaaatgtccatcagtgacagactagataaagaaagtgtggtacatatacacactagaatactatgcagtcatgaaaaagaatgagatcatgtcttttgtgggaatatggatggagctggaggtcattatgaatttataaatacaagtagactggggtctacttgagggtggagggtgggaggagggagatgaacagaaaagttaactattgggtactgggcttaattcctgggtgatgaaataatctgtacaacaaactcccatgacatgagtttacctatgtaacaaaccttcacttgtaccctctaacctataacaaaagtttaaaaaaaataattttaaaaacagaaatcttcagctgtggtatgccagtgggtggttggagtagtaggcttgtcccaaaactccttctcccttcaagtataagcctatacagccctgaaatctcatcttctagcagttatacatcaaataggtgccatatgtactgtgactttgctaggcaccatgacagcacaaaagaaacttaagccatgctccttgttcacatggaaattaaaacatgtaccatatgtattattattattttttttaaacagagtctcactctgtcacccaagctggagtgcagtggcatgatctcagctcacggcaacctctgcctcctaggttcaagcaattctcctgcctcagcctccctggtagttgagactacaggtgcctgccagcacgcccagctaatttttgtatttttttagtagagacagggtttcaccatattggccaggtgggtctcgaactccggaccttggtatctgcctacctcggcctcccaaagttctgggattacaggcgtgagccaccattcccagccccctaaaacgtgtaccatatgtattataactccaactctgcagtacagttgtacaaaggtgagaaagatcagtgtggatttgtcatcagggaaagaaatataactgaattgtctatccccataccctaacacccatccctatctattcttatatccattctcaaggtcttgttaagcaggttcctcatgtaggtcttaggtaaaaggggtaaattcagttgttttaacccctttagtggtcaggattatatatggggacttaggaatctgaggaaataaatcaagagatgaaagtgattgtgagttggtagagggaggatcgatgaattatttcctgctgaagtgccaagatgactgtgatggttaatattaggtgtcaacttgactgaattgagggatgcctacatggctggtaaagtattatttctgggtgtgtctgtgaaggtgttgccaaaggagagtgacatttttgtttgtttgtttgtttttgagacagggtctcactctgtcacctaggctggagtgcagtggagcaatctcagctcactgcaacctcagcctcccaggctcaagtgatcctcccacctcagcctcctggggagctgggactacaggcacgtgctaccacatccacctaatatttgcatttttttgtagagccagggtttcactatgttgtccaggctgctctcaaactcccgggctcaagcgattcgcctacctcagcctcccaaagtgctgggattataggctgagccaccgcatcctgccaagattgacttttgagtcagtggactgaaaaaggaagaaccaccctcaatgtgggtaggcaccattcaatcagccaccagcacaactagaacaaagcaggtggaagaagggtgataaacttactaacttagtcttctcactctcttcccttgccgggcacttgcttcctttcctcctatcctcggacatcagactctaggttcttcagctttggactctgagatttgcactagtggcctcccaggggctcttgggccttcagcctcagactgaaggccacactttcagcctccctggaattgaggctttctatcttggactaaaccgctctaccagcttctctttttccccaacttgtagatggcctattttgggacttcaccttttaatcgtgtgagccaattatccttaataaactcagatagatagatagatagatagatagatagatagatagatagatagatagagtgtatatatacattgtgtgtgtgtgtatatatatatagatatatatatatctatatatatatatctatatagctatatatatatatatctatatagctatatatatatatatatatctatatctatctatctcctactggttctgtccctctggagaaccctgactaatacaaagatgaaatacttgtccaagtttaattacagtccctagcacagaggatgcgcccacaaagagatcacgtgaatcagtgtccaatgtattaagagcagggttggtttgctgcttataggctgtgcaactttggtaaggtaagtaacctctctcaatatctatttctcctctgtaaatagggagtaccaaatattgtaattgtctacctaatatccacaaccaccatccctactgctttaccaatagaccctcatttttttttttttaccagacaacagtgcacacaactaaaaatacactctttcccagattccc

SEQ ID NO: 1265 - DNA, 70849 bp, Homo sapiens
acctctccaggtctcagccacattgataacttcattgtccatccatccatccatccatccatccatccatccatccatccatccacctgttcattcattcactaaacatttataagcatttaagtatgccatgcactctgtagattctgaggataaacacagttgttcacagctatatcacagtatctagcacagtgcctggcacatagtaagtgctcaagaaacactgattcaaggaataaatgaacaagataaagtcactgcactcaaagagctgactgtctaatagagaaaacagacacttagaattacaatatactggacacctatccaatgtgcttcgggtaaacaggaaggagcttgtctggaaggctgaagaaggctccactcaggaagtcacaggccttcaaggagagggggatttcagcaggctgagaaaaagaggcagcacacagccagcccagggaatcatgtcaacaatggcacagaactggaggagaagaaattaatttttttttttcgagacagagtctcactctgtcacctaggctggagtgcagtggtatagtcttggctcactgcaacctctgcctcccaggctcaagcgattctcctgccttagcctcctgagtagccgggattacaggcacccgctactacacccagataactttttgtatttttagtagagacagggattcactgcactggccaggctggtctcgaactcctgacctcatgatatgcccgccttggcctcccaaagtgttgggattacaggcatgagccaccgcgcctggccaaaattaatattattaatcactttccatggaccagacattttatttttgcctttacactcttagaaaggactagaatttatccaccatgaaatcttggcatgcctagactccttctgcctcttgctctcccctcctctgggtctcagctctcacttaaattattgtgatgctccccgccccccaaacccatcagtcaatagttgtgtctccctctggttcaccatccgaatggctgccagagggattgtttcaaatttcaaggctgagcctctcgttcctttgtttggaatccttcaatggctccacatctcctgaaggctgtgtttaagaccttttgtaatatgaccatgaattgcattgcatgccccacccctggcactccctaaggtatacttgtacacctccaaactttgctcccactgctctttctgccttgggtgcccatctccccttctgcctccaatttgggggctatttttactctccagaggacatttggcaatgtctggagacattttggatgtcacaactaaggggatgcttctgcaatctgctgggtaaagattaaaaattctgctaaacatcctacaatgcacagaaagtcccccacagcaaagaattatctggctcgaaatgtcagtagtgctgaggttgagaaatcctgctttgacttttcaggaatggggagcttcagaaggattctcaacagagagtgagagatttagctttggaaactctggcagctgtctgtgatggccaagaggaaggcaggactgcagaccagtgtaaatcatgacctttcttcctcttttcttcctcctcctggaaatcagtgaggtaagctggcaagagtctattgctcttcagccagaaacactaagctctgtgggcactcctcccagatggcaaatgatatctatcgcaacaagcaaagtgaatatgtcacatctcttaggtttctgggagaggtttgtttctcctgagaaagtgtgctcactcacactcaacagctatgggatcttgagagagttactttcctgtctgtgcctgttctcttgtctgtgaaatggagctaataacagtacctacttcttggagttttgtgaggattaattaatatattacaagagcctacaacagggcctggtacgtagtaagtgtggttatatgtgttagctcttaacatcatcacatcttcctccccactatcaccatcatcatcaccaccactaccaccatcaacatcatcaccgccaccatcactatcatcatcaccactgccaccactaccattatcaccacgaccatcgccatcatcaccatcaacatcatcaccaccatcatcaccatcaacaccatcaccaccaccaccatcaccatcatcaccgtcatcatcaccacccccaccatcaccatcatcaccgtcaacatcaccaccaccaccaccatcatcaccatcaacatcatcaccaccaccaccatcaacatcatcatcaccactgccaccatcaccatcaccatcaacatcatcaccaccgccaccatcaccatcatcaccgtcatcatcaccacccccaccatcaccatcatcaccatcaacatcatcaccaccaccaccatcatcaccatcaacatcatcaccaccaccaccatcatcaccatcaacatcaccaccaccaccatcaacatcatcatcaccaccgccaccatcaccatcatcaccatcaacatcgtcaccaccgccaccatcaccatcatcaccgtcaacatcgtcaccaccgccaccatcaccatcatcaccgtcaacatcgtcaccaccgccaccatcaccatcatcaccgtcaacatcgtcaccaccgccaccatcaccatcatcaccgtcaacatcgtcaccaccgccaccatcaccatcatcaccgtcaacatcgtcaccaccgccaccatcaccatcatcaccatcatcatcaccaccaccaccatcaccgtcaacatcatcattttattttagagaaagtttatctgttgaacctgatttgccagaggtaagagggatatgactggatatcattcttccccaagggtggaagcaaggagtcaaccctcagcctctgcacaatctcctggctatatccacagagcttgactcgggttgttggcaaacccctgtgtcttcacccaccaaaaccagttgagccatgattcccaaatggctcccactctcaaaataattccattgggtctgatctgttaagttgcaaaataacaaaaaactcaataataggaacataaacagaggttaaattttctctagttacatggaatctggaggttggtcacaactggtgcggttcagctgctcaaaaatgtcaggggctgggtgcagtggttcatgcctgtaatcccagcactttgagaggccaaagcaggtcgaccacttgaggtcaggagttcaagaccagcctggccaacatggagaaaccccatctctacaaaaaatacaaaaattagccaggcgtgatggtgggcgcctgtaattccagctactcgggaggctgaggcaggagaatcacttgaacccaggaggcagaggttgcagtgagccaagactgtaccactgcactccagcatgggtgacagagcaagactccgtctcaaaaaaaaaaaaaaaaaaaaagatatcacggcttctgtgtctagaaaattcttcacctgacaagaattccagatattagctcttgctggggttgattcagttgttcacagatgtcagtgctcctgtactgcagttgtcttggccttctctcatggcggcaagatgtttcacagcaggaagaccctttcagtcaggaaagccaaccttatcccagaagcattcccctacacacagaaacttccatttgggtttcttcaacagaaaaaaagaaaagttacacagatttggaaggaagaaaccaaactttctttgtttgcagatgacattattgtctacatagaaaatcctaaagaattaaataaaaaaccctcttggaactaataagtgtgtgtagcaaggttgcaggataaaaagttaacatacaaaggtcaactgctttcccacataccagtaataaacaagtggcatttaaaattaaaaacacaatgccatttatattagcaccaaaaaagaaagaaaaataaatacttaagtataaatctaataaacatatactggatctttatgaggaaaactacaaaattctgatgaatgaaaccaaagatctcaataaatggagagatagtccatgttcatggagaatttttcccaacttgatcttacggattcagcacaatccctatcagaatcccagcaagttattttgtgagtattggcaaactgattctaaagttcaaacagaaaggcaaaaagcctggaatagccaacacaatactgaagaacaacaaccaagttgaaggactgacattacctgactttaaaactataaaataaagctacagtaatcaagacagtatggtgcaggtgaaagaagagacaaaaagaataatggaacagaatacagatccccaaaatatactgacacaaatacagtcaactggtctgtgacaaagaggcaaaggcaatccagtgggaaaaggatagtcttttcaacaaatgttcctgaaacaactggatgtctacatgcaaaataataataataaatttagacacagaccttacacctttcacaaaaaataactcaacataaatcgtggacctaaatgtaaaatacaaaattataaaatttctagaagatatcataggataaaatcttggatctcagtgtccttaggtttggcaatgagtttttggatatgacactaaaagtataatccaggaatgagaaaaaaaattggtggtttggagtttatgaaaattgaaaactatattaaatttgaaaatctttgcaaaacacatgtctgataaaggacctgtatccaaaatacacaaagaattttaaaactcgacaataagaaaacaagtaacccaactaaaaaatgggcacaacatatcaacagacaacaaataagatatacagatggcaaaaagcatatgaaaatatgttcaacatcatatgtcattaggaaattgcaaatttcctaatttgcaaacattgacatatgcatcttaagtcactaggaaattgcaaacaatgatgagataccactatacacttactagagtggctaaaatcctcaaactgacaatatcaaaagctgacaagaatacagagcaatggaaactctcacttgttgatagaaaggcaaaatgttacagctagcttcgaagacactggcagtttattgccaaactttcttacttttaccatatgatccagcaattgtgctccttggtatttactcaattgtgttgcaagcttatgtccacccaaaaacttgcacatgagtgttgatagcagctttattcataattgccaaaaattggaagcaacaaagatgtctttcaataggtagaatggataaactgtggtacatccatacaatagggcactattcagccacaaaagaaatgaggtgtgaagcctggaaaagacattgaggaacctgaaaagcatattgctaagtaaaagaagtcagtattaagagactacatactttctgatttcaattacgtgacattctgaaaaaggcaaaactatggagacagtaaaaaaatcagtggtttccagaatccaggaagaataggtagagaattggggatttttagggaagtaaaactattctttatttttttctttttttttttagagacagggtctcattctgttgcccaggctggagtgcagtggcatgatcatagttcactgcagcctcgaactcctgggctcaagggatcctcctgcctcagcctctgagtagctgggactacagtgcaccaccatgcctggcctgttttttgttgttgttgtttgtttgtgttttttggtagagaccgggtcttgctatgttgcccaggctgggaaactattctttttgttgctacatgtgtggatccatggcattatacattgttaagacccagaacttggctgggtgcattggctcatgcctgtaatcccaacactttgggaggccgaggctggtggatcacttgaggtcaggagttcaaaaccagcttggccagtatggggaaactccgtctctactaaaaatacaaaaattagccaggcgtgcacctgtagtcccagctacttggaaggctgaggagtgagaatcgcttgaacctgggaggcacaggttgcagtgagttgagatcacgccactgtaccccagcctgggtgacagaacaagactctgtctcaaagaaaaaaaaaagactcagaactgtgctgcagaggttaggcacagtggctcatgcttgtaatcccagcactttaggaggctgagatggaaggataacttcagcttaggagtctgagaccagcttgggcaatgtagcaagactgtctctaaaagtataaaaaaaaaaaagcctagtgtggtggcatgttcttgtagcccaagctactcagaaggcagaagcaggaggatcccctgagtccaggagttccaggctgctccagcctgggcaacagagtgagaccttgtttccaaacaagcaaacaaacacaaaacaaaacaaaacaaaacaaaaccccgagaaacagtgaaacaatgtatgctatggactttagtttataataatgtatcagcattataaggaaggcactacacactaatgcaagatgttgataaaagaggaaattttgcatgggggagagggatgtatgggaactctcagtactatcggctcaatttttccataatctacaatggttctaaaaaataaactctattagttttaaagaccgaaaggcttggaaacaagtaagcgtgttaggatataatgaggattgagcttatactgaggcaagacttgggaacccctagatgggggaacagaggttttactatcttggtgcctttggacctgctcccaggactgacggagcagtcacagataaagtctgggcatcttgggcaggaacttgaacagtgggactgtatgcaagaagacatttattatctctcttgcacccgagaacaatgccctgttttctttaactttgtaatttgacataatttcagactggcgggaaagttgggagaagagtacaaagaattcccgaagtctcttcccccagatttcctgaatgtcttagcctctgaccacagctgtgctttctttgcctgtcttctcaatgccacgttcatctccatttcacaaccaagcaacagaccaaggcaacaggcttcgactttgcttctttctcattttcatcctgataagaacagcaattgacattttgaatgcctaatccacgccaggcactattctaggcactgcgatacgtaccttgccatttcaccatttcatagccctatgaggtgggtctattattatccccattttacagatggggaaactgaagcacagggaggatgatctactttgcccaaagtcacatagtcaatacgtagcagagttggtatgccaatgccggcagtctagaggcaagcgaggaaaccgacgaaggatgacttgactgggaaaacaggatgggagcccagtttgggagtccaggaggggatatagcccaagccatacattcccaaaggacttcaaaggtagacttttgctgtcgtctcccgatgacatggggcacaaactcagaaacacagacaggacaaaggcagcttgcagggctgaactgcctgggatgaagcatcaaccgtgtgggtgtgcggatgtgtgagtaatgagtgtgagggagtatgagtgtggacgggagtggaagtcacacctaatccagaggattcctattcctcctgaaacccaagcttccaggaaagcccttcctgtggccttctctccctagtcctcttagcgtctgcctgggctgcccccagtacggggtttattacactcaattgcttacatctgttcacttcaattgcttacgtctgctcacttgtcagtgccccaaccaggtcctcagggctaggaagcaggggctggatctatttcttgctctccctagcccccagctcacgacttggcatatggaggcatccacaaacagatgccgaaggatgggagtttttccacactcccacgccacctccaggtatttgctcatgctgtcccttccacctgcatgtttttctgcattgattcaggcactggtcagaggtcacctcctccaggaagccatccctgaccccagggaactgacttatctttactgtcacttccgggggtgggttggtggctgtcttgctcacttggttgtaaggtctcagagggcagggattgtgtctgtttcatgtcttcaggtctgcgtcatcagcgcttgtcacaaggttagacacacagtaggaccaagacagaccaagtacatgaaagaatgattgacatatgggccaggcgtggtggctcacacctgtaatcccagcacttcgggaggcagaggcaggcagatcacctgaggtcaggagtttgataccagcctggccaacatagtgaaacctcatgtctactaaaaatacaaaaatgagccggacgtggtggtgcacgcttgtaattccagctactcaggaggctgaggcaggagaattgcttgaactcaggaagtggaggttgcagtgagctgagatcacccactgcactccagcctaggcaatggaatgagaccccatcttcaaaaaaaaaaaaagaatgattgacgtgcagtggcccctgccctgggaagccaaccctcaccctccaccacagcacttgatcccattgggcagtccttggcttccaccctcaaactgagagctccttgagggcagcagggggtcaaattactctctgggttctcagcactgcccagtgtgagtccaaatatctcccacctcccctgtctccgctctttcctcactcagggctccacagccatgccggccttcagcaattcctcctgcaggctgagctggttcccacagggcctttgcactagctcttccctctccctacacaagtcttcccccataggctcttcagagtctcagctcaaatggcctctactcaaaaagcctcttccagaccacctgccccactggtctaagaggtccctactttcttcttgggccctcctgacctgaaatactttgttgagtgttttccccccagtcatctggctgcatccgggttcttatggtgtccagacgttaatggtctatggggcctgtgttcgaatcccagctccacccctgctcctgcttacctgcagagtgattctgagtttctttcttttcttttttaaaattttataaatgtcaatttttgtagataggggtctcgctaacagggttgcccaggctggtctcgaactatggggttcaagtgatcctcccgcctcagcttcccaaagtgctgggattacaggcatgagccactttgcccaacccattttgaatttcttaaggactctgtgcctcagtttcctgatttgtaaaaccggtgatagtatcactcccttatagggtagttgccaggattgaacgagttaacatttgcagtgcccgacagattgtactagttactgattgaagggctgttttactatccaaatgtggctggagtaggagttgggtaaacatttattgaagaatgtgcaaccactctcacttggaagccgggctgttaggaaggggaggaggattccagtcgcccagccctcccccaccaaacgcaactgccccggcgcaaaagaggccgcggaggccaggcaggagcaggtcctggaggcctggtcggcgtgggcgttttattccgagaccaaggggatccactgcagagttctccgctgggcgtgacctcgggctacggcgtgggaggaagcgcgcggcaagacacccagcgaggtgctggggtcgcccccaggagaggacggcggctcggactgtccggcggcggcggcggggacagcgacaggggcgcgaggtggccgggacccgggccgggcgcgccgggcggggcggcgcatgcaaatctgccgggcgccggggcggggagcaggaagccggggcgggctgggtctccgcgcccaggaaagccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtacgtggacacccagcgctccccaaagccggtgctggcagtgagacctccgccgggacggcctgcgggggtggggggcttggggttaggctgtcggaggccacgcagcccctcttctccgggcagtggcgcccagccctgcgctcaggaagtcagtgaggacttcggagagagaaagggtggggaaagttctgagaactgtaaatttgagtagtaggtcagtgaatcggggcggtctccgcctccgaatatcagatggacccaataatcgcgatcattgactgggacttgttttactgaaaggatgccaagtgaaacctcccactaacttctctgtggccggtgctgtgcgtcatggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggatgacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaaggtcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccatttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctacaaaaaaaatttaaaaacttagccaggcgtggtagcaggtgcctctagccccagctatttgggaggctgaggtgggaggatggcttgagcccaggtggtcaaggctgcagtgaactatgattgtgccactgcactgtagcctgggtgacagagcgagactctgtctcaaaataaacaaatacataaatacatgagaagagagaaccttttctacctcccccatctccctgccctcttccacccaccccatctgggacgatggaggagagcgtttgggattagatgccccacctctcgactgccctcactggtacctgggagtgaggccaggacagaagccgcctaagtactgttcttcctcacatttgtaaaagtgaactttcttgagggttgatgacatgttttataagctacttcacacaatgtccaacacccagtgggtccacaatcaatgtatatgtctgttgttacctgtcaaaacgtatagctggggagtgacagtatggacttgagccagatcacccagtgcaaatgctggctttgctgcttactgtgtaactgacttcccagagcctcagtttctgcatttatgagattatagtgactatgccattgtagtgatgactaaatgagttaatatatgtcaagcatacaaaacagtacctggtatgtagtacaaactatgtatttgttaaatgaataccttttttttttttttagagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttactgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacagacctgcccttggtgaatgtggatcggagcgccccggcagaggcttgaggtgctacagaggctgggggatccactgtcagaccgggtgcatcaccactgttttatgatatccagcaaattgctctgcgtctctgagcttaaggcagagagaagggcctgagcttgaagaggggatcccaggtttaaatcggagctggctacttcccagctctccactgtgtaatctggaggaagttgtttaacctctctgagcctccctttgttttgtcatgggtgtttgcagggagagcattcatgagatagtttgtatagacattttgcccttggaaggcgctcagtgattgctgtttttctctgcattttggaccgagtcccttctgcgtatccagcacctggcttcctcctgcatttcttcctcaggaatttattgagcacctatatgtgccagagcatcggaccaagtcctttgctctcctggggtttagattctagttgagcatacaggcaatgtacaaccaatacatatgttcagatcggcagctttatctgttattctgaaatccacgatttctgaaaaccgaaagtttttcataactcattttgaagctaaacttgaggctttttagagtcttcatcctcttcggtgtgatgctcagatgtctttctgcagagatattagtgcaattgatctttgggtgctttcccgccctgcatgatgggcatgtcggtgggtattttatacaaggtgacctttctacagcctgagtcatcctgaattctgaactatgtctggcccccaggattttacaggagagaacatggacctgcaatatcctatcaggtggagactgtgctaggaaggaaagcaaagctgggtgcaagtggaatcagggagggcttccctgaggaggtgacatttgagagggatgaggaagagagggccaggtggagggactcacagaggacggaagactccacttcctgactggcctgtgcttacccctcattctgcatgcacagttctgtctaaatgcgtccgttcttgcctttccaagaagtgctgatgtctcttacgtttcaagtctagctctgactgactcattctctctttaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgggtcccgggaggggaagaggagccgtggggccttccaagggtttggtggaattgagttcctggtggggaggggctgtgttctgggtcttagagcctctcgcctgcaaagcaaagttgaacgtaacacgcgctcacatatctcgagtgccagcccggggctaggtgcttaacgcttgcttagccaaagtgccaggggctggggacacgggaatgagtgacccagaaatgagggccctcatggagctgaaagcattctgggcttggtgactttgaggaagtggcttttgaactgagacctgaaataccaaggcatgtggatatctggggaaagagtgatcctggcagtgggaacagagagtgcaaaggcccagaggcatgaatgagcttggtgtgtttgacccacagcaaggaagctggtgtggttggatggaaccaaacaagaaagaggtctaggagcagaggtcagggagggagctggggccagatacctgcattgtctcatttaacttgtgtaataaccctaccagataggagctactctcatgcaaatgttacagatgaagtaacagaggcacagagaggttcagtgacttgtccagggtcacacacctgaaggtggcagagcagggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcgggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccaggctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcagctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccctccaaactcggatacttctcttattcagactacacaactgtagttatttcaggtattctccctgactcaggaaattataagtttggcctgccttggcacatgagtcaactggttggagtcccacgcaaagactgtttgtttggtcaaagaggaaggagactattacctccttggatctagagcttatacttctgttgatgcaacctggaatcatactgtgtagcagccatatcccacttggagtgcatattgggcttgtcagctaaaatctccatgtttctcttctatatgagctgctgttaatccaagtttcttctattctgagagtccttgtctaaagctaagaggttccagtttttcatgctctctaataaatctacttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggtttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcctaggttcaagcagtctgcccacctcagcctcccaaagtgctgggattacaggcatgagccaccgcagctggctgaattgttcctttaatcagtataaaagagccaacttccagcctgggcagcatagtgagaccccatctctaccaaaaactaaaaattagctgggtgtggtggcgtgcacctgtagttccagctacttgggagggcgaggtgggagaatcacttgagaccaggaattcaaggccgcagtgagctatgattgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttaggcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggccagattctaaattcctacctggttacttcctgctccgtcaccatcacctcgggcaaattctgaacctccctcagcctcattcctccatctgtgcttgcagggagaatattttactgtatcttccatagtgagctttccaggagaagcaaaaaagagtggtgtataaaaaagcaagtttatgactgcttctgtgccaggcactgtgctgtgcactccagagccaaaggcctgggttcaaatcccagcccactcactagctgtgcatccttaggcaggttcctgaccctctctgggcctcggcttctccatctctgcaatggagatgatattaattgtatctgcaatgctccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacggtgttgtccccggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatgtggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaatacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccctggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtgcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacacttggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacatttttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctcatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctatatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccactgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggaaccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctccgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagcgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgcactaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgccttggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcagggaggtcatttcctgccacccatgtttccccaccctgaatccaccttcctcacattcccattggagggacaatctctggacatatgggacctggggtcccacagggctgcaatccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccgctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcgtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactataggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggatcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcgtgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctctttttttttttttttttttccgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacgaaaactcagaaaggttaaacaacttgcctaagtaacatacagctaattagtcgaggagcctgacgcatgttgctgtagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacaaacaagcccacaatttccatggcttaacactatgggaatatatttcttgctcacgtaacaagctaacgtgaatgttgctggtttgtaggtggtttccctccctgtagaaatctggggagtgaggttctttccatcttgtggtgccgtcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcgcataaatactgtaatttcaaagtagataagcataaataatactttatgatactgaaattgtgatgtgatatgagaatagctgtgagttttgttttgctggggacaggatcagtgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggccccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtaaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggtggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgcatttactgagcagctactacacaccttgagagtagagctgagaacatatcgacaaggaccccacttttttctttttttttttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtgcaggccagagatcttctggggtgctttttgcaagggggaccaggataaggctctccaaggagggaaaatttgaggggggccctgactggggagaatgagctggccagggataagcaagatggagtcatcccacatccccttacaacgctgggtgcctgggcaactgggggcatctgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaatttaattttattttttgggacagagtggagtctcaaaaaccaagctggagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccaccatgcctggcctcatataagcatttctgtctccatttatcatccatctttccctcttgaaggtcagtttcaccaaggcaggcatctttgtctcgttcactgttgtggcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctcgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagagacagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaacgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcttcctgggttcaagcaattttcttgcctcagcctcccaagtagctgggattacaggcatgtgccaccacgccaggctaattttgtatttttaatagagatggggtttcttcatgtcggtcaggctggtctggaactcctaatatcaggtgatccacccacttcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaagctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagacactgctgtgagtgctgtgtctctgttaactcctggaattcacccatccagaggaaccaggatgcaagaggttaagaaacttgccatctgggtttgggttccccatacaaggattcaaatagttgatttaggaagtaatcccgggaaaccctgctaaggtagtggggaactgaggcagggaaggacacaaaccaagaaagtgttacctgaaaggggtccagatgcagaccccaaaagagggttcttgaatctcatgcaagaaagaattcagagcgagtccatagagtcagtgaaagcaagttaatgaggaaagtaaaggaataaaagaatggctactccgtagacagagcagccctgagggttgctggctgcctatttttatggttattgattaattatattccaaacaaggggtggattattatgcctcccttttagaccatatagggtaacttcctgatgttgccatggcatttgtaaactgtcatggcgctgttgggagtgtagcagtgaggacaaccagaggtcactcttgttgccatcttggttttggtgggttagagccatcttctttactgcaacctgttttatcagcaaggtctttatgacttgtatcggtgacgacctcctgtctcattctatgactaagaatgccctaacctcccaggaatgcagcccagtaagtctcagcctcattttacccagcccctcttcaaagctccagtttaaataaacctctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagaccagcctggccaatatggtgaaaccctatctctaccaaaaaataaaaaattagccgggtgtggtggtgggtgcctgtaatctcagctacttgggaggctgagttggtagaattgcttcaacctgggacgcggaggttgcagtgagctgagattgtgccattgcactccagcttggatgacagagtgagaccctgtctcaggaaaaaaaaaaaaaaacaaaaaaaaccttgttctaagccaaaatcaatccctttagctgcccaaatcacacagtttacagatggagaaacagttttagagaggaaaagggacttgcccaaagtcacccagagaatggcagagcctgaactagccttctggacttcttgcctccaaaagctctttataataaaatataattttaaataaaaatagttatctgtttagggccaagcaatatgctaagtgccgtccagccactgtgtcatttacgtctccaaacagctctagttgggaggctcaatgattatcccaattttacagataaggaaacaggtccagagaggttgaggattagcctagaaccacacagctaggaaatcctggagccaggatttgaacccgggtctgacctaagagctcccagccgccgtgatatatcagcttatgtcatcctgacacctacgcagatgtcggctcgaatccactttgcctgagcattgtctcagagaaatctaatttaaaaattaggcagcaaatagaaaatatatttgactgctagagatgcaatgggactgggagcccaacaaaggatcttaggcaaaagaaatccaagttgttggcctcagcaactattactgaactggctgggctttgggaagctacagagggatgagaagacctggtggatcaggtgggcccaactcaggctggcccccaccctgcaggaagtaggaaaagtccagggtcataggcccagtgagatgccggctgcgggagtttcagcctccggggctggaccagagggcaggaggggacgcccctgggtagcagcgccagagtgggctgagtggcctgggcccctgcgggggagctttcagagatgttgatttgggggtactccctcagccctgcctttacacagaatttgtgggggatgaggggagggggaaaggggggaggaaggcagtgagtgcatctgaattttttttttttttttacaaaaagtggcttattgcatttttctgattactctatcagcacgtgcagaccttttcctattcagagaaagcctgaagatataaagaggaaagtgaagaaaaaccaccggaaatcccatccccgccccagcatctggcactgtgtgggcgatcacgaaatgagcgcttgtttttgaaggcgtagtatctccgtgaacatccggttgaacaacctttctgactttatttttcccacgaaagttattaattaaaaaacaaaaagcaaaacaccgaaaaaacaaaaaacccagcaagtgtttgagctcccaccacgagggaggcctgacgtcactggatcctcccggcagccgatgaggctgcatgggacttgcccacgatgtgctgttaccgagtggcatagccaggcttcaaaccagagtcctagctaaccgccctgtatataccatgggctcatcatcttccctggttccagctcagaacagagactcagaggaacaagggctctgcgctcaccctgcctggttaggtccagcctttccaattccaagctgtgtgaccatgggaaaagtgtttgcccactctgggcctaaatttcctccttggtaaaaggcacacaagagcagtactctgcacgccacagtggtggggtgagcagcagatgacgtggtgggtggaggccaggtgacaccaggctgctctcaagcttaacttgcctgtgatggtggcgggaccgtgtcagttcttccaccaaatcccacctgtttccacgacgtttattgacaagtcaggggcaccgccccgggtggagggggtgtgaagaggaagtcagctccctggtccctgctgccctctggtgaccacatcagcatcagcacctgctccatcccagcagctccaggtccaggccgtgcccagaaaacttggcctgggagattccccacccgccctgccccgatcccacctctcttccatctctgcattttccagaaattcccccagcaccagacaaaagagcctaatgtccattagatatgctgtgtggcgccaggccagcgtgtaacctctctgtgcttgattcgttatctgtaaaatgggaatcattataatatctgcctcatgtagctattgtgagaattaaatatgttagtacctgtgaggtccttagaactatgcctgcggctgggcacagtggctcacgcctgtaatcccagcactatgggaggccaaggtgggcagattgcctgaggtaggcgtttgagaccagcctggccaacatggtgaaaccctgtctctattaaaaatacaaaaatcagccagacatggtggcgggtgcctgtaatcccagctactcgggaggatgaggcaggagaattgcctgaacccaggaggcagaggttgcagcaagcggagattgtgccactgcactccagcctgggcaacaagtgggactctgtctcaaaaaaaaagaactatgcctgcaaatagttaatgccttaaaagtatttgctaacattcttcttcttcttcttttttttttttttttgagacagggtctttctctgtcacccaggctggagcgcagtggcccaatcccggctcactgcagccttgaacacctgggctcatgtgattctcccacttcagcctctcaagtagctgtgaccacaggtgcacacaccactaagcctggctaatttgttttttaattttttgtagagacagggaatcactatgttgcctaggctagtcccagactcctagggttcaagcaatccatccacctcggcctcccaaagtgctaggattacagatgtgagccaccatgcctagtctgctaacattatccttaatattacactgaatatgtctgtggattttgtgggaggtgagggtataaaacataattagaggaaataatgacattctaaatttaatttgactttattacaaaaagggcagaatggagcaacagtaatccaggacaaaaaattgtcccaatcccatcattcaacccacttgtgtttgtatctgtttgtgccacttctgtgtgttgtttacatgcagagtcagtgtttgcgtatttgcggttttatatcattcatttctcatcatacatacatatatttatattcctgacatttttctagggaatatctttatattcctgacatttttctctttttcccttatgttcttccataccgggacttataggaccttgcccagactcaacttccctcttccccatggacccaagttgctgagcttccaacaggtgtttacagcaaaggagaatgagacagagagaagcagagatgcagagagaaagacagacagagaagactaaactgattgatcccaactccattatgatatctgactccaaccacagaatgaccctgatccagccacagactgacttctgatcctggccacagtccacctcctgtcctcagccacagaacagctctgactcaagccaggaactgagtcccgacccatgttactgacttactcatgatcctggttgcaggctggccccagccacatgctgacccctgaccctcaccacagatggatctttgatcccagctataggctgatctctgattctggctgccctgaaccaccactcctatatactgatgacccaccttagcgtgatcccacccaggaactggcatttcctgggacaggctcttggccacctgctgctctgccctgggcacaccaggccctacgcatcctcccccttccaccaccatccatgatttcctgatttctagcagcaaatttagcttgagttggtcaacatagctgggctgcctgaccttcctctctgccatggaaccacagagcaagtcagcagttctccttcctaatcaaaaagcagcatggaggagaaggctcctttgccaccttcctttctgctttggatggtgcttttgcaatcatgaggagacaagcctggagatgaaaggaggcattctgaatatggtggagtggaagaagaagaaggcctgcctggggctttgattacatcaccaagtgatcaaaccaaccttaaattcttaaataaactgtaagtgtgcttttctttaaaccactgtgagttttcttttgcagtcataaagcaaccttaaaaattgtagtaggtacaataatgaaccccccaagatgtccatgtcccaatccctggaacctgtgaacatgttacattacatggcaagggggggattaaggttacagatggaagcagggttgctaatcaactgaacctgagatgtagagggagattatccttaattatccagacaggcccaatataatcccaaggatcttcataagtgagagatgcaggagaagccaagtcagagagagatttcaaaatattatgctgctggctttgaagatggagggaagggccatgggctaaggaatgcaggtgaccacttgaaactggaaaagtcaaggaacagacttccctagagtttctggaatgaacacagccttgttaacaccctgattttgagctcagtgagaccagtttcagacttctgacctctggaattgcaagatcataaatttcagttttaggccactaaacttgtggaaatttgtcagagaagcaatgggaaatgaacgtgcaggtgcattcacgcatccaactttaggctctggactcttcctcaagctccttccccaatccccatcctctccctctttattggcactcaatcttcacttccagaggatcctgccaaattcctgcccattccatatcggcatccaccctttcttgttagagtggacgtagggcaggctggctccacagctgtgcgccaggcagcagcccgtacccccctgctcggaggacccctactcttcagtgtcatgctctgaagtcccagttttgaaattcttggccaggcgcagtggcccacacctgtaatcccagcactttgggaggccaaggtgggcggatcactcgaagtcaagagtttgagaccagcctggccaatatggtgaaaccccgtctctactaaaaatacaaaaattagccaggcatggtggtgcatgcctgtaatcccagctactcagggaggctgaggcaggagaatcacttgaacccgggaggtggaggttgcagtgagccaagactgtgccactgcactccagcctgagcaacagagcgagactttgtttcaaaaaaaaataaaaaaagaaaaagaaattcttaaaaattttatctctgaagttgtgttttatagggaggtttaatgggaccaaggagcacccattgagggcttggagcctcagctcacacagggtcccacctcctgcctgcttccctgggacatctgccacctgcctgcttccctggtacaggctcctggccacctgctgctctgtccccagcacaccaggccctactcatcctccccattccaccaccatccatgaccattgctgccttctgcccttgaaggaggcctgggcacaggtgcaaaggatcatcaaggtcagtagctcacctcacgggaccttggggtggagcatggtgacagccattcctaccccagaggtatctgctgggcagccagaagccacaactcagcccacttctaatccaggaaccaagagtgaccatcttgatttctcagcccttttgttttttctttttgagacggagtctcgctcttgtcccctaggctggagtgcagtggctcaatctcggctcactgcaacctctgcctcccgagtacaagcaattctcctgcctcagcctcccaagtagctgggattgcaggcatgagccaccatgcccagctaattttttatttttagtagagacggggtttcaccatgttggccaggctggtctcaaactgctggactcaagtgatccgcccgccttggcctcccaaagtgctgggattacaagcgtgaaccaccgcgcctggccaaattatcagccctttttgaataagaagacctgcatttttattttgcacagtgcccctccaatgatgcagccattcctgatgcggggtcattccctctctcccaggctgagctctcttctccctctggaccctaaaacaccatcactcccctgtgtcttcacctgcctccctctgctggcctttcctcattgccacacatatctactcaagtctttccatcttcaaacagcccaagcttccctccaccccggctcctatttctctctcgccttctctcccccagccacagtgcttgtgctcaaaagctgtctcctctcttgggcttcacttccttcctctgcacccactcctctaccctctctgtgcagagtcggcctgactctgctactaaactactttcactgaagccagctccaccacccaagccaagtctcagtttcaatccctactactctgtggcactagcatctccctcactcctgaaactcggcccctcttggttctctgacactggctgtttgttcctgtccagtctctttttctttttttctgaggcagagtcttgctctatcacccaggctggagtgcagtggcgcagtctcagctcactacaacctccatctcccaggttcaaacgattctcctgcctcagcctcccaagtagctgggattacaggcacccaccaccaccacacctggataatttttttgtatttttagtagagacggggtttcaccatgttggccatgctggtcttgagctcttgatcttgtgattcgcctgcctcggtctcccaaagtgctgggattacaggcatgagccaccgcacctggctccagtctctttttccaaggtcttctcctctgccctctcttacacgttaggggtccgcagggcccatctggggccctccccatctcctctcctctttccacagagttaattacaaccttcactaaatctgtactggagtcgcatggatcaggaactgtgtggtccacagcccagcactgtgcttggcacatagagcatactcaataaacatttactaagtgaatgaatgaatgaatgaatgatgtcttctaaatatatctccccagctgagatctcttgcctgaactccagagttatacattcaactgcagttgggtatgtctcagtttccacatctcccacccaaacattttgcatgtcctagctagtagccattcctatctcgtgtgacatatgttattatatattgtatatattattaagtcttttatttcttatttctcaccaggtctcccatatctcccccaaagaaagtagactcatggtgggcagagatttcagtttggttggctcattgccttatcccagggcctagaacagtgcctggcacatagtaggtgctcaataaatacttcttggctgggcaccatggctcacgcctgtcatcccagcactttgggaggccaaggcaggtggactgcttgagcccaggagtttgagaccagcctgggcaacatggcaaaactccatctctacaaaaaatacaaaaagtagccaggcatggcggtgcataactgtagtctcatctactggggaggcttaggtgagaggatcgcttgagcccaggaggtcgaggttggagtgagccacgatcacgccactgcactccagcctgggcgacagagaccctgtctctaaataaatacacaaaaataagtaaataaataaatacttcttgaacagatgaatggatctccacagagacatccccacatctcagattcagtatatccaaacgagctctttctcatcctcgccaaacctcctccttctggttcctggttttgattgctaaagcaagagagcgggtgctcctcaattgactacctccttcctccctgcagaacttccggtactgtgagtctgtccctgggaccctgctctccagctcctctgttcagccatgtcagcctccctattgtaacccctgggtttatgccggtagtgtctttatcaaacactcccccatgccaggaccaggaccatctttgtgactgcgtccttccctgctccctggggtccctaagatgattttaggtggcatgtgggcatagtgagctgagaaaacaattcctttttcagttctctttctcttctccagattagcctaccacaggctgcagcatctagctggaagttaatcactcggttttggtttcaatgggcttgtttttacagttcccttctatttacagtaaaggatcctgatctttcatgtgtgatggtgacaatgtttcatttgacaataaagtgatttaaacaaagcgaggaggccaatatgaagaaaatgtaatga

SEQ ID NO: 1266 - DNA, 171274 bp, Homo sapiens
gtactataatgtctattaagtcattgtattaggtttttgtttggatatgtgttccaaaaatcacaaatgaagtatgattttttaattttggtcctctttatatgtgcttcaatcagaatttcctaagcctaatgagtcaaaatagccttttaaaaaaatcagaaagcagcacctgcttttaggtaattctgagaatatttggcttgtggataggatatttacttttcagtcaccacctcgattggaaggctttataaattagaaaaatgctcatttaacagttttggcatttttatcttttcttcaacataaaatatttgttcacagattttgcaccatttttgaacaattcacgtaagtcaatgggtggtaactcatgagctaactggaagatgggttaaaatactttacaaagtactaacttctattaaaagttgttttgctacaattttcagtggaattgtagtgtgttaaagttgttatatccatactaagatatattttaatttgagatgatgctttatttggatcactccaatatgtatatgtattacaaaaaatctagtgaaattaatgttttatcaaattacttgcattaagaaaatgactagcattttaaactgagagtatgtacaattcttattgtagcaaaactcttaacatagcagctgaccttttagaataaagactaacttttaggtgctggtttttggttactgtattttcaaacactgatggtgtctgcatttctgccaaaggtattttagttttatagataatgtgatagtgtataaaggtttaataatgatacctccttaaataggaagaggagattattctgttacgtttatagcctcttatgatacacattctttgataatttaaaagctttgagtcaccttagtgcacagtaaatctcttgtagaattagttgattagtaatgatttggatataatgtcacattcatttgccaactggttggacctgatgttttgaagtgcttcttataatttataaggctgtatttgaagattacacaattgaatgtgaaggaaagttatttagaatattagtttcaagcttttaatgtctgtgtctttgtgtttttccagataagtattcgtttctagtcttccccaacaaaatttcagttctcctgttagtaagaaaagctatcaaagactttctatttagtttctgaattttatccagtatcttaacttacaggagacttacttcaaattaaaaagtaggttaattaatgaatgactatcagtatcatggtaaatttcctgtaaactggacattaaattctaattcactactttagatggagggaaggtttttaaattcttagttttgaattagtacattttcaacaatgtagggagttttgaaaacttaaaagtagaaacactgaactgtaagtagctctgggaaaacaggagcaaaagaatagataagcagatgtctgttaatatgtgatgcagcttttaaagttactaacaaaaccgggcctctcgttccttcatagggatatatagctttgctaactgctttttgctttctctggtttgcaaagaaataaattcaactgctataaagcttttgctatttcttggtgtaaaaagtagagtaagagtattttcatcctttcagtatttgcaaattcttacagaagccatgtggctcttcttggctttatatcatatgtacattttacaatatttctttgacacacttggattttcatagtgagactcttaactgagctgctgtaaatggttgttccacttttgaagttctgtgagtataaaacagattaaacaggctaaccaaaattatgctgctaaagatgtaaagtcattgccccagggaaatgtttacatttgcagataaaagaaaaacctaattgttaagtaatgaaaattgagctaggaatgaaagattgatatgaatgaaatgcccagtactagtagaaaagcaaggatttttcttttcttttggcaaggagaatcaaatgttacatactttgcacttcattggattttattctaagagaaatctgatttcagagtaagtaaatatctttaagggaaagtttatgcttactgttataaggttttttttgtcatatggttgtctaaatgttgttaatatctatgtcattgtggtcattttaaatcctaaaatttgttggcaaaagaaaaaatttttatatggcttctactttttgtggaaatagtgattaaactgacaaatgtctacatccttcagatttttgaaattactgtttattttgttctatcataaatagttgaataaaagttactgtacaaatttgaactctttacaggaagaatataaatctagtaaataatagtagtttgttttcctgccgtgtgagtttattttaggttactgttacagtgatttgtgggaatctgacaggggtttgttgctggtagtggtggtggtagtggtatgtgtgtgtttgtgttggcaatgctaagaaacatcttaagggaaagacaattctaagaagtaacactctgaattttattaatttgtaggcaataaatattttcattttgttttaaatttactattagggacctttcttctttttaaaaaattattggggtatattttaggattaaaggctcttttcttttcccttgagctgctggtataactttccttgttctgtgtaatagctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtgtgtatgattcacatggaaaacaaattatagaacaaaaaagatcataaactctctgaatgaaacattctaatgtataatataataatttattacatttcagggttgagggatggagtcttgcggttaaatcacatttccagttcagtgaggattaactcatttataatgtgaaattgcttggattaaattatgttcttagcacatagaaacttgtctgtatcctaaaaacctttccatttgtgtttcatcatatccattgatttgtagtggcttgaggaaatgtagcatttttattaactctggtaacttgtttgatcaatagcagtgtttattaatattgaaagggtccttgatgggggacaaattttaattgtttctggtgattttattaagcagatttccatcttagagaaaaagtcttaggaagttttcaaatctatgagaattaataggtatttcaggcatacaactggtaagaaatggtcctgaagagagagatggtaattttctgatatctcatgaatacaggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagcagggcaactgccctaattcagatagatttacagtaacctacgtacagtagatgcacatacacacagacacccctttgctggagaaacttaggaccctgtcagccttttaaaggaaacagcaggagtggtgtcctaaatgatgttcatgcagctgctttaccatgttcacagtcaagcccatgcatgccaggttaaaactgtggaaatcaaaagtaaattcactcatattttaatcattttaactgagatttaaaattagaagtttaaaccactatatataaagaactaatcttttcttaataccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaacaaaacagtgcatgtaggagcacagggccacacaaaggcattctattgttatgctcattctgcttctgtaatgacttttcataggtcattcttgtgaaccattttgttttgcaagcaaccaaggaaagaacatcttaagtggaaaatcagtggtggttgtgaacacttagagaatagcaatccacaggcaagaataatggtattgtttgtagagctttattaattggatattttttaaaagacattttcattcacaggtcattactatggttctcagcgatccaaatatgtagatcattggtttttttttttacctgaagtagcttaagagtacttggatcagtagaataaatatttattgaatcaatcagtcagccaattaatatgatgttagtgatagacctgcctccttttatggaagaggtaacagatccagagaggtcaagtaatttagttgtagactgaaaaatatatcaaagcctttgctgcaatcatatgtaacaaaaagaaccaaaacaaacactttttagtggcacctgtggatttacaaagggttgcctctctgtcattccacaacttcagaaggtgtgacaggttttccctatttatcattaccaataataacaagtattgagagttttaaaatttctcccagaagataaactaacaaggatggaaggggagggcaaaggatatctaaacatgagaataaggacatgttagagggggggaaacagttgtaacaataaggaaagagaagagcaacagtggaagagacaggttgtgtgcccctaaagattctgcacccccagtttggaaacactgatacattttaggacacagagcactcctagatctctacgaaattttagaatgaataatgtgtaatttataggatcagaacgtatggttattaaaacttggatcaagatatgcccggtgtatacattcttagcacataggaatggcactgccatactggagaaggtcagcagtaaataggcattctgtacataagcctcatggaagggtaagatggagagactggcagaagtagcacctactctgctgggagcacttctctgagtacgctttagttcaattcaaatcactgtattctttccccattgctaacctaatatatgaaacaagcttagctgtctcagaagtttttcaagagatgatcaggaaaaattaatgcacattcaaaaggagaatcttcagtacaaatttgtttttttaaaaatagatttagggctgggcgcggtggctcacgcctgtaatcccagcactttgggaggccgaggcgggtggatcacgaggtcaagacttcgagaccagcctggccaacatggtgaaaccctgtctctactaaaaatacaaaacattagccaggcgtggtagtgggtgcctgtaatccctgctacttgggaggctgaggcaggagaatcacttgaacgcgggaggcagaggttgcagggagccgagatggcgccattgcactccatcctgggcaacaagagcgaaattccatctcaaaaaataaaatagatttagggggtacaagtgcagttttgttacatgggtatattgcatagtggtaaaatgtgggcttttagtgtacctaacacccagagaagcatacattgtgcccagtaggtaatttttcatccctaaaccttttctcagcctcccactttctggagtctccaatgtcggttattccactctttatgtccatatctacacattcaatcctaatttgtaccaagtagcatctcacctttaaatcacaggcttattagttgggtgttttctttttacttatgaaaattcatctagtcaaactgtcaattaatttttcctcatttcattaaaagtgtatatctaatgctttctctaaaaattgatgtactggaaatacaaataaataaatgctccctgtgtagaatttccacttgcatcttgtgcttttaataccattacagggtgtcatgaacaggttgtaaatgttgcacttattgccgtgtttcagatggaataagttggcgaattctgggctcctgaagcttgatccagtcgctagggctggaagcactgtgttaggtggctgcaggaagaagcaaggaactcaaggtgattgaaacttctttggacataggccccaaatttcctatgtgatctccatccaggaaacaggcaggattctgtgtgagtgacagctactcattttgtagagattagagacacaccaaattttggctgcctttctccagaccgttactaatctgtgagaagacacaggatgtaaaaactggggaccaaaagaaggctccttctccctaaggccttgaatatagctggtccattccctgtgtcaagaacctaccatgatcctgctgggtcctctgagagtggaaggagactctgtccatctcacctcatcagctcttccctggctggttggaaaagaccaacccaaaagaggggtgatccaaggagtgagagacacttaccacaaaatgggaccctccccacagaatatagggcttttacctccttctctttctccatagaaaactacatttcctatactagttagagcacaagtagtatagggaatgtagggggtgaggactacattatacaggagtgatagtgatagatccttgtttctcctgatgaaatgttttcatgtacttttggtcagcctatcatgcttctatcatttgttttcctttgtgaagttccagggatatggaagtgggtaggtaacctcttgccaccattctttgttctgtggcaccttgtcatcatatttcaccttgaagtccttgtctcacattatagatcttcactttggtatgcacacaccaaagttagtgtgaggaagtagtcattgaagttattataggacgacattgttcatctgtggtggaagacaggattggtatgggaatggtgatgaaagctaggtgtttgtgagggtttgtaaccctcatggggcactaccacttcccaaaaaattgtctccattattaagaacattttgtttttatgtgtgtgtgtgtatgtgtgtgtgtgtgtttgagacacagtctcactctgttgcccaggctggagtgcagtggcgtgatcttggcttactgcaacctccacctcctgggttcaagcgattctcctgcctcagcctcctgagtaactgggactgcagtcacgtgctgccacacccagctaatttttgtatttttagtagagacggggttttgccatgttgcccaggctggtctcaaacttgtgacctcaagtgacccacctgccttggcctcccaaagtgctgagattacaggtgtgagccactgtgcccagcctgtttttatttttgaagcttaatgttatatgttgctctttgtgtttactattttgttgtcttttggcagcattaaaattttcatgcttaaaatcatttattgaatacataaaacaaatctaaagactatctactaaaacaaaggctcattaaaaaacctatgagtatatcacttttactttattgaaattaaggtttgtagcaaatatatctgatattagaacatttgaaagagatagagacagattcattttcattaagcagcacataaaaaatggactgaattggattacattgatgccagtctaggtatacacacactaaagttggtgtgaggaaatattctgaagttattataggaagacattgttcatctgtggtggaagacaggaattgattatgtcatatagtacaacttcgcccttctcccaacatagcatcttctttaaaatagctttgtgtagtaacaagaaaagtaagatttttccatggtatgtgtatctgaacctcagtttcttttaaagaacaattcaaagattattggcaacaaaacagtctactatgtaagcagtagttgcgtataaaactagtgtgcctaataactgaatactgaggtttgtgtttatcagacgtagtgtggagcatatatacactcactacagtgcctacacactacatacattcatgcgtttagagagacctgcatctccctgcgtaagtagtcatcttttaaatgtactttctagcatataaagagtttgcttcccaataaattgttcagtccctaaacaataagtaagctatgcttgttgcaaatgatctgtgagtaaaattttcagggaaggtggaagcaaacctggcttatgatcattttgactatcatccaagaatagtaaaaatatgtttcgctgattgcatttggggttttaataataagtaagtgtctttttcttcagaatttactggttgccaagtacatgactcttctatatttgaaatatggtgtgtgctgattctcagtgttgactgtatgtctggattttgatgacccatgaatatgcctgtctccattttccttgagaaggcaaatcatctctcttgagatagcctaaatgataattgtacattttcagtttttaatttccttcccaatcttgatggttaaattcttcatattctacggtcagtaattcagaatttcttttactgattacctgaaagagaaatagttttaagaacttaagaaatgccacccaaggtcaaaccaatggttcattccaatattactgccactggtagataagaggatgtgcttgccatttatgacatcttctttgaaatgttgaagatggcctcaaaatattcttaactttataacctactagaaatgtactccatgccctcttaagcctatttagattctcaggctgacccatctcatagagcaggagtggcagatagtctgtgaatgagtcaccattttcccatccaaccatagtagacaccattagtgtattatagcatgcttcctcagggaacccatgtgtcctctgaatgtctgtcaacacagaaatccacatagccaggaataatcagcattgatacttgttctggccttgaactaagatgtagttcttcaagtttacttcctactgtgaaaattatcacttccttttatttatttgaaatgtgatccataattctatctggtacttcgggatttagttggacattttgtcaatatcagatcctgtgtcctattgtcattttatggccctagtctaaactttttctgtttttccaattttctttgtttcaggaaaccaaagtggcacacattcccagtgtgcacttggatacataaaattattattagcatttggtgtgatttccccagtatccttatcatatattaactatgataacttttgtaggtgcaaactttgaggcattttttttttatccagcactgtagactttagataaagtagacattggctgattatcaccaattgtttctatcaaagactataatttttgaaaatgggtagttttaggctaaagattgtccaaggttttttcccccaaagttattttaaaaaactatgtcaactatatataaattgcttatagacaagttattttcctttgtaaaataaaattattttagtaaaataagttgattaagtgaatattttaagagatgtcttggacactgaaaaacatctgaagatgaacttttacgaatttttgaagttactcattgttcacaaatgatgtttcttcatattttctacatatttttcctttagctgattattatttgaaattgaaagtatataaaattattcaatgccaggaatataaattattactgtaaagatttcaaccttaaaatacatttgataaattacctgtatatttttataagaaaagattggaaatattataaaatacttggattgattttgttattctgttgttttatctacacattttggttaatcccagccttctgactctatccttgcactagaaaatgtcacccccttaaaacagtaaattaaaaataaaaagtatcttgcttatctctatttaaaataagagggacataaatgtttttaatttccttcaaaagtcaagtttagtaattgcaaccaacttagaaagtatgattttaccttgttattttgttgattttggaactttttaacactagttttgtatgcttgattttcagagtgatctggcaacctacaaaagaaagcaaaaacatagtatcttgtttcttgggcttatcaacattaatagtaactacatctttctactgttttagttttaacatcatgacaagtgaaaatagatagcatatttttgcaggtgtcttccgtttgagttggaagaagtgtgctttcagcatttcccctgacttttgccttttagttggcttactatttcttaggcagtggtctcagaaggatggaaggattacaaaacatagatttatttctcaagtcaagttctgagttgtggttgctgaaaaacaactctgtaatggcatattgttaataaaatttaaaccacaataaactgtcaccttattccagttagaatggctattatcaaaaagccaaaagataacaaatgttatcgaggatgtggagaaaagggaacctttatgccctgatggtgggaatataaattagtagtcattatggaaaaccatctgtaggttcctaaagaaattaaaaataggactaccatatgatcgagcaatcccactactggatatctatccaaagaaaatgaaatcagtatatcaaagagatatctgcactcccatgtatattgcagcactattcataatactcaagatttggagtcaacctgttgttcatcagtggatgaatggataaattgtgatatatatgtattacatatataaaaaattatatataattatatataatatataattaatataattatataatataacataattatataatataaatataattatatattataatataatataattatataatataattaatataattatatattataatataattatataatataattaatataattatatattatatataattaatataattatatattatatataattaattatatataatatataataaattatatattatatataattaattatatataatatataataaattatatattatatattatatataaataattatatataatatataatatataatataattatatataatatataatatataatatatcatataattatatataatatatataatagaatactattaagtcataaaaaggatgaaatcctgttatttgccacaacatggatgaacctggaagacattatattaagtgaaataagccagacacagacaaatactgcaagctctcactcgtggaatttaaaaagctgatcttatagaaatacaaaatagaacagtagttaccagagactggggaggggagggaggagggtatcatggagagagattggtcagtgggtacaaagttacaattaggtaggtgggataagttctggtgtcctattgcacagtaggatgactgtagttgtatatttcaaaatagctagaagagaggattttgaatgtttttactacaaagaaaagataaatgtttgagatgatgggaatgctaattaccctgatttgatcattgcacaatgtatacatgtattgaaatatcacattgtaccccataaatatgtacaattgtgtgtcagttaaatttttttaaataaaataaatatttttagacctttctatatacataatttctgttgatagtgtatatgcattttgcattttgtgtttttcctctttgcattataaaatgggtataatatttaggagctatcttcctatatatatatattcccttattcaacttttttctttctctcaacatcaatttattacaatttcagggaaatggagaaggacagaaaatttcagtcctagtgctcatgggaagaaggcagaggagagaggaggaaaaatatagtttaaggaggttgaggccaggtgcggtggctcatacctataataccagcactttggtaggctgaggtgggaggattgcttgagccaaggagttcgagaccagcctgggcaacacagtgagaccctatctgtgttttttatttgtttgtttgttttgagacagtctcgctctgtcacccaggctggagtgcagtggcatgatcttggctcactgcaacctccatctcccaggttcaagcgattctcctgcctcagcctccggagtagctgagattacaggcacatgccaccacgcccagttaatttttgtatttttagtagagacagggtttcaccatgttggccaggatggtctcgaactcctgacctcaggtgatcacccacctcggcttcccaaagtgctgggattacaggcgtgagccactgtgccaggcctgtatttatttatttgtttaaaggaagttgagtaacaagttccttgttccccatcccaccacctaaggcagcattttcggttcctatttgtcctggttgggagatttggaggctttgagaatgccagggaaggggcagatgcctgggatcagaactaagagatcacaggtgaggggaatatggaactagaaaacttccaggagaactgtcaagaccaggagagccatacctcactgtatgttccaagcgaactgagttgtctaaagtgattgctcaaattattaatcaggtggaagtttgaactacattaaattggactatataaaattccaaccccttcctcctacaaacctcccccgtaaccgaaccttcccactattcagtggagaaagagctccaaagggagttggtaacaactatccagagggaaaaaaactagacctccttttctccatttgaggtgtagcatgtgagtgaacctgtgactttgctgcggttacaacaagcactttgatatgattaaaacatcctcataaatgtcactgtgtaccatcatttactgaaactgtcccctatatttagaaacaattttcattattatgagtaatgtcacagcatagtaggcctatgaaattaaaggacaaaagtgagaatgttaaggcctgagaaggaaaagtcagaatctactctgttagatttagatttgcattttttgtgtatgtatactgataattgtgagtaataaaagcctaactgattacaccaaaaaaaggaagtttgaagtaagttcctagcatggcagaatctatgtatacaacatctaaacttgagggaaatgtaaaaatatatggagtatagttacaaatattggatggaggaaaagaatagaaggaaaaataaaggtgaaaatgtaatgagaaacaatgacaagtaactgaagcaatggaaactgctctttgtgtgtcaatggtagtcttctcaggagggcacctgccttcagtatcatttccctatctcatcactttcaggtagaataacaaaaacgcagctaaatttacagttctttagagaacgctgttttcaaagttgcagcacttggtgttctcatggatttgcttctgagtttaggtttaagtgccaggtagggattcttagtttttccttacagggctgccctttgttgacagaaacagctccaataatgctagtagtgagtagcttacactgaggggcatctaatttattccttaccaaaaaccatgaatttattcctgttattcccattagatagatgagaaatttgaagcttaagggcagggggtggggaactggcttaaagtcatacctagtagggggcagagctcttaacttaaatttgggtctaactttaaaacctctaattgtaaccagggtctaatctatggttgattgggttttaatttgtcagctaatccttatataaataaatttcatcacataaatgatagcatcttgggatgaacagaaataactgatgggaggagaagcaggtcacggagatgcacaagggaccctcagagcactgctgtggtcccgtttcttcactgagagtctgtctgaagtagctcataggggcaacgggtttgtcctcatgctgagggtatcaggggttaatacttaacatttaaaaaggaatattcaggaagttgaaaagggcaaaattggggtaataagggcatttctcccttcttcctgaagaaattaagcatctttccctccctccctccctccctccctttcttccttccccacttcctctcatctattgcccagcatctagcagggtgcctggcacatggtgctcaaaaatgttcatttcattccattagtctaaggagcgtcaatttttcaatgtatttgaatccctcaagtccatgttatgccccagagacaggcacaggtggaggaagtagagcaccaccaacctttttgagaggtgtttatttccagatcaccttatgccttgctttactgatctcacttacgacaacctagaattaaagtgatctttctcactaaagaaagagaaatgtttaaaattacgaattgtacagccatctgaaatagcaaatagggctgattaaaatgaaaacggaatacattcctgttcacaaaagccgcatgcaaccctcttcttattcactttaatccagcctgttcattggccctttcttcccacccctcaacctttctttctttctttcttttttttttgagatggagtcttgctctgtcgcccaggctggagtgcaatggcgtgatcttggctcactgcaacctccacctcctgggttcaagtgattctcctgcctcagcctccagagtagctgggattacaggcatgcgccatcatgcctggctaatttttgtgtttttgtagagacagggtttcaccatgttggccaggctggtctccaactcctgacctcaggtgatctgcccacctcggcctcctgaagtgctgggattacgactcccagcccaacccttcttttaaattacacatgttggctggtctgaacatagtgaattctctcaactgattgtttacagtcaattgcagatggaaatgcttgtgctatttctttccctcttcttactactgtacttgactagcctaaaaaaaatgtacacaagtgatacatgaacagattctcattattaaaaatcctggacctcaatttcactccattccattgttaactggagtgatagttgtgtatctattccacatttttattatgaatttacttacatgttagatcgaactatacaaaactgccaatatttgatgatttgtgactgacaaaatggcagtgccatatggttgaacctaatatacttacagtattgttattaatttattacatgtacgggatcttttatgctgcaatttgctttctcatttaatgatatgttatttttccgtctatggcagctccagtagagttatatatattattgcctttagctgccatgtttcacagtaatgtactgtactctaaccatttccctattgatgggctatacaattgtttcatgactcaaagcagtaatgctgtgaacatttttgtaagcatatcttggtgcacaggtacaactattcttgtagaaataattgtctaaaagtagagtacctgagtcaaatttaaaattttatagataatgacaaatttcttttgaaaaaaggcttttccaatttgtacatccaccagcaatgcttgatggatctagctttcctccatattcccacactgagtatcatcaatctccttttgccaaattcaaatgatatctcctaattgtttttggatttccctgatgatagtgagatccagtatcttctgtattttgctggtcatgtgggtttcttctatgaattgcacctctgtattttttgctcattttaatattaggatgtttgtcattctcagcaaactatcacaaggacaaaaaaccaaacactgcatgttctcataggtgggaattgaacaatgagaacacatggacacaggaaggggaacatcacacacaggggactgttgtggggtggggggaggggggagggatagcattaggagatatacctaatgctaaatgatgagttaatgggtgcagcacaccagcatggcacatgtatacatatgtaacaaacctgcatgttgtgcacatgtaccctaaaacttaaagtataataataataaaattaaaaaaaagaaaaacgggaaataaaataaaattaaagtaaattaaaaaaaaaagggtttcataatcctagctggacatttaggcctttgatctattttgagttaatttttgtatgtggtgttaggggtccaaattcattcttttcacgtggatatctggttgtcacacacaggaccatttgttgaaaaagactattctttctccactcaattgtcttggcacccttgtggaaaattagttacctcattaatgaatgtatgagtttgtgtttgaaaaaaaaattaggatgtttgtctttattaatacatgtggatgttcatcctttgtctgtaatataggttgcattatatagaaactttcctggtccctttctgctcataaggccaccttcataacactctaaagtctggttcctgaatagagaggcctttgtatcttgcctccttttcctccttctcaaaagcttctcttaccctttctgtctggaaatgaaggaatgattaaacacatcataacacatctagagaatggactgttatgtaatcactaaaaatgatgctacaaaaatatttcatgacatggggaaacattctaagttaaaaaaagaggactataaaacgagaaagtctgtttctattgtgctttagaaaattccttataaatcaattgtacataaacatgaacaccaaaagataactgttaatgtgtggaattaactgattttcatttttatataaacaggaacaccaaaagataatgtgttgaattaacaggatttttatctttttttctcgtaattttctatatttcccagctttcttatgatgaaagctattatgtttgctaacaggaaaaatcaaattttatgcacaaatacatccccaattaaggtagtagaccaagtattcagtcttttaaaactgatacaggttctttcttccttccctattggtcttaaggaacccttgccgggaagcctagagcagggttctcaaagtggggtcctaggaccagcagcatcagccctacctgagccccatccagacctactgaatcagaaacagggcatagtagggtgcagccatgttgttttaacaggcccttttctgggtgatttctacactcactaaagtttaaaaaccatgggttgaaaggaccatatgaatttactctaatgatgggtttctcagaagtgtaagtaatgagttcttgagtctgtgacgttagcatgcttgacccacctgcatggagctccctttccctggaggacctcgcattcctttgtgccagggccacagaggcctggttccagaccgtccaggctcccctggctgtcatatcctggtttgcagcgacactccgcttcctcagtccgttcgttctttacacattgggcaaattcgccgcaggccaggaacttgcagggatctgcttgatcagctgtaagaaatggggcagattttaacgcatgtatgaatagctaagcaatggaactggcagcagtcaaaggcaagagaccaaatacatttgctattacctcattttggagtgggttgcacagttgtgatatcagactggagggaaaagaaccacattctgtatctttgaaaaatgaatttacagacacaagtgatattagtttagctccaaatgtaattatttacaacctttagtgtgcatcagaatcgtctggaggccttgttaaaacagattcctgagccccacactcagagttcctgtgcaagcagcgtggaatggggactgagttctggctctaaagcagttcccggtgatgctgatgcatctggtctggggagcacattttgaaaaccactgcattagagaattaggaatgttttgttacttagttttttttttttaagtaagcatttataaagcattaagtcatcatttatgtgaacagttttgagaactcaggatgatttcctgattttaaatataaatttctcttggtctcttgctaaggccctaatgttagagagtcattcttttggattaattatttcttccctattaacatttagactcacttctttcttgtcattaattgttctattttactccattcctaattctatagggttgtctccaattctttgggaagtggattagaaatcaagagaatctcagatatttagctctggaaggccagtggcccctgtttgcccttccttatccttatagagctgagcacattgagctctcagtagagaagcaactgaccggagtcctcaagggctgatggcagaaccagaacaggcctcttgtcatcagaccactgttgtttctgccccagaaggtctcctgttcaaccatatcagccatttacttttcagattattctttaaccaaataactattatgtgcaaagagctagggaacaggcaacagtaaagccattcttccaagaaatttaggggaaaatgcgtacagataatgctatacagtcctctgactggtctcacggccatcccttcgtggaatgtgtgagaagttccagggaagggcagagccccaagggggagctattggaccactttgctaatatattggccctctttgctaatacggcaggtgaaggcaattagaattagagtcaaaacgagagaatttataacagtaatttgtagagcaactcacactgcttccactcttattaccttaaaaatattttccctaggtattttgatgaccctctttactttcatgtaatttttcaaggaacacccaaaactttaagctttaggcaaagactgaaaaatggatgtgggctgattctggggagacagagccatggaagggatagaaaagattggctctatgatagatgaatgaaagtttaactagtagaacttttgtaagcaaaattttccctatgttgttatcattttctttatctgccatatcccaaagacatttttccttagaataatgaacttattcatgggtaggccataccaatatttgtttcttccttttttttttgagatggagtctcgctcttattccctaggctggagtgcagtggcgccatctcaactcactgtaacctccgcctcccaggttcaagcgattctcctgcctcagcctcttgagtagctgggcctacaggtgcccttcaccatgcccagctaatttttgtatttttagtagaaacagggtttcaccatgttggccaggctggtctcgaactcctgacctcaggtgatctgcctgcctcggcctcccaaagtgctgggattacaggcgtgagccaccgcgcctggtctcttgtctctttcttaatacatcccagagcacatgtacaagacaaattagtttgaacttcctactctttgctattgatttgatcaataataatctatatgctatgctgcaacaactgaaaatgttttgttctgaatgtggtcgaaagcttggaaagaagggggcaaagagacttgagatcaatagcagattcaggagaaaaaagtagatgccattgtctagaagaatattttcaagtcatgatcaaattgtgtttgggtctgaggaagtgaaatcctcatgattggtgtgtagacaaattggtctataattgccttcactgcctggatttgtttgaattcccttcaaaccatttatttttactgttggtactatagagagatttcaccatgatcctgtaccacatttaataaatacataatatggtttggggcattcactgggcttactataattgcttgctggcaaaatgacttagctttctattcttaagccatgaggatagctcttctacacagcatatttgacagtctctccacagagacagtccagggcacttgacctcggcaagctgaacagtgtcagtggctgctcgttagcagttggtgggaagatccaggtccagcctggccagaggtccgggcctagtctactagcatcccagtagattctggctgtattcagaagagacatgtcgttgcatttcaggccctgtccctggagtgaccctggggatcatgaccctgaacctccagcttcagtggaaagggcagttatttacataaacagggagctcacacttatcaaaggccattatgtgtttggcacagtgccaggcactttcaacatgtgtcttcaataatattcacagcacctctcaaatccatatggatattgccgacatcattttcatcggtgagaaaacggaagcccattttagctagtaagtatgatccaagattaacattcatatctgtttacaatgtttggctttttaaataattctagaggttttcaaatatggggtttccaggagacaccacaggactccaaggggctcataagggatgagggaaaaagagtgagagcccccccaccccaccacatcttcattgccatcctcactggcagacatatcagacttccatgaatgctttcctttgaataaaggttcccttaactaaacaaaagctcaaatccattgtctgctgcaccctttcatgaggcagaatgtttcttgtagaaagtacagtctgacactacagtggctccaatgttttttcctgttgtttaaatgtgacagcaatgaacatgtcttgaaataagtgagctgccatgtagggcttggaaatatttgtatcattctgagatttccagtgtaagggcatcggatgtatcagtttcttccctggatttgcttacataatgtcttctgtgtgcatttcaaaggtactgaaaagcaatcccaattggtgactgaggaagtttgtttcccagctctccaccgtgtgatcaaaaagcatttaaatgatgtcccctgcctgcagggaacaccttgaggcattttacagtcaaagttaaaaagatcatggtccttttcatcaaaaagtttataaattcatggagatcataggtccctgttggtccaagactgcctctttttcaagcctcttgtttctggtcccaagtgcactcatgtttgtcaggcctgaaaataggccttccctctctgccagacctcagaaggtctcactcctttttctccaactcaagatcgtgccctccgctacaccccccttcccgtcccgcccctcaaccttgtcctgctcttgccgcatgtcctactggctgtgtgctgagtgccttatctccctaacatttatcatatcatctcctgcttttgcgctgtcccattttactcacgtgttggacagaaagtgatacatctcctttgattggatcctgtccaagggcaaggtttcagctcagcttgcctataaaattcaggcttcacctgggctggctgggctgaggtcccgttgggtctctctttcgtggacgttttttccaatgcgatgaaacctagttctcgctagatggcgctcaatagcaaaagaagcaagagtagacttcgggaatgacattttaagcaccccagctgatttctgactttaaaaaccactgtgccttgcgcgttggtggagggaagcgaggtctgcaagggattcacgcggtagcaggagcagctccaggggactgctgatagagccattattactccgtgattacagcggcagatcgggcctgcctggcgggggtaatgtggtgaaaactcctggatcatcttttcccatttcaaaaaggcagagctaagactctggaatccaaacgcttcccgcgctgccacgccctggcgcccagcgtgacaaagcttcacgcctgaacaaagtgacagatttttggttgcgtcggcgctggggggtcgaccccgccgcacgttcgctcgctcctgctggctgctgcgggcagctgtggggcctcctcgccctccccttccccacttaccaccaaggctttgtggtcatggttttgttggtggcgaggaggtgaaggggtcattcctttgcctggggcatcagagaaaggcaaacttacgcatcacaatcaatagcaatctgcaggaggcacagcctgggggcccgccatgcttttaggagcccacaaaaatgttttctttaaaatcagaagaaaaaattaatgcaacccgtactggattatattcatttttgtgctcacgaagttaaggtataattttaatattctttactaatagtcatgaaggcaaagggcctagagcccaggaagtcttaatgaggccctggtagtctgacagttctcttctcaatgtgtgaacatcacttttacatagcgcttggggcttcgagtttagtaatttgaataaatacgtccctgtactgagggttcatctgagatgttacacagggacctcacagcttccaccaagtcctgagaaggttgtgagatgtttgtaccttcagagagagtggacctgctcatctgttctaccagtgaagaagcctcaggacagtgccctagcggggaaagcctggcttctagaaattgtctgtggtcttgggaacataggttagcatctctggctctcacttttctcttccatagaatggagtgtttaaatcaagtgatcactaatgtccctccaactcaaacatacgtctcccattctgcgtgttccacggcataaagccaacggaggtggctcatgatacctccagaaatgctgatgcagttcagtgattcaaagaaatcttaaaatatatatgtttaagtttttgttgatcgcttattttattgttataaaatgtttggcttatggcttattgctgaaaggtagattagagtgagaatattcaatgataaatagcacatagcacagcaccatgcacatgtttggagcttaatacacatttgtggaattaagttaacaagagttctttctggtttaaagtggcaagtaatgtgatagactttaggtttcatttcagttctccaccactctcaagaagcaccaccacagctgactctcaataatccttttttgtgtgagtggatgtgtgaatacccacacacatcttgccctggatgtgaggttgaagaattgtctcagctttcagccattattattatctgccaaacagaggtgttctggatggattggcactagggtggtggccaattgtcccaggatcagcgggtggagggagaattctgacactgggggagctgggaggaggccctgcagctgggctaagcccggacttgtgtggagggctttgtgttaacaggttggccaaacagctccaggagccttttaaggaagctccatgcagtggttggggtgtggaatgagggcacagattgaaaccctggagagaggtgaagtgtgtctggcagtccaaccagtgttggggcctctagtgaaggcaaatgtcaaacagaaaatctgcagtgctgcgtgtcccaggaggcaaagggccagcagcatgaccccaggagacagggccagggatgtaggagatgatggggcaaatgaagaggggagaggctgaggagaatcacctggaaggagaattcctatgactgctccagctggaagggacactcctagcagtgcatataaaggggactcttgggcactcaggacttttgtttctgagagtaaacactttttttttttttgcattctaagactatgacaaaatatgataagaaatttcatttggcgaagtgtagaaactaacagaattcatttaggattaataaaactgaagtgtgttgtcactttttctaaataaacagcctctataacccagttagaagggcttataagattcctttttgtaaagaagttatagggtagagttgaagatggcacacaaatctggctttgaattccatctgcagcgtttggtaatagtttgaccagcaaaagacaaattacttattcttctctgaaacacaatttctgcagctgtacagtggggggaaataatatctaccttgcatatttattaagattaaaatttgtgtcaatagtaactattattgacattagttaatagtaactattattatcattattgtgatgagtgacatataccactttttcagagatgtcgaaggtcttacaaattatgccttttccagggaaaacaagctcgttgagccacatttttgtaaatgcatcctggatgtcagactgtaattaatttcagtgtttaccatttaccggccttgagggctgtccatttttgaggaggcttcttaggaattcaaggagagaataagttatatgtggttttgcatttttgaaatcttcagcctgcacaactaactggcataaaagccctacatgcttctgaagaattttcacagcagcctaaatgaaagacgactctagttgctggagatgctggcagaatactgagcaagctgtgacttactcggtttttcagttgataaatcacagaaagttctaacactggcttatactttttatatcacagattcatttatccaggggtttttcaaaaggggaatggcacacctagtgcagtaataacagcacattgcttctcctacatgcctgcacctctgcagatgttatttggcctaatggattgctaatcctcatttagaggatgcatccaggagttcacatgctgatctgaatgtggaatgatattaactaaaaatcccatgagagttttcaaattctctcttctccttagttcaaaagtggttgtggaataatgttatctctctcccagtattgtgaccacaaactgctttctaccctgacattaagcaaaagaaaagagaaagacttaattggaatttgttttaaattttgcaaatgatactaaataaattatctgggcattgcctgtaaatacaataaaattggggcacagacagcaaatactattctgggccagatgtggtggctcatgcctgtaatcccagcacttttggaggccaaggcaggtggatcacttgaggccatgagtttgagaccagcctggccaacatggtgaaaccccgtctccactaaaaatacaaaaattagccaggcatggtggtgcacccctgtgataccaactgcttaggaggctgagacaggagaatcactggaacccgggaggcggagattgcagtgagctgggatcgcgccattgcactccagcctggacgacaagccaggctccatctcaaaacaaaacaaaacaaaacaaaacaaaacaaaacaaaaaaatactatactgaccaagacagccttaatattcccctcagcttcactaaactttttttttccccaagacagtgtctcactctgtcacctagactggagtgcagtgatgagagtaactgggactacaggcgtgtgccatcacacccagctaacttttgctttgtgtgtgtagagacaggggtttcatcatgttgcccaggctggtcttgaacccctgggctcaagcaatccacctgccttagcctcccaaagtgctgggattacaggcgtgagccaccgctcccagccttcactaaacttaagacaaacttcttccacaaggctctcaacttcctttttcttttcttttcttttttttaaaattatactttaagttttagggtacatgtgcacaacgtgcaggtttgttacatatgtatacatgtgccatgttggtgtgctgcacccattaactcttcatttaacattaggtatatctcctaatgctatccctccctgctcccccccaccccacaacaggccccggtgtgtgatgttccccttcctgtgtccatgtgttctcactgttcaattcccacctatgagtgagaatatgtggtgtttggttttttgtccttgcaatagtttgctgagaatgatggtttccagcttcatccatgtccctacaaaggacatgaaatcatccttttttatggctgcatagtattccatggtgtatatgtgccacattttcttaatccagtctatcattgttggacatttgacaacctcctttttcttacagcagttagttaaaagaacttgtaattgcaaattctatgttcctttgagatgtaaaccttttaaaaaccctcttgccacctttacaactctggaatgttatgctccaggtcctgggcgccatccctttaaaatgtaaacctcaaggaacttagcaactttctccctgtctctgtggaaaggtaggagcctaacattggagggcgccttgctctaagttgtaagacaagaggtagacagcctgtgctgacgttgtccgtttccatttcattctagcctcactgaagtctggcctctctgcccttgctattccatttgcttttgtaaagcattctgatgacctttgaactgtccacttaagtgccctctactcttttcactcacagctgctaaagaagctccctcttctgctcttctgttttgtgactttctgcaacattgtctctcacctcactgactgctatttcttggctccctttactgtaatttttctatttccccattaactgttggggttattcagagttccattcacagctcttcctcccatcctacacattgcccctggccattttaaaaaatctgttctctggcttcagttgaagtttcccaaatgtatactttcagccctggctttcccttggcctccagacacctacttcataggctagagtcaatctatcttgtctatttccttagaactggttttctttcaaatatttttggagtcttttaaaaatatttaatggattttattaatttttgccttatttattgcatttaaaattaaaaacaaattaatatacgcaccaccctttgtacctattttatatttttcctaagtttttccaaacttgcagtattgtatgaatgataaactgttttatttttattttacttgagaacactttaaggactgtctagcacttagttggaaaacgttttgagctttccaaaattttattaaagtttaattttaaaagaccataagtcataggaaacaaaagaaaaagaaaaacaagacaccaaaagtggaagcaaatagatttgacgggcatttttagacagcctggctttaagtgaaccggctcagcctggctttcccttccttccaatctgagctatcttcgctcccttcactccctgttctgtaaataaagctgtcatcactgtggagtaactgaagaaacctggcactcccagaaatgtctgcattttcctcttgcatcttctggaatagtccctcaccccctttctcttcctgggcccaccaccatcatacaccaagacccagctcaatatcactgtctgtatatgcctgctatgatatcccttcacctctgtagaattaattgctctctcctcattacttcataagatttctttctgctgacatcctgattccagtatttaacagactctattatgtctttttgtatatgcttccatttttctcattagttatttagctccttgggggcagagatggggtcgattcatcttttggtccttgtggctatcatagtgtctgactcatggcagataatccataaatgttcactgcatgtatgagtgaacaggtacccaaatcatgattacattatcatttacttatctaacttttctgtaacagcaaagataaaggccagggagaggaacaggcttgagtaattgttgatggtttaagaaaaatgatccaatatttggaaataaggagaaaagttgactgtgtgaccttcaatgttatattagaatataacaatcccatccagtaaacagagaccacctgtgggtcaatctgaccagctgcctgcttttgtacaacaggcaagctaagaatgctttttaaatttttaaatggttaacttttaattagttatgtaagtacctacataatttttgccttttggctttcaatgcctaaaatatttactgtttggcttttaaagaaaaagtttgctgatgcatggaaagcaataactttgtttgactcactatttactatggattatggtccagacgttttacaactctataaaattagaaattagtgtagagaaaattgatgatgcaatgattgtagtttctgttttacatttaccaatctcatttcatcattctctcttgtcctctggctacctaaaattccaatttttcatattctctttaaaccagctttgtcatcctaccaattcccttatttcaaaattaaataggactttgacatgtgctcagtatctcctttatgacaattatggtttttacattttgagggtgattctttgataagggttaggggaggcaggagtgggtagggctggtgtttctggaggctggggggacactggacctgaggtgggaggaccttcttacccttcagtgttgcggaccactacctctaaactatgtctactacgaaggtggtcagggaagggtgaaagggtaagaaatccagtaatgcagttttgctatagttgactatcctggctgggaaaacattgaaatgataggatgccttctctattttccaaggatagattcttgagattctctcctagagacaaagctaagtatttattcttgatatacagaatttccagcagctgcctttttttcttgtcaaagatttctcccttttaattctctttcaaggagaattttctcagcagattggatcatcatcattgagttcaagtaaatacttgaaagatcaaaacctgaatcagggccgttcctgtatttgcttaagtgaccttctgttatcatcagggattttgagcatcattttctcttgggtctcgcttactacatgctggaggatgggcactgttgtgtatcagcccaagccttctgtaactgaaaagtccacaccagcaatagagccaagagctgtgtaaattggaatttgagtccttcttttctaggaatctgaagtaattatcttcactccggatccagggtcctgagagacagcacgatctgctggttgcactggttggttgtactagggacattttaatcagctcacccgtcagtcaccatgatggcttacacgcaaatatcccaccaaaaggagaaaatttggatcagccaatcgcactgaaaaactaggagcaaaatagctgtcatattgctagatttaaaaaagaggaagaaaatgattgaaaatcatctgcacattttccgttaatgtgttttaaaatttagatatgcatttctcttataataattttgtatgtatttcctcagactaaaattgtataggagtactgatgctagaaacagttttctgtaactgtacaggcttttttttagaacagtattttaaatttcatgttcacaaagttttataagatacgcagattcatagaattaagaagttaattaactctattcaaaagcaatggtggtgagaatttttgggttttagtactgtctcctccctggattggaacaagggtttgaatggaaaaaggaggtgtgagtgagggtggtgtttgtgaatctgtgtttgtgcacctgactaccacgtgctttggggtcgctatctcctcctcttcagcagcctcaccccccaatggtagctcgtactgctgtgtgccctgcatggttagtggtcccctctgaatctcatattaaaaatctgatctccaatgctggaagtgtgggcctaatgggaggtgtttgtgtcgtaggggcagatccctcatgatatgagtagattaatgtcctccctgggagggaggggtgagttcttactctgtgagctcccaccagcactgggttgttaaaaagagcctggcatcaccctctcctctgcttcctctcttactgtgtgatttctgcacatgctggctcccctttgccttttgccatgagtggaaacagcctcaggccctcaccagaagcagatgctggtgcctgcggaaagatgagccaactcttttctttacaaattatccagcctcaggtattcctttatagcaatacaaacagaaaaagacagctggtattccatctccccagccctggaccttagtggctgcagctggctgcttagttctggctatccccggccaaaggctgtctcattgaccagcctggagggactagagttcttttcatttatttctactcctacattctctcttctgttcaggcttgacaaatgagacttaaagaaaactcagtgccctcttcattatgggaccatcccttagtgatgcccaagcccacaggaatttgtaggaagtctggcacaacagaaacttgtccttaaaaagtcttttggaatgaaaaagatgtagttttgatcccagcatagttctaagatgtcccttttctactacagtgcaaattcctttgggcagggatggattttcatgcattagcatgttatatggtggtggatgaatgctgttttggattaagcatgtagaagatggtcaatgtcctgatcatcagtccagtgcccacttcctgattacatgggtgaacccagccttcgcctttggtgaaatatctaaaccagaatccccagctgtgcatgaaggagcccacagagtcagtgactattccctgtgcccccctctattccttgcctgctcctccctgcctgctggtaccttcctccttcccctcactgttgactggaaggaaaacctttgagggcggtttagcacagtggcttctagctatgcatagcgtagtataattaggaaccatgctggatattggatttacccatttggatttacatagatgaatccatacagttcattgattatttttaacttataaaatccatatttgacttactaattctgctgtcctcaaacactttgattgaaccatcatcatttggttgatgcttaatgatgttctaagcatcacttaagacaagcatcactatgtcctaactggtgcaacatagccagtttttggcagccctcttgcatagagttattattttatgagttttcaatgtatataaaatttagattttgtcactctccaggtatctggtaaggaatagagtatgaactataagttcaccgaagtgcttagtgtaacattcagtggcttttgcaaagtatctcccttgtagttaccatgtgtagtcattcaacattcaacagctttcattcagattcactgcttctcctggctttacatgttaatttcttcaaaagtatttgagttggtgcaggctcagggttgaactacctctggaaagcaagcaagtaatttcccaggttgtccagcaggcactggctttcccctacttttttccaccactaaaaataagaattgggcatgtatgccatagttcactgagtaggctggaggtattcttaggtagctcagcataaatgtgactctgctgggagtgaaactgacgttagcaccatctcatgcttaccacctttggcttcttggaagaaaagctgcatagcagaactattcacaagaaatcagtgaaaataatttcagttccaccccctccacaaataccttgtcacgctactttttactgtttttgctggtaccttaagcaggtcacaaattgatagtcaagttaattatgacaatgttgcaatagtaactactaatgtttattaagtaactagaatttgtcaagtgctatattaagtattgtaaatattctttcagttagttctcataatgttaccatctccattttcttttcttctcttttttttttttcttttttttttttgagaggagtctctctgttgcccaggctggagtgcagtgggggcaattttatctcactgcaacctctgccttccgggttcaagcgattctcctgcatcagcctcccgaatagctgggattacaggtgcccaccaccatgccaggcttatttttgtatttttagtagagacagggttttgccattttggccaggctgatttcgaactcctgacctcaagtgatccacctgccttggcctcccaaagtgctgggattatgggtgtgagccaccacacccggccaaaatttctccattttccatttgcagaaattgagtgctgcagttaccacacaagattcaacatttagggctggggatccccaagaccattactatgctgtgcttgcttccaatatcaacagtgtcccttatacagccctggcagtgcactcacagcttcccaccctctttctaagacactacttaagtggcatctacattgagaagctgctccctacagccgcacacctgggttatcccttgcctcaacttggctcctcacgttgaccttcttgtgctggtggatgggtccctaagtaagctgtcagctccctgagggaggaaggaagacaggggattgtgctatgacttcttcaatgctttccaagtcctgctagcttaatcaattggctgaagaaattagccttctgatcctaactggcaaagacccctggttccttttcagttctgaagtagttttccggggaagaggcagtgtcttactggcatttaggaggtgtttgatttcttaggggagccacagggcttactcagctgctcctgtttagaagtaagtgctcccaggctcaatgcctacaggcggtctgtctttttaaggatcctgtttactaaggtacggaggcaatttgcttaaagttgctcaaagcactgctctatcaaatataaatgtctcccactgagcctttttggtttgcattttgcccatggcctcttccttctgctttcgttgttagtccacagagagccagagagggtgttaaagattcactccactaattcatagccaattaggaagctttgttttgaatttgactgggaggtagctttggcagaaatcaggagccctccctgacttttaccccagggaataaaggacttctttcaattggttagaaaacagaattttgaaactaatggtaaaaacagttcccaatttggtcacagctggttacaatggtgcacactctttgctttattatcagagcaaatgtttgctttctcttgtgtggctttgggctaagctcccatgtctttaaaagttttctccttgtctaactctttgctttaatcttcacatggaagctgatctgtagtatacaaccaaaaagcaaatttattttcttctttttttttgttgatggcgaagtgactttctccaagtttgaatttttatctaatgattatttttctttccttagaatgctgtctctgatcctgaattacatgatgaagtagctattctgataatgaactgtgattgaaagattgcttaggtaggaagccccgaggttgttgcagagcactgagaaagtgcttttgacttctagcagaatgtaaattagcttggctgtgggctacattaaaaaaaactcttaaacacagcaaaagttttgttctgattaaacttaaaattaaagctctcagattgtgcaacaagaggtgtgcttgttcattgctttttgatacaggaaaatgttaacttgcatgtctttggactctacctttctaatgatgtgctccatagcttccaaaaggttatttcatctggtatcatttcagtttgatttttgtggcctaaagattgaaacgtgtgcttaaaaacagaacgaaattaaaaaaatgaacaaaacatctctaccactttctgggttggattcttttacctggttcaatgttgagagagtagctgtctatttccagatggagttgttgggctgcagcagaacgaaaatcctccaagaccccgtgcacagccttggtgaggttatacggcactgacttagcaaacttcattttgctattcacaatcacactcccgtttctgaagttaagtatttcaagttgcttaaatcctgtaagattggatcgtagatatggaaccagctgcaaaataaaagatggtttcctcttaactgtgttctaagtgctcagctgctgctaattccacttacactcacttttcattaaccgagacatatattttagttcctttttattattttgatttttgtttttggatttaatgtgagaccagaatgccactacttaatggttgatttgcagtgattagtcccatatttccacctttctatctgtgtattgagatggatggctgtgatttttttcatggtgaattgtgagaacagatgatttttaaaaacctgagccaatgctattagcaaagcaggaatgccaagttcagttattaaaaaaaaaaaaacccaagtaaataaaaatatgttccaaactgagcccaggagcagactgacctgtgtctatgtaaatgggacatctatttggatgcagccaatttgaaatgacctattaaaacaaacaacaacttaaacatcagcatgtctctctacgcagtaaatatttcccggccaacacaaatgtggtgtagtggaaacagcaggaaactggcagttaggagacttgggtgccagtcctagaactgtccctaactagccatgtgacctttatcaagccctgtaaccactgtgttgtacctcagggcccttatctgaattgtgaggaagaacaaaaagtggctcccagcgagccgtttccaaactatcataatctcaacagtatgccccatggcattgtgtttcaggttcccacatctgcctcctgtgagccacgccatcctagagatcatttttcagaaatgtttgaaactcagtgatgttcaccttgtccttggctctgaaagtgagcctcctcattcatgaattgtactgtgaacccagaaagcatagagatgcaagcgccgacctcctaggtgtgacccacacctcctttttatttgcccctgtccccaccccaccacaattttgactctgacccagtcccacattctgttacttccctcacaaggtttttgtgtgagtaaaatgaaattttaaacaaatcgtggtacttcccttttcaagttactgtcccctgatgaggacagaacttacttgactagcctcattcttggtgtcttagcattgctttggcctggggtagagattccctgtcttcacctactgtgcagatagctaggtgctgcttctcccaaatccattttcctatttctcatagaaagaggctgctgatctagaaagcacattttccagcctcccttgtggcaaggatggccatgtgactagttcccactaatatgatgtgggcaactttggtgtcttttgcttaggagaaaattgctttccctcagcttcctctctgcttctcacaagtggaaacagggatgtaccaatgacccagctttgaccatgtgaatgaggaaatgcccttggtattggcagagctataggatggaagaagtgtgggtccctgaatggcatcatagagctaagctgtcctacccatcaagtgaaagagaaataaacttgtactgaatgaaagtcactatattcttacctcttcattatggcagcttagcatgaaccctaattaacatgccatggttagtttgtcagaggcaggtgaaccagcacaactccatcttgaataggagctgggtaaaatgaggctgaaacctactgggctgcattcccagacagttaagtcacaggatgagaaaggaagtcggcacaagacacaggtcataaagaccttactgataaaagaagttgcagtgaagaagctggctaaatcctaccaaaaccaagatggccatgagagtgacctctggtcgtcctcactactacattcccatcggcaccatgacagtttacaaatgccatggcaatgtcaggaagttaccctatatggtctaaaaaggggaggcatgaataatccaccctttgtttagcatagcatcaagaaataaccataaaaatgggcaaccagcagccctcggggctgctctgtctatggagtagccattcttttattcctttactttcttaataaacttgctttcactttgcactgtggacttgccctgaattctttcttacgtgagatccaagaaccctctcttggggtctggactaggaccccttttctgtaacaggttcacagggactctgttccctgagactctcccaatatctactcacctcattataaatggtgtggggtggggagatagcccagataaagtcttactttaaagcaaatgttcacttgagaaattgggtttcatgtggattttaatttgtgtaataatttaacttatatgaagtataaaattttttatttattgtcagacattctgccatctgtgtgatatgtacaatttattttaattaaccatgaatgtatagaggtattacatagttcaacatttcttattgtatatgtatttcttattgtatatgtagaaacaaaataaacgtgagtttgggagtatcttattatcaaagatatatgtcataataattatcttttcactttctttgttagggaccaggaatgataaaccacttagtcattttttaggtttacaagaacttaaggggaactaagaaaggaacccttactcctgaactctcagcctcatctgtgctggaccattctaactttgtaccctttcatgagattgatataatttagaaaatgttcactctatttttagattccatgttcagtgcttgagtgttatgtattattcctggattcactaagttagggagaattataatgaaaagagtttaagaacaaatttgttcttacagattgggtggcggtgtcttcccatttgtctatcacagaactcacttccccagttggatctgaattcatctcaaaattctagttgaatgtcttcagcaacagctggcttggcggtttgtttctactaacactaattgctcaagacagccaataattatattataaaataacaacaaagaaagaagagacaaagaattgggaattgtgagcagtgcccactcaccagctgtgtgaattgttgctccagagctcggtactccagagagctcttgttgaacaggtcgttggagaaggccatgttagcaacacgcagactgaagaacactaccagctctcggcccttgggggcaatggtcatagaactagtggtgatatactgtaaagctgagacaggagtggtatcctccaagaaatgatctgggacagaaacatattcgctgagctctggtacctcagatggggcaggagtgtcagacagatccatttcatctaggtgtctgaccatatcttcgccacctgcacttgatcggctgtcatctgaagatgcaggtggatgtgaaattcccagagccagttggctgattgcagaataatcactggtggggatggtgagccctggtactagcattgtctggtcagtggccattgtatctgtggtgccttgatcagtcagagagaagatgcttgatgccataaagaaaggtggagcttctgacagggaggtagaggccatagcaggtggagaccaagaagtgtctgtggaggaagtacaatttcattatgtccaagtattccccaaagaatagaaagtgaaaaaaagaaaatccaaaattaagcttaacttaagaaaatacatagcatttgcgtagatcatttcaatagtcatttttttttttttaaagaagagaaattggaacagaaagggcaggcagcactatgtcccaacctagggagacaaagagtggatccctgtacccattttattcaggcccagtagttcttgatatatgagactaaaagagcaccagttaactagaatttctggaattactgcctagtcagacacgatacacttgggaaccaagtagtacaaactgactaagtcaccaattggtgccaaactgcagctggcattggaacagatttagatccctcatccccgtatagaactcccagacaactaggtgtgcagttttgacccagaaattttattcactttccaataatgcaagtctgcattttatgcaattggatttttttggttacaataatgatgttttggtatttttaccacttgaaatttaaattatgcttttccaaaattgagtaatctaattgaatagcttgtcaatttgcaaaatgatactgggagtataaaggtattggtgaacatataatttgaatgttacattgaccatacaacttgctgtttattaatatttaaaacctctcaattagctgggtgtagtagtacacgcctgtaattccagctactcaggtggctgaggcccaagaatctcttgaacttgggaggcagagatagcagtgagccgagatcatgccactgcattccagcctgggtgacagagtgagactctgtctcaaaataataataataataataataaaatacagtaaaaaacctttgccacagttacattattacgctctgacaatttctaccaccattttgcattgctaccttgggtaagtacacattgaactatcaaaacctaccccttttttggtacaaaatgaaaataaatatttctaaactgagaaagtggtgggaactttcagataaacagattgttgaattattaaaatattccaataaacctaaatccagagccactgatgatatttaaggcattaagtgaacaaaacagggagctttttgtgatttcttcagtggccttttggcaaatatgcaggaaagctctgttgaaatccaaatgctaagcatgataaatggactgtctggatgcagatataatctctggactctcagtcagctaatttactacggtgaaattactaaaaccgaaactccaagtgataaacagctctgaaagttggaatcatattagttttattactttcttaaaataaaacctgtctgttggtgagttatgccagatttcagagaagcaccctcttttctctcacctggggagggtacctgcgtgtgtctactcataattcactcaattgtgagaaataatgttacctaatatctaagatctctctggagatacacttaaagttttattaaaatctccattgctatgggctgaatgtttgtgtccatgcaaaacttgtatgttcgggctctaatccccaatgtgatgatatttggacatgggtctctgggaggtaattaggtcatgagggtggagtcctcatgaatggaattactggtcttgtaagaagagactcaagagagatgatctctctttctgccatgtgagaatatagcaagaaggcaacaaactccaaaccaggaggagagcccttgtcaggaataaaatctgcaagcaccttgatctggcatttcttggtcatgagaaccgtgagaaatatatttctattgtttaagacatccagtccatgatatttcattatggaagtctgagttgactaaaatatccacaaacagatctgggatgataaattgaaaggatttgatttgactttttttgtgtcatgggaaatgcatttgattctgtgttcttatgatgtgatctctgctcctgcgggtgataagagttggcaagaagcacaatgatagatgtcttcattttgctctttcaccagcatttcattactcacacctttcttactatgtagactttaacctgtttaaaataggcttctacattatgtcatcaatcaacaaaaataaatttctggccatttccctttgtgacatctttttaaattttatactttaagttcgaggatacatgtgcagaacatgtaggtgtgttacacaggtatacatgtgccatggtggtttgctgcattcatcaacacatcatctatattagctatttcccctaatgttatacctcccctatccctcccctactgtgcgacaggtgtgtgatgttcccctccatgtgttctcattgttcaactcccacttatgagtgagaacatgtggtgtttgggttgctgttcctgtgttagtttgctgagaatgatggcttccagcttcatccatgtcccagcaaatgacatgaactcatcctttttttccctttttattatttatttatatttttattatactttaagttctgggatacatgtgcagaacgtgcaggtttgttacataggtataactgtgccatggtggtttgctgcacccatcaaccagtcatctacaataggtatttctgctaatgctattcctcccctaatcccccaccccatgacaagccccagtgtgtgatgttcccctccctgtgtccatgtgttctcattgttcatctcctacttatgagtgagaacatgcggtgtttggttttctgttcttgtgttagtttgctaagaatgatggtttctagcttcatccatgaccctgcaaaggacatgaactcatcctttgttatggctgcatagtattccatggtatatatgtgctacattttatttatccagtctatcattgatgggcatttgagttggttccaagtctttgctattgtgaacattgccacaataaatatacctgtgcacatgtctttatagtagaataatttataatcctttgggtatatacccagtaatgggattgctgggaaaaatggtatttctgattctagatccttgaggaatcgccaaactgtcttccacaatggttgaactgatttacactcccaccaatagtgtaaaagtgttcctatttctccacatcctctgcagcatctgttgttttctgactttttaatgatcgtcattctaactggtgtgagatggtatctcattgtggttttgatttgcatttctctaatgaccagtgatgatgagctttttttcatatgtttgttggccgcataaatgtctccttttcagaagtgtctgttcacatcctttgcccactttttgatggggttgtttgttttttccttgtaaatttgtttaagtttcttgtagattcttgatattagtcctttgttagatggatagattgccaaaattttttcccattctataggttgcctgttcactctgatgatagtttcttttgctgtgcagaagctccttagtttaattagatcccatttgtcaattttggcttttgttgcgattgctttgggtgaattagtcacgaagtctttgcccatgcctatgtcctgaatggtattgcctaggttttcttctagggtttttaaggttttagttcttacatttaagtctttaatccatcgtgagttaatttttgtataaggtataaaaaggggtccagtttcagtcttctgcatatggctagccagttttcccaacagcatttattaaatagggaatcattttcccattgcttgcttttgtcaagtttgtcaaagatcagatgattgtagatgtgtggcattatttctgaggcctctgttctgttccattggtctatgtatctgttctggtaccagtaccatcctgtttttgttactgtaggcttgtagtatagtttgaagtcaggtagcatgatgcttccagctttgttctttttgcttagaattatcttagccatacaggctcttttttggtcccatatgaaatttaaagtgtttttttctaattctgtgaagaaagtcaacagtagctttatggggatagcatttaatctataaattactttgggcagtatggacattttcaagatcttgattcttcctatccatgagaatggaatgtttttccgtttgtttgtatcctctcttatttccttgagcagtggtttatagttcaccttgaagaggtcctccacatcctttgtaaattgtattcctaggtattttattctctttgtagcagttgtgaatgggagttcactcatgctttggctctctgtttgtctattattggtgtgtagaaatacttgtgatttttgcacattgattttgtattctgagacttatcagcttaaggagattttgggctgggatgatggggttttctaaatatataatcatgttatctgcaaacagagacaattcgacttcctctcttcctatttgaataccctttatttttttctcttgcctgattgccctggccagaacttccaacactatgttgaataggaatggtgagagagggcatcctcatcttgtgccagttttcaaagggaatgcttccatcttttgcccattcagtgtgatattggctgtgggtttgtcattaatagctcttattattttgagataggttccattaacacctaatttattgaaagtttttagcatgaagggctgttgaattttattgaaggcattttctgcatctattgggataatcatgtagcttttgtcattggttctgtttatgtgatgggatacgtttattgatttgcgtatgttgaaccagccttgcatcccagggatggagctgacttgatcgtggtggatgagctttttgatgtgctgctggattcagtttgtccggattttattgaggatttttgcatcaatgttcatcagggatattggcctgaaatttttttttgttgtgtctctgccaggttttgatatcaggatgatgctagcctcataaaatgaattagggaggatgccctctttttctattgtttggaatagtttcagaaggaatggtaccagttcctctttgtacctctggtagaatttggttgtgaatccatccagtcctgggcttttcttgttggtaggttattaattactgcctcaatttcagaacttgttattggtctattcaaggattcaacttcttcctggtttagtcttgggagggtgtatgtgtccaggaatttatccattttgtctagattttctactttacttgcgtagaggtgtttatagtatgctctgatggtagtctgtatttctgtgggatcagtgatgatatcccctttagcattttttactctgtctatttgatgcttctctcttttcttctttagtagtctggttagcggtctattttgttaatcttttcaaaaaacaagctcctgtattcattgattttttgaagtgcttttcatgtctctatcttcttcacttctgctctcattttagttatttcttgttttctgctagcttttgaatttgtttgctcttgcttctctaattgttttaattgtgatgttagggtgtcaattttagatctttctcactttctttggtgggcatttagtggtataaatttccctggaaacactgctttacctgtgtcccagagattctggtacattgtgtctttgttctcattggtttcaaagaacttatttatttctgccttaattttgttatttacccagtagtcattcaaggagcaggttgtgcagtttccaggtagttgtatcattttgagtgagtttctttttttcttttttattttttgagatggagtcttgctctgtcacccaagctggagtgcagtggcatgatctcagctcactgcaacttctgcctcccgggtttaagcaattctcctgcctcagcctcctgagtagctgagattacaggagctggacaccatgcctggcaaatttttgtatttttagtagagatggggtttcaccatcttggcctgactggtcttgaactcctgacctcgtgatccactcgcctcggcttcccaaagtgctgggattacaggcatgagccactgtgcccagccgttgagtgagtttcttaatcctgagttctaagttgattgcattgtggtctgagaggctgtttgttatgatttctgttcttttgcatttgctaaggagtgttttatttccaattatgtggtcagttttagaataagtgctatgtggtgctgagaagaatgtatattctgttgacttggggtggagagttctgtagatgtctattaggtccgcttgacccagagctgagttcaagtcctgaatagccttgttagttttgtcttgttgatctgtctaatatagatagtggggtgttaaagtctcccattattattgtgtgggagtctaagtctctttgcaggccctaagaacctgctctataaatctggttgctcctatgttgggtgcatatatatttaggatagttagctctccttattgcattgatctctttgccattatgtaatgccctgctttggcttttgatatttgttggtttaaagtctgttttatcagagactagaattgcaacctctgctttgtttttgctttccatttgcttcataaatattcccctatccctttattttgagcctatgtgtgtctttgcatgtgaaatgggtctcctgaatacagcacaccaatgggtcttgaatctttatccaatttgtcagtctgtgtcttttaattggggcatttagcctgtttacatttaaggttaatattggtatgtgtgaatttgatcctgtcattatgatgttagctggttattttgcccgtttgttgatggagtttcttcgtagtgtctatggtctttacaatttggtatgtttttgcagcggctgttaccagttgttccttttcatatttattgctttcttcaggaggcctggtggtgacaaaatctctcaatatttgcttgtctgtaaaggattttatttcttcttcgcttatgaagcttagtttggctggatatgaaattctgggttgaaaattcttttaagaatgttgaatattggtccccactctcttctggcttgtagctttctgcagagacctgctgttaatctgatgggcttccctttgtgcataacccaacctttctctctggctgcccttaacattttccccttcatttcaactttggtgaatctgatgattatgtgtcttggggttgcttttctcgaggagtatctttgtggtgttctctatattttctgaattcaaatgttgacctgtcttgctaggttggtgaagttctcctggataatatcctgaagagcattttccaacttggttccattcgccccctgcatcacttccaggtacaccaatcacatgtaggtttggtcttttcacatagtcccatatttcttggaggctttgtttgttccttttcatttttttttctctaatcttttattcattgagttgatcttcaacctctgacatcctttcttccgcttgaccgattcgcccattaatgtgtatgcctcacgaagttctcgtgctgttttttccggctccatcaggtcatttatgttcttctctaaactggttattctagttagcaattcctctaaccttttttcaaggtttttagcttccttgcattgggttagaacatgctcctttagcttggaggagtttgttattatccaccttctgaagccttcttatgtcaatttgtcaaactcattctccgtccagttttgttttcttggtgatgacaagttgcgatcctttggaagagaataggcattctgatttttggaattttcagccttttttgcactggtttttcctcatctttgtggatttatctacctttggtcttcgatgttggtgacattcagatggggtttttgtgtggacgtcctttttgttgttgttaatgctattcatttctgtttgttagttttccttttaacagtcaggcccctctgctgcaggtctgctggagtttgcgggaggtccactgtagaccctgttttcctgggtatcaccagaacagcaaagattgctgcctatttcttcctttggaagctccatcccagagaggcaccttccagatgccagccagagctctcctgtatgaggtgtctgtcgacccctgctgggaggtgtctcccagtcaggagacacagggttcagggacccacttgaagaggcagtctgtcccttatcagagctcaagtgctgtactgggagatctgctgctctcttcagagccggcaggcagaaacgtttaagtctgctgaagctgcatccacagcccccccttcccccaggtgctctgtcccagggagatatgagtttgatctataagcctctgactggggctgctgcctttctttcagtgatgccctgcccagagaggaggaatccagagaggcaatctggctacagcagctttgccaagctgcagtgtgctccgcccagtttgaacttcttggtggcttccgctgtgaggggaaaactgcctactcatgcctaagtaatggtggactcccttcccctcaccaagctcaagcatcccagttcaacttcagactgctgtgctggcagtgagaatttcaagccagtggatcttagcttgctgggctccatggggggtgggatctgctgagataaaccacttggttccctggtttcagccccttttccaggggagtgaacagttccctctcgctggcgttccaggcaacactttggtatgaaaaacaaactcttgcagctagctcagtgtctgctcaaacggctgcccagttttgtgcttgaaacccagggccctggtggtgtaggcacctgaggaaatctcctggtctgtgggttgtgaagaccatgggaaaagcgtagtatctggctggaatgcaccgttcctcacggcacagtctctcatggcttccctttgctaggggtggtagttgcccaacttcttgtgcttcctgggtgaggtgatgccccaccccaccctgcttcagctcaccctccgtgggctgcacccactgtctaaccagtcccagtgagatgagttgggtacctcagttggaaattcagaaatcacctgccttctgcattgatcttgctgcgagcttcagaccagagctgttcctattcggccatcttgccagccgaaaaaaagatgttttttgtgacatcttaatattaatccctcacattcacaataaacctaaccaagttaattcattaaaggaacaatttgctatttaattatagggttgcttgataaaatacaggatgctcattggaacatacgtttactaaaaattattatttttaatctgaaatttaaatttaactggacattttgtatttttctttgctgagtccagcaaccctatttaaatgtgattttaaaagactcctactctcttttgttttgagattgaagcttctaaggttatagtcaattcctttggaaaaatattatccaaaccttatcactatttgtaagtgtattttaaataatcatgttttcatctaattcatatgaaaaaattagacatagtagtgacacagaccagtccaacattgtatttttgcactacaataggaaagtcaaacactaaaagccaaggccattcatttcactctgaactatgcaaaatgaaaagatttaaaataactgttatgctagagtgcgtgtgtgggtctgtgagggtatggagtgtgtttacgtgtatgtgtatgtggcagtccattgtttctaagtccagctgccaaatgtagagtatatagctattgtggtcactttccaggttggagttctgtccaaaggcaaggccacaaatgatatggtccaacccaaagtagatgaactcaggtccatctgaagcccaaagtgaggtatgtgggtgggagatgccagaagccccattagtagccagaagaagacaaagcagaagatgaacagtgtgtgaggaacaagtacagatgaaaggctattttaaatgctactagaaagggtcacatatatatgctgaaccataagcatcaagtggttgcttattcatgtcaaaaactctcaaaagaagagattccatccaactcctttatatctttaaggggcatgaccagcaaattcttaattttatatcaaacaaatccattcttatttataataacaagaaagttattatcttcctttttggaatattatagagatagaaaatgttaattatccactcattcaacaaatagacattgatagcctagtatgtgccaggcattattccaggtgctaaaatatataagtgatcaaagataaaattctggccccaaagagcttactgtctagtggtggaagacaaaaaacaaaacaaaaaccaaaacaatacaaggaaaaatacatggtacgccaggtggtgataagtgctatggaaataaaatgaggcagaaaaggggatggaagtacagggtttccaattttatacagttgtcattgagaatataatatttgagaatagacctgaaggagatgagttagccatgcagcaaatgcaagtgagaaggccaaaagaagaagaatgcctgtcatgctcagggagcagctagctgggagaacagcatggccacagtggaattctatactatcaatcaagtgtcagggtggctaaagacattttcaagcacacagtcttaaaattttttcccaggcaccttttcttagcgtgtgtttacctaaaatgaggttgtaaaccaagaaaaagaaagaaatgggatactgaaaaatgttcagggaaagggaaatctccaggaaatggtaaaggggactttgaaatacacagttacccaggtgtaaaatgcaaccagttaaaaactggattcatctcaagagacaggtacattgaatgcatctttcaccaagacttctgcaattgtaccaatttttaaaagatttctttgccattttgttttttgagacaggttcttactttgtcacccaggctggagtgcagtggcatgatcacggctcactgcagccttaaactccctgtctcaagcactccttcctcctcattctcttgagtagctgggaccatgtgcatgcaccaccacacccagcaattaaaaaaattttttttttatgtagaaatgggggtctctcgatgttacccaggctggtctcaaactcctgggctcaaatgatccttctgccacagcctcccaaagtgttgggagacatgacccatcatgtccagcaacaatttattttccagctttattaaggcataattgacaaataaaaggtgtgtaccaaatttcttaacctgacaaaactactggatgaaatgttccacagaacaggagaataaacccagagggagaagggatcaaggaatccaaactgggagaaaggccaaggaaaatccaagatagcaaaacaggtagcaaagggaagacccagaagacagcggtccaaaagtcctagagagtagctgtccagagagaaagaggtggtatattacaattgcaatggaaagtttgagaagaattagtaataagcacaaagaaaactaagtgaataataataataaataagcctgatgcagtggctcatgcctgtaaccccagcactatgggaggctgaggcaggtggatcatctgaattcaggagtttgagaccagcccggccaacatggtgaaaccccaactctactaaaaatacaaaaattagccaggtgtggtggcacgtgcctgtagtcccagctacgtgggaggctgaggcaggagaatcacttgaacctgggaggcggaggctgcggtgagccaagattgccccactgtactccagcctagcctacagagtgactctctgtctccaggaaaaaaaaaaaaaatcacagaaaacattaactccaggaaaacagaaaggaaacacagcagattgattggctgagaatatttactataaatactgaatactaatttaataataaaatatcactatattgggaacattgaagagagaaagaggggatggtattgcaagaaacttaactctttacctacaataatggaacgtcaataaatgatgtatgaaacgatgagtcaaaaatgcatattatttaaaaatatggggaaaaataaatgtcagacaaaacagctgagttaaaagggactgagttaaaagacattgtttttggtgagtgttactgcacagtaaagaggtgtgagatagtaaaatgctgtatttgtcatgattttgttaatatgatttgactttaaaaaattaaactttttattttgagataattgtagattcaaacgcagttataagaaataatacagagagtaacatctgtgaaaattgcagagttagacgctccaaaagtctgtcctttcaataaaaagctggtgaaaagtgtcggaattgactttttcagaattctggaaactaaacaaaagcttgcagcaaacaagggaatgcttaattaagaacaacagctaaatctcagtaagaacagtgaactttgtggcatttttaacttaccctgttatcccccactccccagctcagtggtagccttgaaaataacagccctcatttccagtagcagtactccagggagcagaatggacctcactgacaaagagttttacttatttgtttcaacctgactccctggaataccaactcaaaaggctggcctttatctttcctaactaggaactctcctgatgctaaaatggttacctggggaaagtttgtcaaaaacacccaggcaaatgcactaattgctactgtgtgaggcaatggataacagctgggcacacaatagactaagcaaaaacttgggaggaaaggctggggaatgagatgctttggggaaaaagcactttcaaaagctctgacatattttggggaatctagagggccactttaatgcccagggctgtatgcatgctccgtaaggacctaagaatgcatatagttctgggcattaaattctcatctctgtctgaccttcaaagttctgcaaaagcacgaagagaaggctaatcgggaagtggctgctttctggttatgggggttcttttggagatgatgaaagatttctggaattagacagtgcataacattgtaaacatattagaaaccactgaattgtctacatacaatgattaaaatggtgaattttatgttatgtgaattttatctccataaagaaaaaataggctgggcacagtggctcacgcctgtaatctcagcactttgggaggcaggggcaggcagatcttgaggtcaggagttcaagaccagactggctaacatgatgaaaccccatctcttctaaaaatacaaagattagccaggtgtggtggcgggcgcctgtaatcccagctactcaggaggctgaggcataagaattgcttgaacccaggaggcagacgttgcactgagctgagatggcgccactgcactccagtctgggtgacagagtgagactagtctcaaaaaaaaaaaaaaaaaaagagagagagaaaaatgaaaaaataatatagagagaatttgcatactcattacccctaataacatcctgcaaaactatagcataatatcaaacaatgttgacattgataatctagagacaattcccatcatcacaaggattccttcatgttgcccttttacagtcacctctactctcccacccatacccttcttaacatctggcaaccactaatgtgttttttatttctataattttgtcatttcaaggatgttatataaatggaaaaatacagtgggattggcttttcttactcagtataactctggagattcatccaaattgtgtgtatcaataatttgttcctttttattgctgagtagtattacattatatagatgtaccacagatggtttaaccatttactcttgaaggacatctgggttgtttctagttttgggttatttaacataaagctgctataaatatgcatgcacaggtttttatgtgagcatgttttctttctctataataaatgctcaagaatgaaatagcttgcatggtagccgtatgttaaatttctggagaaattatcaagctattttacagagaggctgtactattttacatttccaccaccagcaatgtataagtgatacagatccaaatgcattttccagcatttgttgttacttttttttttttttaattttagctattctgatcagtgttaatgatatctcatcgcggttttaatttggacttccctaataaataaaaatctgaacgtcttttcatgtgcttatataccatctgtatatgaggtaaaatgtccctccctatttggtaaaatgtccattcttatcttttgctcattttctactggaatttttaattgttatgagaattgtttatattttctacatacttgttctttttttttttttttttttgagacggagtctcgctctgtcgctcaggctggagtgcagtgtggccggtcttggcttactgcaagctccgcctctgggttcacgccattctcctgcctcagcctcctgagtagccgggactacaggcgcctgccatcacgcccagctaattttttgtatttttagtagagacagggtttcaccgtgttagccaggatggtctcgatctcctgaccttgtgatctgcccgccttggcctcccaaagtgctaggattacaggcatgagccaccacgcccagccacacacttgttctttaccagatatatgtttgcaaagattttcgccagtctgtatcttttcttctcatcctcttaacagtgtcctttgcagagccattatttattcaactactttgttccgtctaggatatacgagacaaaaataaaactcaggaaactcactatcatgtcatattttaggccctaaggttcctagttagtccatcttcttctctttacctttcagagccttctcatatttgttttgtatataatatcagggtatttagatacacttaggaggaaaagtacattcatttcatcttcctgggggtggaaatctacttgaatttttaaatgatgtccttattttatttattaaaaaacattattaaaaatatagactaaatatgtactgttatttgaatgtcccctctaagactcatgttgaaatttaattgttattgtggcagtatttagagatgattaggccatgaggactcccatgtcatgaatgaattaatgccatgatcatgcaattgggttgttataaaaggcagtttgaccctctcgctttcttgctctcaccccctcctgctcttctgccttccatcatgaaattatgcagcccaaaggccctcaccagatgcaggaccctcgaccttggactttccagcctccagaactataagcaatacatttattttctttataaattacccagtctgtggtattttgtgacagtaacatagaatggaataaaacaatttgactgaagacagccaggtcaatactgacaggctttaagaaatcattaaaaatgatatgaaaaagaacaaagttcagaaactgatcatagaggacaggataaaatgtagaagaaagacaaaagaaagcctacatttatgtaatttgtgtccttcaataagacaacaacataacaagtgaattaggaaaagtcctcaaacctatgacaggagaaaaatttttctgatacattaaaacaaacaaggccgggcatgatggctcatgcttgtaatcccagcactttgtgaggccgaggtgggcagatcatctgaggtcaggagttcgagactagcctggccaacatggcgaaaacccatctctactaaaaatacaaaaaattagcggggtgtggtggtgcatgcctgtaatcccagctacttgggaggctgaggcaagagaatcacttgaaccggaaggtggaggttgtagtgagccgagattgtgccattgcactccagcctgggtgacaagagcaagacttcttataaaaaaaaaatggaatttagaggcccaaacaatatcaagaaatgattcaaaatggaattatccatggcaagttatcccttgctatggtctgaatgtttgtatcttcccaaaatgtatatgttgaaatcctaacccccaagattatgattaagaggttgggcctttggtgggttgggggtgagaagggcatgattaggattagcattcttataaaagagactccagagagctagctagtctcttccaacacaggaggacaaagtaaaaaggtgccgtctgtgaggcgtgggtcctcaacagacacctcatcagacacaatgtcagctccttgattttgtactcccatgacttcagaactgtgagaaataaacttgtgtataatcacccagtatgaggtatttagttatacctcatgaactaagcccaaatgaacgaagacacccctcaagaaagaaaagtcttgaatctcaaggattaaaacaaaggaaagctaaagaaaacaaaacaaaacaaaaaacatgtgggtatctagttagaaaaaggaagccatacagaaattgccagaaaaatcatgctagtgtcatgtttattgcagctgatcacatagctgaagacaagggagcaaagttgtaagtgaaagaaagagtggttcaagaatttgatatttagccacattgtccttcacatttggaagttacaggcaataagtagttgagccctcaggagctatggaacccatgaaccctttttgaaacaattgcctgctggtatattccagccaaccaaaagataaatcaaacagaactcaggaatggagacgctgtgggatagaaggtttgagggtgagacctaaatctatttaaatatgaaaatctgtccaagaagctgtgggagttgttgtagaagcaattctaaatttgtaaaccttgacaatggtaaaatacaaacctaattaccaaaacttggagtgtggaggagtgaagatgggtagactaccagtgttctgataattttatctttcatagcattacataaaaaattctatctactgttaaaatgtgtagtgtaaatcataattacatgaaattaatattttaggtggtttttcttaattgctagagatcttttaacaataaataccttatgatataagaaaatacttatctgcaattcagcaatttctttggtgttatttcagttccttttttattctgttaaagtcaagtgaaattaaatttagtaaattttattagaatagcaatgtagaaaaattctacttttgtgaagatacttctatctatccttttatcttttaaaatgctaaatacctctttctttttagattgtaagatatctaaaatgatagatattattttattatttctgagtagcaaaattttagccttttttttttactttctccatcatttactatttttcacttttagggaaaataacactaacttaaaaaaggcttattatttagcctctcaacatattaagttttcttcatagatgttatttttagattttttgtaaactttgacactcccaagtttattgcagcattatttattgctttcttgctgtcaccctctcttgctcttctgccttccactatgagatgatgcagcccaaaggccctcaaccagatgcaggaccctcgaccttggactttccagcctccagaactgcaagcaatacatttattttctttataaattacctagtctgtgatatgaaatcaaatcaagtgttcatcgatgaatgactaaagaaaatgtggtatatatacataacagaatgcttaaaaaagaagaaaattctgttatttttgacaacatgaatgaacctgttcagtgaataagccaggcatagaaagacaaatactgcatgatctcacttatatgtggaatctacaaaagtcaaactcatacaagtagatagtaaactggtgattaccaggggccagggggaggggctgtggtttggaaagatgtgggtcaaaggatataaaatttcagttagataggaggaataagttcaagagatcacgtgtataacatgatgactatagttaatagcaacgtattgtattttaaaaattgctaagagaggggaatttgaatgccctcaccacaaaaaatggcaagtatgtgagataattcatacattattagcccaaatgagcctttcaaaaattgaaatatgtgtacatatttcaaaatatcatgtatgtgatatatataatttttatttgttaattaaaaatagttctgtgaggctggacatggtggctcatgcctgtaatcctagcactttgagaggctgaggtgggaggatcacttgaagtgaggagtttgagaccagcctggccaacgtggtgaaaccccatctctactaaaaatacaaaattagctgggtgaatgcctgtagtcccagctgctcaggaggttgaggcaggagaattgctggaacccatgagacagaggctgcagtgaactaagatcacgccacagtactccagcctgggtgacagagactccatctcaaaaaacaaacaaacaaacaaacaaacaaacaaacagcacaaaagcttcttggttacttggaaaaaatatgaaatttcaaacgtatctatattctaagaaaaggtcttaggcagaaccactatagaagaaaaatattttaccactatctttctattattaataataacattaaaaaacatctggagtaaaactaaaactggtaataaatttaattcctaagccctgggaaacttcattgtgttttcttcctattttagttagatgtttctatgaggttacagtcttaaaatccacttttagaatcttgggaggcagaattgaggatgggatagaaggataggataataaactattatttatttggcacctttatgttctagacactgtacaaaggatattttaaaaaaattctccatttgccccaagccactttataaactctctgcacttcctacttgatgttaatttttggagtccttgaagtatttttaaattatgccttttctaagtgattaaaatgcgtaattaagagaggcagcccaaggctacaaagatgggtgttgccttgagcagtggtcatcattaaaatgaaattcaaacttcttttttttttttaatatgctgcatttcccttcttaaagcactaaaggccatttttccagtctaatttattacactttccctcactaaacaaacgtgctgaatctgtgaaatcttattagacttaaacattatctcatataatataaaaactaaagagctcagtcccaatcataccttgttactttctgtcttcattttgaaaaacataatcactaattgctttcagtttataatcagcccttatatgaggaaagtgtgagtatgcatttggaaaagagcccattcatgtcacttcctggtttcctggtggccttaaaattcgtaattgccttctctggagaagaaaattttgggacaaatgaagtaattgtaatatggatttgacatgcaataatgtaatttttaatagtatgatcaaagttcaattctggatagcatctgaattatttattccaatactattgaaaaggttgtgtttttccagctctgatttgcaaagcaaaataatcgacacattcttctatctattaataacttcatatgtaaactagttcaaccattgtggaagtcagtgtggcgattcctcagggatctagaactagaaataccatttgacccagcaatcccattactaggtacatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatatccttggtagggacatggatgaagctggaaaccatcattctcagcaaactatcgcacggacaaaaaaccaaacaccgcatgttctcactcataggtgggaattgaacaatgagaatacatggacacaggaaggggaacatcacacaccagggcctgttgtggggtcgggggaggggggagggatcgcactgggagatatacctaatgctagatgacgagttagtgggtgcagcgcaccagcatggcacatgtatacatacgtaactaacctgcacattgtgcacatgtaccctaaaacttaaagtataataataataaaaaaaaatcatctctactttcataagagaagtgattttctgaaatgacagttaactcttagtagttcaaaacaaaatttaacctccccttaatttacacatccattgcattcctagaaaattcaggtttatataaattttgagaaatatactttacaaatcacatgtaagtgcaaaaaggagtgtcaggaaaaaatgtgaaaaacttcagtgtcttatctagtgcaccttccaggctaactgattcatagggacctctgccttctatattgtctttgcaacctcttagtggtagaatatttacagtagtgcaaattattcttgttcatagaaatgcaaaggattttcatcaggtggaatgtaattgattatttccttgtggatactgaccagctttgtatctacttgtatatttattccctcatttctttttgctgattgtgtgtttgaattctcctttgaactggttgtaatatcttacttggttcctcattaattagtttattaaacatgacctttggcacgtattcatcttataattgcatgacagctgtaattttaccttttaataaagttttactttaacaagagttagtctaggcttgaaaagttgtagtttttatcttcacatacaagaatgtccacttatatatataaatcttgttgcaagcagatgaattctttgttgtgcagtactgtcctgcatattatagaattactcttcccactatatattagcagtgtccacccattactgtaggaaccaaaaagtgcccagccccgttccctcccaaccaacatgcaagatacgtacattctgtaaagaagtatcacttctatcaagaattgttcctgacaatgttgaactttacctgagctttatcagaaaatagctaccaagaacacccacgcccacccacccataacccatcccaacccttttgttttctgaaatcctctctccccttttttttgttctgggaaggaagggctaattacaaagaagcacccttcttcatatgacttaataagacctgctgtccactctttctcatgacctccgtaagacttgtgggtaactcccttgtttacctgcctctataaaatgcagtccatttctttgagacatgcctaattaatgaacagtctcccaattttaatagtctgaataaaactgtccttccttgtctgatacattttgttttttacacttctgttttatactcgaactttaccaaattatatctacatatccattcttcagtcattctttaaatcaatcaattttcaaacatttattgaacatctactatgtaccagcataaaatagtaatttaagtcaattgctagagttgcatttatggctatcttattggtattgaggcttaaagtcaaggactggaacagtaaacctggagaagagaaatttttcactaatctaatgatcattttttatagagaatcagtggaatcagtgtttaatggcttgctggaatcctgctcttttcttttttgagacagggtctcattctttcacccaggctggaatgcagtagtacaatcatggctcaatgcagcctcggcctcctgagctcgagctcgagtgatccttctgactcagtctctagagtggctggaattacggggacatactatcatgcctggctaattttaaaattatttttgtaaagacgggttctcactctgttgcccaggctggtctcaaactcctggcctcaagtgatccttccacttcggcctcccaaagtgtccggattacaggcatgagccactgtgcctggctgcaatcctactttcccccccgcccaaaactgatctttctgtatatccaagagtagaaggagaggaaaatggcattggatttagactatttgaatgtttgattcaattctgcttttactttgctcattcattcattcatttaacaaatatttattgcctgttgactttgtgtcaggaattttactagatgataaaaacagctctcattttttgagtacttggtacatgctaggcataattctaagcattgtacatattaacccaatcttcacaagaaccctatgaataagtactattatcatttcatagatggaaaactgaggcacagagaaaggttaagtaaattgcccaaggttataagttgttgggctggggtttgaacacaaatcagggcacacaatcagactccagaatttacttcactacactactgaggctagggtggtgaacacaacagacttagcctttgtcttcagggaactttgagtcttggagcattatgttatttaattgaaagcatgccaagtgctgctaaagaggacacatagggtactttgggaggcataaaagggagacctaacaactctcattagctgatggatctgcatttgtgaaatgaggctgataagatctgccatgtctgctttaggaatgtggtgaggagcaaagccaaatatattaaaaaagcaaaaattatcaagtgcagttatctgtattttgaagaaccacaagctgtgatcatttgtagaaatcaaacatgtgaatgttagagatgcagcctggcttcaagatagtcccttcagagaatgaccttaaataattttgactgtgaactgcaaagatcaaagcaacaagagctgtttttaagataatgcaaacattttagtgcaaatttggaaaattttttactctataaaaggctttcataagaatattacaaaaacactgaaggtatttttaatgaggactttctttctttctttctctctctttctttctctctcttctttctttctctttcttttcttttctttctttccctctttctttccctttctttctttctttctttctttctttctttctttctttctttctttctttctttctttcttttctttctttccttccttccttccttccttccttgcttccttccttccttccttccttctttcttctttctttctttctttttcttttctttttttttttttgagatgaagtttcgcccaggctggaatgcaatggcgtgatcttggctcactgcaacctctgcctcccaggttcaagcgattctcctacctcagcctcccgagtagctgggattacaatctgcaaccatgcctggctaatttttacatttttggtagagatggggtgcctgcaaccatgcctggctaatttttatatttttagtagagatggggtttcaccatgttggccaggctggtctcaaactcctgacctctggtgatctgcctgccttggcctcctaaagtgctgggactgcaggcatgagccaccacacctggccgggattttcttaattgcaacaaatattcaacagtttaaatgaaaataaaggttgatttaaaagtcaaagataaattttagagaacattcagaggcttggtttttatgcagtgttgtttttctatcagtaagtgaaagaaatgcagtataagtaggcttttagaagaagaatgattttcttttgggaaagtaggaagttataaaatcacaagtgaatcagaactaaaatggatgtatctgttgacttggatgtgcctgtgccaggaacatatatgctccctgaaggcagagcctgggtctacatcttggtagccccttacacagagtactttgcaacatacccagtaatgatttgtgtttggtctgtgaatgagaagctcacagtgaaggatcagtcagtggtgctcagtcactggcatgtgccaggcttctagagcaggcagagaagatgtgttataaagcagatatggggtccggtcatgtcccagacatacctggaacaaagtcagttctgatcaggacatatctctgatgtcctgaaaaaattaatgtagtttagtttgtctccggaaaaaattgtgaaagattatgaaatgggtttaaaagattactaggtgtctttccaatggaatgttgagtatcacctagcatacctttggcagttatctaattttagacaattctgtgctttttgttgtctctcactgagctattttacaactccacaaactataaaaagctaatggtaatgcaaataattcaatgcaagtgaattttgtctaatggagatgccatcgattttccttctgtgaaagagacaatttcaacattacattttattgctgggtggattttaaccagttttgcatgaatttgcaaatttgtatcaccattcctgattgcttatatcagaagttggcaaactttttctgacaagggccaaacgataaatattttaggctgtatagaccatgtgctctctattgcaactactcaactatgctgctgtagctctgaagtagccataggctatacgtaagtgaatgggcatggctacattccaataaaagttcatttatgagcactgaaatggaattaaatataattttcatatgtcaaaaaatattataatacttttgattttttggaaccactgagaaaagtaaaaagcatgcctagcttgcgggctgtacaaacggtaggttggatttggttttcagggctatattgtgctggttcctgggttatgtttggtctgttctttggattatttttggaaccaatgataacatcttattggtttcctcattaactaatgaggtaaataaaatcttcaatatgtgttcattttacatttaaatgagggtcattattttaccccttaaaagttatttcttaacatttgccaaaggtagttaatggaattcagttgaggtatttggagaccgtgaatcaaaaggctgagagaggctgggcacggtggctcacacctgtaatcccagcactttgggagaccaaggcaggccactttgagcttaggagtttaagaccagcctgagcaaaatggtgaaaccacgtctctaccaaaaatacaacaattagccagatgtggtggcgcatgcctgtaatcccagctacttgggaggctgaggcagaagaatcatttgaacccagaagcggaggttgcagtgagctgacattgtgccactgcactccagcctgggcgacagagcgagactcttgtttcaaaaatgaaaaaacaaaaccagcaaaaggctgagagattctttgtcctgagtgaatattagaatccttggccaggtgcggtgtctcatgcctgtaatcccagcactttgggaggctgaggcgggcggatcacaaggtcaggagatcaagaccatcctggccaacacggtgaaacctcgtctctactaaaaaatacaaagaactagccgggcgtggtggcaggcacctgcaatcccagctactcaggaggctgaggcatgagaatggcatgaacccagaaggaggagcttgcagtgaactgagattgtgccactgcactccagtctggcagacagtaagattccgtcttaaaaaaaaaaaaaaaagaatcctgaggagtttcagaatgtcatcaattaaagtaggacctcaggagagggccttgaatgggtgtgtttgaaaaaccttctaggtgattctaatgtgtagtcatgattgaataccggtaaatttgaggaagtggtatttaaaaaaatttctttgtatattgaaggacagctgttactttaagatataaaacatacaataaataatagctaggacatctgtgataatatcaataatgtagttttttaagtttaaagcatgatcgaaagatccaattatataaatgagaagactataaattgctttaattaatcttttcttacagtctttctaattgctaggaacttggcagattaagattgctgctaaagacttaagccgccaggcgcggtggctcacgcctgtaatcccagcactttaggaggctgaggcgggcagatcaattgagattgggagttcgcaaccagcctgactgatatggagaaaccccgtttctactaaaaatacaaaattagccgggcctggtggtgcacacctgtaatcccagctactcgggaggctgaggcaggagaatcgcttgaacccaggaggcagaagttgtggtgagccaagattgcaccattgcactccagcctgggcaacaagagtgaaactctgcctcaaaaaaaaaaaaaacaaaaaaaaacccccaaaaaacaagcatacattttatttatttaaacctcatttcatttcataaagaactcgaggtggactaaagacctatcagtgctaacaacaaactttgaagtgttattattttccattttctcagagtggtttatggatgggcagacttggagagtcttttctaagcaggaactctaaattatctgaagtgacttcatggtacactcattaaatgtgataccttagctacaaaacaccaagtaatttcactctttgaaaaataataaaattttataccttaaaaagtgcttccatatattttatccattattattatttcttagagatggggtcttgctttgttgcccagactgaagtgcagtcagtgacacaatcatagctcactgcagtctccaactcctgtactcaagcagtcctcccgccttagctttcagggtagctgggattatagggggagctatggtatccattatgatccccaaaggttttagtaaatattataaatatttacattatatacaaatttatatttcccacaataaaccaaaacttttcccattatttgattcaatgtcaattacttaatactcgaaaacctttctttggctttttgtcttggttctccctcttctgctttgtgtgttgtatgtttggctccatttcacgctgcacctttgctgcactagagcatctttgtacccaagatcatgcatttttgtgttttctctatctttgcttttaataagttccagcacactcttttgttgttgacgtattttgctattgttttcttttctatatgctctttatttcatttgtatctattaatgcccctctgagaaaggcaaggtaggcattgttagcccatttgcagatgaagcatctaaagctcagaaaaatgaaaactcctactcaaaactaactatggcaggttcagtactaaagttcagtttccttaacataccccttttatttccacaaaagagccaaaagctgttgttttcctctttgccaaggcttcattcattcatttgggtatggattcttatatttgttaaacaaaaattattgaatatctactattttccatgtacttgcaagtcactggggcaataacaataaataagataaatatattcccttcctcaggtgattacagtagttaaaaatactgcaacaactccaatttattgagcacgtttggtgtacattatacctaaatgtcacagccaatttataaggtattattatccccggtctgcagatagacaaactgtggcatagaaagataaacacttttttggggggtggggaggacaaggtctctgtctgttgcctaggctggaatgcggtgacatgaacatgactcactgaagcctccacctcctcgggctcaggtaattctcccaccccagcctcccaggtaggtgtgactacaggtgtgtgccaccatacctacctattttttttttctactttttgtacagacagggtttcaccctgttgcccaggctggtctcaaactcctgggctcaaggaatctgcccacttcagcctcccaaagtgctgggattacaggcgtgagccactgcaccccaccaagattaataaactcttaatatagtatcagtgatgaggtcctcaataaggctgacattggagcaatatactcatagtctcaaaagacagttggtagcttggcaaggtgctacagccaatatatgttgtgtagaggtggatggaaaaggggtgtggagaggggacatccaatgaagtggcagtgctgaacctttgtgaattaatgccacttgttgcacaggacaatggccctgctgatcaggggcatgtggatttcctaacacattatatgaaagaaaggacagtcttctattgtcaataatggatctcaaaaccactgttatctcatttcccaagtggtataactgtcttgaagtgctgagaaaggcaggtctactaacaatctccttctcaccccagtttggttagggagagtccagaagctgatattttagtaaacgccaagcaaggagtccagatattcatttttgcaatgaaaacacagactgtagaagttttgagttaaggaaaattacatcagggatattttaatgatagcaattctgccaatttagcaaaagcattgtttatattcctcataaaatttcacaacaaaagagtaactgtatttattaacaatgaactttgtctcagaagagccactcaccctgttaaaccacaggcctttgtgaggctaatgctgaaattaataaggcaaatggagaaattgaaagactgaagagtcaaagtatttgaaataagaaaaagcagattgaaaaaaggatgagaaatgaaaatctgattccacactgtattgtattgggggattagctactcgggtaccacctgaagagtaggtctgatcaactatgcctaatatgcttcaagcaggatcgtttcggacatgatcacacacttacggaatggtggatatttaaaaagatgtgccacaaaatgtgaaaatttgaaggagaaattggatttatgaatatgaaatagagggcagtatacattaggtatatataaaagataatccatcctgatttactgtaaattaaactttatgaaacatttttctgaaaagacttaaacatgaggtttaaaggtatatcaggaaaggaaaatggcgtgtgcaaacacatggaagacagtaggatattaataatatacaggtgtgatagttaacattgtcaacttgactggattgaaggatgcaaagcatcgttcctgggtgtatctgtgagggtgttgccaaaggagattaacatttgagtcagtgggctgggaaaggcagacccacactcaatctgggtgggcaccatccaaaaactgccagcgtggctaggataaagcaggcagaagaaggtgggagaagctgacttgctgaggcttctagccttcatctgtctcctgtgctgggtgctttctgcccttaaacatcagactccaagttcttcagcttttggactcttggacttgggctctcaggcctttggccacagactgaaggctgaactgttggcttccctacttttgaggttttggaactcgggctgtcttccttgctcctcaacttgcagatggcctattgtgggacttcaatttgcgatcatgtgagccaattctccttaataaactccctttcatatatgcatatatcctattagttctgtccctctagagaaccctgtgtgttggaaatgcaaatttgtcctgactccagacctactaagtcagtaagactgaaggtaaggcccagaagtcagtgttttaagaagccctctgggggattctgattcatggaagagtttgagaacactggtagaggaaaggttccacaatttgtcatggggaaatttagtgatgaagcactgcgatgcagccctggtcctgatctgcccctgtggaggatatactacagcatttttcttctgccctcaagcctcttacatcctaatgatccacaggtgtcttttcattatagatagtctgctggtaaagtcttaagtcaagaagaaccacacaaacattctatgcttaataccaaaatctagtaaagtccataaagaggaaatgctgctttagagttaatttaattaaagggaagaaaattcaactttagtcagtagctttgaactccgatgagtaaaaaatccataatgtgatcacattgaagttcctttagaggcgttcttccatttgacatttaaaatgcattttacatcaaggagtgtcatttgggaaaaataaatgactttttctgctgtatagctgaagaacttgttaaaaagcaaatacatgtgaaaaatcatgtttgaatttccaggtgttgtcagtctaagctagtcaacatctttctttgcttagatgttaatggaatataaatccctcataaaaagagaactggtaagatagtttttagtgcttttgccaagttacagtcatagaagacatttgtatttcagccacttcaaataatcacttcctgcgtcaaagcattctgtaagttggttctgtaaatacatgttttgaagatgttgctacagcacatcacattctatcagctagagggaattgttgagtgcaaagaaggaaagaatgcaagagactaattctaaatgtctgtttttaaaagatagtttagaagcatcaactttttgggggacactttagtagttccagaaggagctatttcaaacccaaatttctaagtattactcatcctcaagtgatttacaaaaggtacttgagctgcctttagtgcattacatgcctgattaatttcaggcccttggaacagacaattctatttaaaatatgatatttcttccacttttattttacagaagattttgagaaattttcaggattaaggaaaacaaactgtatttgaagaaatcatagcctaatcatatattaacattaagccattaaaaattcagctttataggatatattgtaggatgaaggtggtggtgggggaagaatttatagcattctgcaaagcctgaatgctgaggtcatgtgaacgttaagaagaaaatctgaataattcaggcaacagactgttatttaccatctgaataaagaaaatgtattccactttgggaggccaaggtgggtggatcacaaggtcaggagttcgagaccagcctggccagcatagtgaaactctgtctctactaaaagtgcaaaaattagccaggcatggtggcacatgtctgtaatcccagctactcaggaggctgaggtaggagaattgcttgacccgggaggcggaggttgcagtgagctgagatcgtgcctgggtgacagagcgagactctatcttaaaaaaaaaatgtgtatatctatctatctatctatctatatatctatatagatatatatagatatatatatgtgtgtgtatatatatatgtgtgtgtatatatatatgtgtgtgtatatatatattcaaacaactctcctcacctgcaacaaagaatgcccaaataatgactatttttctgagcaaatcacctctttttacttttaatgtaacattttaactatggtttgaagagaaaatgttacattgaggaggttcacattttgtagctatgattctgcattaaccatagcactttatatagtttctactgtcaccaaaagaaagggtgaggaacaccctcatctttaaaatctagtgacataatcattatcattaacatccattcatctgctatcatccatccctccatccatttagtcagtcatcccttcatctagagaatgtccctggggcagaggaaaacaagaaaatgggtaagagttagtgtaaaaagatagagtgaaattgctgcaattcaagtgcagctaaaatggataactacatccagaagatgtcagcactaaatgggaactatctcaaatgattatgcagtttagtactttattgaaactgatagatttgggtgcacaaggagatatatccctggtgcacccaaatctatcaatttcaataaaatactaagcaatataatgaataagcaatcctatagcaactttagaattaatacagagggagagagccttctcttttaattaagtgcagctaataaagggacagttttgaagtacaatgacctgtgtatttgtgctatagtaatcaaaatagcatggtactggcataaaaacagacatacagaccagtggaatagaatagagagcccagaaataaaatgcacacatttaaggccaattgatttttgacaaggttgccaagaacacagaatggggaaaggacagtctcttcaataaatggtttgggacaactggctatccatctgcagaagaatgaaattagaccctcatctcacaccatatacaaaaatcaactcaaaatggattaaagacttaaatgtaaaacctgaaactctaaatctaccagaagaacacaagggagaaaatctccatgaaaatggtctgggcaatgatttttttggatacaactctaaaagcacaggcagcaaaagtgaaaatagacaaacaggattacataaactaaaaaccttcagcacagcaaaggaaacagagtgaagataaacctaagaaatgggagaaaatattttaaaccatatatctgaaaggcaattaatatttaaaatatataagaaactgaaaaaactcaatggcaaaaaagcaaataacctgactaaaaaatggcaaagcacacaaacagatattgctcaaaagaagacacccaaatggccaacaggtatatgaagaactgctcaacgtcattaatcagcagggaaatgcaaattaaaaccacaacgagatattacctcatacctcttagaatggctattatcaaaaagacaaagggtaaaaagtgctggtgagatgcggagaaaggggaacatttgcacattgttcttaggaatgtaaattagtgtaaccattaagtaaagcagtacagaagttccacaaaaaattaaaaatagaactactatgttattcagcaatcccactagtgggtatatatacaaagcaaatacaatcaatatgttgaaaagatatttgcactcccatgttctttgtagcattattaataaaagccaagatatggaatcaagctaagtgtccattaaaacaaatgaatggataaacaaaattgtccacacaatgaaaagctattcagtcttaaaaaagaagaaaatgctaccatttgtaacaacatggatgaacttgaaggacattatgttaagggaaataagccgggcacagaaagacaaataccatatgatctgacttacactgtatgaggaatttttaaaaagttgaattcttacaagtagagagtgttcttactgcaaataaatgataagtatgcaaaataatgcatatgttaattagcttgattttggtattacagaatgtgtacatatttcaaaatatcatttttgatatagtttggatatttatcccctccaaatcttatgttgaaatgtgaatccccagtgttggagttggggtctggagaaggtgtttggatcatggggacagatccttcacgaatggcttagtgccatccccttggctaggattgagttcttgctctggtagttcatgtgagatctagttgtttaaaagagcatggcaacttcccctacccttgctcccactcttgccatgtgacatgcttgctcccacctcatcttccaccatgattacaagcttccctagaccctcaccagaagccaagccaatgttggtgccatgtttgtacagcctgcagaacggcaagccaatttaatctcttttctttataaataacccagcttcaggtatttctttatagtaatgcaagaacagcctaacacaatgttgcacacaataaatatatacaatttttgtcatttaaatataaacaaataaagataaatttctttttttgtaaacaatagtttgagccatttgaaattcctgatatttgtgattttggtctggaatatggcaacctaatgtctgaagtggttttgtttttctggttagattctgaatgatatggatcaactaaggaagggaaccttcccaccaaaaagggactttaaaatgctgcccctggcagagaggatgcagtaggcagagaacaagggtgtcccagacaccacatttgtatggttaaagaggcagagaaaggcagaactgtctggctagggaatacacacaggtagccagcattttccaggtgggaccagatcagagatcataactttaaacagattggctgagtcattagagaagaaaaaaaatagaagccaattgcagaattctgctaaaaagtatttatatttcaatcaatacatgaaaaaaattaataaatttctcatctaagagaatgctttagtgacttaaaacaaatccttttgtcatcctcataaatactctgtatctattgcttatgttgttttatggactatttcaatcctactattccattatctggctccaggctggacaaagcttggagagcagttcctttataggacctggttttagtgagacttccttcggtttgtgctgagccatactgaattctgaggcaaaagggaaactgtgcacctctatatgcacttatcaaaatattctctcatattttgaaccaaaaagaaaaagttaataaaagtgctaatgcattaataaaagaaaacataacaatatatgaagtctcacattgcctgatctgttggtgcccatgtcaacccttataaacccacctgaagagggatgaaagagcctcacaggccaggaaccatgggcagattggaaatgactgctcctgtcacaaaatagtgcaataaaacaaacaacagcctatccttatttacaattttgacatgtgttcatcatggtaaatgatgaaccatgtaccatgggttttttttggtactttggtactttaatttttaaaaatattacatttacatattatcttgagtcctgaggttttggctccttttaaattttgcacctgacactagtgccttacttgcttcactctaatcccagccctacttgggtggtgcacgttacacacaaggtgtgttgagattaggtgaagaggaagaagaaagagagtcaggcaagtctgcataggaattcatgaaaaagtattctaagaattgaaaaaaaaatcccactatggactgaaggtcttaataactattataataaagattgaggggagaaaaacagatacatcaaatcatgggcaaattggttttgaattgatggaggacactgaaggctcagatctagaaggggatctgcagaaagatactttattgctgagcatgaatttgtgagaaaaatttgaaattgggaaaatggccgtataggagaatgatgctggtaatataacttgtccttatcaagcaaagtggttatcaataatgaaggctgaaatatatcattactggaatattaccataaactgcataaagtgtcaaattggatctcttgcccagcctgcataggagaaagcagaatatgttaacaatgaggaaaaaaaaaatgagactccctaggggagaaatgaaatgagaaatacattagtttgtatgtgaaggctgcaaacttaaaagcaaaaagaaaacaaataaaacaggcagtcaaaccaacaaaatctcagatgattctaatgaaacaggagaattttgtacctttcatatataatgaaacaatatatcaaattgcaccataaatgagacttttaacttataattacatctcaggaaacttttctcacaatcagttttttcttttgtttttagcctagaatgaagggcactcacagttgagtcatgccaagcagcaggttccattttccatattgaatagggcagttaaggcctaggtattgcagtactagtttcctgtgtttccttggcgaggcctaaattcctctttgcctaagaaagaaaaaacctcactgggaggggtgttcagtgaaaagattgacctgagctgaaattcagccaaggcctcctacgactttttatcctctgtcattgcccaggaagatgggaaggatcgttgaacttcagtctgacacacagtctttttttttttttttaattatactttaagttctagggtacatgtgcacaacgcgcaggtttgttacatatgtatatatgtgccatggtggtgtgctgcaccccttaactcgtcatttacattaggtatatctactaatgctgtccctccccctcccccctgcccccaccccaccacaggctccggtgtgtgatgttccccaccctgtgtctaggtgttctcattgttcaattcccaccgatgagtgagaacatgcggtgtttggttttctgtccttggcgatagtttgctcagaatgatggtttctagctttatccatgtccctacaaaggacatgaactcatcactttttttttttttttgagacagggtctcactctgttacccaggctggagtgcagtggtgcgatctccgctcactgcaaactccgcctcccgggttcacgccattctcctgcctcagcctcccgagtagccgggactgcaggcgcccaccacaaggcccgactaatttttttttgtaattttactagagaaagggtttcaccatattagccaggatggtttcgatctcctgacctcgtgatccacccacctcggcctcccaaagtgctgggattacaggcgtgagccaccgcacctggccaaactcatccttttttatggctgcatagtattccatggtgtatacgtgccacattttcttaatccagtctatcattgatggacatttggattggttgcaagtctttgctattgtgaatagtgccacgataaacatatgtgtgcatgtgtctttatagcagcatgatttataatcctttgggtatatacctactaatgggatggctgggtcaaatggtatttctagttctagatccttgaggaatcaccacactgtcttccacaatggttgaactagtttatagtcccaccaacagtgtaaaagcattcctatttctccacatcctctccagcacctgttgttttctgacttcttaatgatcgccattctaactggtgtgagatgatatctcattgttgctttgatttgcatttctctgatggccagtgatgatgagcattttttcatgtgtctgttggctgcataaatgtcttctcctgagaagtgtctgttcatatcgtttgcctactttttgatggggttgtttgattttttcttgtaaatttgtttaagttttttgtagattctagatattagccctttggtgttctcactcttatttctatgggataccactgaaaatattcagccccttggagcaatgtggaaatcatgagtgaaacttataagaaagatagcagattacaggtacacagcacaatagcagtctggctttgtccaacttaaaagatgaacctgcttcctttaactagttctgcttgcctcctttccctgaactagcaggtcctctttcccacctcaggttcttcatgaaacattactcttttaaatcgcttctcccagggaaatgcccaagttgcagttccagtttcctttccaggaagccactgtgtccccagcattgatgtttgtgtcttttatggatgtcttgctcagtacccctcactactggtctacctccaaggtcttaagccttgttcaaccctcttctgttgcccttcacatccaatgattgaaataaatgtttcccaccattaaaaggcccttttagcgatttcagttttgttctatctcacttttccttcctctggtcttcttcctccttaccactgccagttctctcagctgtaacatttctggcattttgtttttcctttttagaaacaaggtctcacactgttgcccaggctggagtgcaatggcatgatcatagctcactgcattctccaactcctgggctcaagcgatcctcctgcctcagccccccgagtagtaattacaggcatgtgccactgtgcctggctaatttttgtttctcgaatactgtacagcatcatgtacaactaaatctatttaaatttaacacacataagatgcttaaaacaaaaagggaggcacataatttgcttcccttgagatactctggctttccaagttgaagaaatttactgaaagatcattcaagaatgtcccagatataaagtctgacaaaattattgcaaactctcatgaaaagcccttaaatcaatggcaaacttgctatcccatagaatgaagattggtttgaggatctaaagagtatattttcttaaactctaagcatatgcacatcttggccgggtatggtggctcacacctgtaatcccagccctttgggagactgaggtgggcagatcacttgaggccaggagtttgagaccagcctggccaacatggtgaaaccctgtctctgctaaaaatacaaaaatgagctgggtgtggtggcgtgtgcctgtaatcccagctactaaggaggctcaggcaggagaatctcttgaacccatgaggtggaggctgcagtgagctgagatcgctccactgtactccagcctgggtgccatagcgagacttggtctcaataataaaataaaataaaataattatatgtagatcttgtattcttagcacacacccaaaacaggtaactatgtgaagagatagaatgttaattagcttgactgtagtaataagtttactatatatatgtatattaatgcattatgttgttaccttaaatatatacgatttatgaaataaaccaaaaaccaataaacatatggtcattcaaagcaaataaacaaacttacaaaaacaaatagatgtattcatttacttctctgaaagtgctttcatttgtttcatccctatcaatgaagtatggcgagttttggaaatgctgactttagatgatatttagtaagcatattattacaattctgtggattagcacttgttccagcatttcaaattgcataaagctcctgctaaaacacattatttggcaaggattttacttaacctgacaatacagagaacgggccaactagcaatgaagagttatttttctatctcattcattgccgtggaagaaaaatagaagaagaagctgaaaatcctcttatcttttggtttactcaatagtcaaaatgttaaattccctctgagattgatgggacctatttaaagatgaaactctcattttcccaggccaggcatggtggttcatgtctataatccccacattttgggaggctgaggcaggaggattgcttgagcccaggagtttgggaacagcctgagcaacattaggagaccccacctctacacacacacacacacacacacacacacacacatacacaatctcattttcctgccttttacatatttaaggtcagatggatgatgtgacccgtcactttgagcagaagtgcataacaattccagaaggttgcttagttgcctgtgtagactcccctcctgtaaactgacaactgcatgcaacttgcaatctactgacaccttcacaaatgctgtttcactttcttaaaatgtaaaaactgaaggagattattcacaggagtttctatccatgccccccaatccattacagatattctttttatttctaccttaggacttcgaagatgtcactttccctcaaagcaagaactacttctctgattaaaatgctgatcacattgtatacctgtactaatgcaattccctacaatggaacccaaggtgacatttcttcctcatagtctcacaggtggctttgtctgtggttggttattctctggcctcaaaccatttgcatgaaggatgcttctcactttctgtaaaaatggacacggtggttcacgcctataatcccaggactttgggaggccgaggtgggcagatcatgaggtcaggagattgagactatcctggtaacacagtgaaaccccatctctactagaaatacaaaaatttagttgggcatggtggcacactcctgcagtcccagctactcaggaggctgaggcaagagaatcgcttgaacccgggaggcggaggttgcagtgagccaagattgcaccactgcattccagcctgggtgacagagcaagactctgccttggaaataaaaaaaaaaaaaggcaaaagaggcagacacacttgacttctcaccctaactgtgatgttacctcatttgagtccagataagggaacatgatacagaaacccttgcagctatgaaaacaccatgtctcgatcacttgagaagtgattaatgggagaatggaaaattgtggaactggttagatgccactttgaccacctaacctatgccagcccccttctgaacaaccttctctctattctctttccattattgagtgcatatttcctgtcctctcttcttctgctacgagctccttccagttcctcaagaatggacacctattaccatcaatgacaaacacattcttttatattataattaagtgcatcctgtcaggcaaacctgctttctctttgcaccagacagattgttgaattgtgacttgattttgtctgttccagttctgtctttgcatatatggtactgacataacgtataaggcaccttgtttttttccgactgtgctgagctcattcaagacatactgtgatgattaatttgatgtgtcaacttggctagggcacagtacccagatattattgtatatgtttctgtgaaggtattttaaaagatgagattaacatttaaatcagtggactctgagtaaagcagattaccctacatagtgtgagtgggcctcatccaattagctaaaggcctcaataggaaaaagactgatgtctgcagaggaaaagggaattctgccagcagatggccttcggaccatcgactgcaacaagaactgcatcaaagtgcaactttccctggttttccagcctgccacctgcaggctttgaactttcagattttgaacttgccagcctccacaataatatgagccagctccttaaataaatctctctctccctctctctctttctcattgtgttccattccagcatgaaattcaacagcaggtgttcaactccagcatgaaaagaaatttggtgtcttgtgtataacatagatgaccatgggggtgtttcatttcatggtgatccagactctttgacctatccttctccatccaccattatccaaagtagtccctggtttattttactttttaaataaaatatctcttgtatcatcttccttccttcctttgtatccatgcccccaaagcttcacaccaaatacagaacaaaatcctccactttcctacttttcacctaccaagctgtaggcagacaaactttccctaagccccattttcattaccaccttcattttctgaaagcccagaacaaactcctttttctgacttttaaggccctgcttgatatatatccttcccctacttatttctcagcattcttccctgaaactcactccagtctctgcagctttgcttatgaaacttattatacttggagggtcatctcctttctcttcacgaaagtcctttatacccttctcaacccaagcaaagctccatgagtgctttctttgatatctctgcttctcactgtttttctcctcttctgaactaaaataattatgtacctctgtttagtctatgtaaagttaaagtagtatttatattttatacataacatcttacattgttcactatttcatatgtgtaggtcttgaataaaggaaatagatgggaagtgtactgaggtctcttgtgaacttaatcttccttttcagagccagactttgtgcttgttgaacaaagaatagtgaatgtggaaattctggtgttgttaattagttattaacaactattagttgttaatagttcttaatatgaaatttcaatttacccccaaatttaggcctcggaaacatcacagacatatgtaacggggcattggtatttaaattgggattacatctttgacagctgtcgtaacagaataccatagatcaatgactcaaacaatggatatttatttctcacaactcaggaggccatgaagtccaagatcaaggcaccagaaaaaccagtgtctagtgaggtcactcttcttagtttgtaggcagctgtcctctagttgtatccccacatggcggaaaaggagagagagaaagagagagagaaagggagagaaagggagagagagagaaagaaagagagagagagaaagggagagagaaatcatccctcttttgtctcttcttataagggctcggccctcatgacctaattacatcccaaaggctcttacctttgacctaattaccttccaaataccatcacagtggggatttaggtctttcttccttaagtcttacagtaacctttctcaaaaaacgttctcaattttccacacatgataactgagtgatatatttttaagatttaagatttttgttaaaatagtcacagtggcttaattttgaaaagcatttaaaagtttattcaagcagggctgttctccttgtcattagagctgtttactactgagggatgatcagagaatagcgctcaataggtttgtcctaactgtttcagtgccagcaagtgtgaaaggaaacagaaccaagccagcttccaggtagtctgtgaggggctgcagagctctgtggcatggtgcaagcctctcctcctggcctgagctgctgtgtgctggttttctggcactggtgaggtgctagcacttcagctagagttagcaggatacaaataccactcctgcagtgtgttagggtccacttgaagaaacaagaaggggtagaatacagatgctaaatccaaagtgaaaaatatgccaaacacccaaaactgaaattgggaaacaaaacaaaacaaaagtcactgggccgttggaatgaaacctctaaatcaggatgtgtaggaggacaaagcatgcatagctgcctctagctcaatagatttaaagtaatctgggtgacagtttcctaaagaaggtctgagatagaaatcttgaatccctagaatcattccatttacctatttatctatttcctgtgtttatcaacctctgcttttttctgtaaaatactggatagttcaatgaaaagtactgctcataatggatactgtattagtctgttctcatactgctcataaagacatatctgaggctgggtaatttataaaggaaagaggtttaatggactcacagttccatcatggcagaaggcaaggaggagcatgtcacgtcttacatggatgacagcaggcatagagagagagcttgggcaggggaactcctttttataaaaccatcagagtttgtgagatttattcactatcacagaacagcacgggaaagacccacccccatgattcaattacctctgggtgggtccctcccatgacacatgggaattgtgggagccacaattcaatatgagatttgggtggggatacagcaaaaccatataaaccatattagatacttaccagtcttttcctttgtatggatgtgagctaacaaaaaaggatggaagcaaaaaactgaccctgtcaaagacctgagaactagcaaaggctagcatctcctaggatgtgctcactaaccactgactaaaaagaggtaagaggagggcaatatttgaacacctgagaggcacggctaaaaccagttcactgacctggtacagaaactgcagacacatatattaccactttctgttaatgagcctgtacagacattattcatcaatcaggccagcctttcttgctgaatccattcatggattcagaatttatgttggttttaatttttaaataccaataaaatcaattcacttctattcatctctccttccatcaccaatgtcctagctatcaacatttctagactgaattaccgttaagactcttctaattgattgcttgcatttgctgacctccagccagttctccacaatatagtcagaaggatctatttaaacctaaatttgaggtgtcattgtttttcttaaaaccttttagtgattctttgcagggcttataaagctctatgcttctagagcttcaccattttctctccaaattcctgtgctctagctacgatggctttcttcactttccttcaatgtgccacaccactgccagcttcagctactcccctctgctgaaaatacccttcaccacccctcctcagtttttattttttgccttcttgtcgttcagatctcagtttaaacattgtttccttaagagagtcaattggctacatagaatttataataaggaatactgtgtattttattatttgtaaattgtgttacatatcctctgtatcagcaaaattttataataaacttctctatgcatatatattccacattgtttttagattggctgttaagcatttactagcacatcactgacgagcttcagtggtcacggggtaattggttgtattggtttccttcttttctgcacttcacttctccattgccttactgaatttactggtatcatccctgaaataaactccttgtaattgaatccttgtttcggggtctgttttgggggaacccaaatcatgacaggcataaagtatatctgccttgttcaccaacttatcccctgtgcctaataagcaccacataaatatttgttgaatgaataaatgaatgatcacagcatcccagagagccactggtaattaaggtaattcattgaagtcctttttactctgtggtgtcctggaacataaagagtttgcttgaatctgtggcctacagtgcccctggaattcacctgtgatggaacggtttcccatctaaagatgtgcagagaatctacatgggacccctggggaaatcaacgtgcactagtggcatatggggcaaagccagagaatggacttacatgatataagggaggtgagggagagaactctcctgagaaagaaaaaggagaaacaatggcttcaaggtgagataaagtcaccaagagttactgaaaactgcttggtacacactattatctgaatatgtacctgtattcatgtgaaggagtatcagcatggaaggaagagaaagatgcaatttctaactacaaccaccgttaactgcttttatccccgcataagaggcaggatttatcttagaaacaggtgatctctgttcagtataatgttggaaagagattaaacagatcactactcttcataaaaactggactgtaacttgggaaaggagttgggagcagcctggaaaaagggtggtcatgaggagggctttgagggaatgagggcttaacatcatgatgcaacagggaatgaccaagatagcactggctagggagaactttccagcaaaggatgtgactgacatgtcaagacaggacagctatgtaataacttgaggttggtgactgggtggtgctgcactatggcttcctcctgtccttatcacctcaacccacaataaagttgatctactcatagaaatatcatctctgaatggtgatgaggaataattatggaaatctagactgttcacctccagaatgaagagggagtgaaagacgggaacagattcaaaaaggcagatggaataatatctcttcactagagggcagaaagtcagaaaaattttcttgggaattgccaaaatttgagggagggtactgaatttcccaaactgaaattctgaaggacatattaagtcacctgacatttctaggctaaatctagaagtaccaaatttgagagttgaaagaactttgattcacttttcatcttttcctgggcatcataaagattgtatctagggatgaggtgaaattggaagtcttagttgaatggccattctttcttttctttagatgacatttttcttgtagacctctctgaataatttttataagcaataaacttctgttaggaaaaccttgctccctggtaagaaagaacaggcaaaaatattgaccactgttgcctaaactcagttcggctgagttgttcttaaaactctttcaagtcttacttttaccctttcatcctaaagtggagcaatttaaataacatctttgccaagccttcctgattgagttaggaagtgtacatttttgggctgggagagaggctaactgcaaatttctttccctgcatacctacgtttaatcaatgtggtagtgggtacatcacatgaggtggagctgattaaatttcttcagcactcttattttgatgaaagtatttaccaataagggacattgccttacacgtgaggctgtctgaggagctgcgtgggtaccagcacagggagggcacatatcctccaggcatttactgtctgagatgatagtactgataggcccaacaaggtcgacagcagtgacaaatagttatgaaactgcaattatatgccagccactgtgcttagcacaggaattttaaaaaaaggaataagaacatatctttttacttcaggaattcagtcttggagggattccagacatgcatagcaatactttcaattctgtattgaattgaaatgtttgatggcagtctagatgactttttgctgtggaatcagggaacagatggtaattataaatccttttcagggagccgttggggaaaacttcacagagaaagtagcatgttagctgaaactaaaatatgagttggaggtcatcaagctgcaagaatggaagactattacaggcacaagaaaaaataactgtgtaaaggcacaagaacgtgacaatgaatgacaaattttggcaatggtgagtggtgtgaccagaactgatggccaaatactgcttctagaacattgatttggctctaagctttttactagacagattaaaaagggaactagattattccaataaagtctgactttcatggagatattgtaatacaaattcattcattcactgctgtaattcctttaacatgtattaatttttaatatagcatctggctggacactgccaatataggaatgaatagagacagacggctgtccctgaccacatggaacattagcagcttggttttacattgagatcattcagtttagctcatgtcacggattccttctgatggagtcaaaggctgagatgagacaaagaaaagttggaaatgtgctaattttaacatattacctagatgggcaataaaagacaaagcaatgtccaatagtacagtagctctgcttaaagtttgcttcttcacttaaaatactgcaatttattaagagacctggtttctgtcttaaatggaatatgttgcaagtgaaaaagtctgcaatttgggagggaggacactaaagaacttctctcctgatagaccagatgatcattctaatcaactaaaagagaaatgtattgccgcctacacgtctaaaccaaaccaaaccacaaaaaatttttaccctgtgaattaatactatttttgaacaagttggatacatgttgtgtggaggacagaatatcaagtttctcctatatgtggatgactcatttttatgaaataggagtgatctttttgagatggagtcttgctctgtcacccagactggagtgtagtggagcgatcttggctcactgcaacctctgcctcccaggttcaagcaattctcttgcctcagcctcctgaatagctgagattacaggcatgcagtactactcctgacttatttttgtatttttagtagagacagggtttcaccatgttggccaggctggtctcgaactcctgacctcaagggatctgcctgcctcggcctcccaaagtgctgggattacaggcatgagccactgcgcccggccgataggagtgatcttaacagataactggctctacaaaaaagaatggcttgggatcagctactacaaaaaaacagtaacaatagaagaccccacaattctatacaacataccaattcttttagtgtcctagatgcatattttgcaagaactttatctcagaattaactactaagttaaactgctgaagctgaaagatttctttgagtgctttacagagattttaatggcctggtgggtgtttggtgacactaaccttaaaaattttccaggctaaaattatctcagtaatactgtggtgcaggattttggagccctaattttcattttacctgtacatgggaaaaggccagaactgttttatgagggagggaaggcttgctcttgtccagagtgcccctgcactttttttttgtttgtttgttttctgttttccgttttccatgtataactgtctttttatcacgaatgtttcccagttagggtttccatttttcattaagatatgtcatttctactcccatttgggctgattatgaaagcatatggatctgctcttgtcaatgtggaatatttgcactctaggtccaggtcagcaaatataactcttcttgctcaatacaaatcacaagctcaaatatgagatataatttctacttatagagcattgactgaaggttagacagcacagctattcctctaaataatgcaaaatcaattcttgaattaaggcagactgtcagcacctagcccctcctggaacttctgtaatgaacttggctttggcattcattgcacatgtccagggagggccttaaaggaaacacttgacactggttttacacagcaggaaggttcatgtggacaggacatggtactataaccgagactgtcctccttatgagaattcagcagataaatttttctcctaagcaattaccatgctgtaagcatgcagatctatattaggtgactaattgtattttcctctttacacagcctgttaagaagctcagagtcaaatcatgaagcatctaaagcaaacctactgaactctatgatgtttattttgtatatgatttttcctacagagttatcttattttaataaatttattgatgtgaaacttataacacataaaattaactattttaaggtaaatgattcagtggcatttggcacattcacaatgttgtgtgatcaccacctcaatctagttcccaaacacttccatttcactaaaggagtaatctttgttttattttctcttccatttttctttccattctttaaaacaaaatctttttgtatggatccatgtctgtaaatcgctataaatcttttttaaaatgatgtaggattttaataagcaaaattaaaaaaatttaatgataagccacactgcaggatatggaggagtagtaggtagggtatatgagaagaaccaagaaggagtcactttgtggaagcccagatgtaggagtttcaagagcggggtggttaacaagagtcacgtgccagaaatgtcaaatgaaaagaggatggaaatgagactgctaaattgatcaattaggaagtcatctgtgacttttgtgaaagttacatccctgctttatgggttagaggtgaaaccctgtggtgattaggaggtgacataatagagactcagaagcctagacaatttagaaaaattgacagagtagtgaaatagagagagaagaggctgtggtttgagggcaaagcaagtttgaggttatgctttttgcaaaggatggagctacttaagccaaacatagtataatagatgtagaaaacttgaataacgatcctggctgtgccgcaagctatgatatgaccttgaacacggcacttcacatttctagccttggctttctcatttgtgaaacacagaagcttaaccaaattatctctaagatttcttccagctttagtgttctatggtatattcatgagtaaaaggaatgtataaataaaatggaaacagtaaggcaatttggaaataagataatgctttcatcatagatatactattatttttattaatctacctgaaatgctaatcttataagaaagttttatgatagaatgaaagaaaagtattcagtgagtgcttaagatcaatcatttcatgaaaagttttgttttgttttgtccaaacaactcttaaaataatttggatgtcaaaatagtggttgatatggattgtggttaattataaatggcataaattcttccatacttctcccatcaagagagaagctctatgtcccctccctttgaatctagatgggctctgcagctgcctagcaattggaatgtgaggaaatgatgctgtttttaggcccttaagatattagaatactgacactctgaactcagctaccatgctgtggtgaaacccaagcaaccctgtggagagacctgtgtagagaagaaatgaggcccccagccaacagctttgggtgagcactgatttgccagccagtgagtgaaccgttttggaaatggatcttcaacaccagttgagatattccagctgacacaacatggagcagagaaaagctgtccctgctgatccctgccaaaattacagatttattggcaaaataaatgattattgttttaggccactaactttagggatggttgtaatgcagcaataaataaccatgtcaagaagttaacatttattcactgataatcatgtaaatgaaatccaatttgtataattaattctgctatcataccatatatgtattcctgaaataccttgcattctgtaaaatggcatactaattgcacagtgtttatgaggaaaatacagttaagatagtccactcaaaacttgtagaatgtagagacctctaactaaaacaatagtaatcttattaaatataccagtcattgcaaatctccaatggcatttgtacttataatcacagtacattcttatcagcctagtatcctggggcttgtgttttttacttgtagttttaccacagggctctatagagtggaaagaataggggttcttggagccactaaatcagctattttttgcactaaaaaaggctctctgcaagatttttagttgttttcttccctaatgtcttcatatgttgctaaatatttctctttaactgtgaaaaagtttgatactattgcctcaaaattaaccttcttggagattcaaaagtgaatcactaagacttcagtgtttactgatattcttttttacttacacatgtgctaatttacactaaagaaacacatgtagcagaacagcctgtatccatagtcagcatgtaaaaggcacaggaatacatatagtgattgtaaaggcccagtccacggttgacatggctgcttgtcatggacttgggccttaggacctaccttgtcctcatggactctcagtttccaagcccagaggagattgttgttctgggtgagcagcagttggtgctgttttgctttcagcctccttgaccagttccattagaaaagggctgccggtgctggctgtaggactgggaactagagctgaaggaaggatgctgtggatgtcctcctctgcagaaaggttagttcaatggactgcttttctgttggaaatgctggtggcagtgaaccttttcctgggttcgggatggctttgtcactggtctttgaggcagtatcataatgggattcctcaaagcatatgttgtcatctaacatagactttgtgaggggaaacttaccaggtagaccatgctctgctccgtccactgtctcaagctggggttcaacaggaggaagttctggactcaaagtagcatcctgaagaatgaattttgcaagacagatgttgagaaaggatgtttgtatgtatatgagaagggctatacccatatttcaaaattttcatttaaatttaggcaaactattttgttgttgacttgaatctactatggaggaaggttctgatatagaaatatgttctaaaaggataacatccattgatacagtggtaaaataagatctattgcttctcggataactgaatctgcctgaatagacttaactaacagctaagatactttgatttatgtcaatcatgttatgaattatttcattttaggagggaataaagcttagtcagcacttctatttatgaacaccccagtgacaacttctggcataaattaaataaacataggtttaaattaaatacaaaaattattactgaatttattatttacttttaaagacattaatttgtatttatcaaacccccataaataaatacataggtaaatctttaagtcataaaaacaaatttataaagtatgatcatgtttatatatatttctgaaagtcaaataatatgttctgctttaattattcttttcagttcatgaaaatttgtttgttttattaaaaacagagcccatcctgattctaaatgaaacaaaaatctaactaaattgaaggaaactttgaactttgagatatttaaaatgcaagttgtattatattttattaatacggatactgaaagtgggttaagcaagtgctgcttgtaaaaaacagaaaagaatttaattagcattgcaaaggggattttgctctgttcatttcttaagctgatttgttctttggtggaaggttttgagactttgttcctagttaaagaacaaaaggacaacaaacttacctctgttataacagcaaaagatgtgggcagctctgattgggtgtcaggaccaaaggctggcagtgatccagcaatttctatgggtaaaaaatcacaagatttgaatgtatctttcctttttcttttgtggttgggacaataaaacagtccaggttgaaatatgcggaataaccaatccttaaggagtagtacaacaaatcattaggaaaccagaggcatagaaaaaaggtcattaatctgaatgatatattgaaggacagttgcaaagggtgcatcttgcatgtttatgtgataagaatagttattagggtggatttttagggtgctcagttttattctatagatttggaccaagcaggctggctaattatctaaaccattagggataaaaatatgactaaactgataagaaacaaaatgactagaataaatactggaaccaaggatcatttgtggcaaactttcaacctaaagcctgattctcagaatgacacagagggctcaaaagggacaagccccgagtatcaggttgtctctgagacacttgtgaagttgaccttttcttgcctatgaatttccctggcccttcgtcttgtctcaagagacctttatgaagttttctagtgttaagagtgcctatcttaggcagaaaacagaactggcagaaaatgacagtttcatgccatgttgtactaaaatggcatttccagtgtccatctactttgccatttactgaacctactgaggactgccctctgaggatcctaagtgtgcctgatgatcttgttgacttctctagatccactctcccctcccctccctgctactttctgccccagaaggttgaataatatggactatatcaatggttccttgggctctgtctttggcatggcatacaacattaggcaacacttcaagtctggagatagtaatgaggcttgctgcttctagcctcagggaactctcctaatcctttgtgtacagacaaacctttacaaatggtccctttattaaactctcctcaaattatactaatttgaatgtgccatctgtttctcgctgagacctgaccaattgactacatgagagaatatgttttgattgtgccagggtaacagaactgtctgtgggttcttttctctgccttcgttctccgcagttgacttggactgaactgaaacctttggattctcctagaactatccttggtaagaagtgggtaccaaagactcatcaaatgagacacaggaaggagtgagaaaagctagaaatgataccatatgtattcctgtcacagtaatgatcgactttagaagacccaagttaaaatgacagtttccatgagacattcacattcttagtctctgccaaaatgagaataaactcagaactaagcaatcattaactgaccatcagtgaactgaattgtccccacatccaaagattgttcttcctctagtgctttgctgatcagccttttgaggtctgtagctgtgagatagatttctggttgcttgtcctcctccatggttccatgatagacttcctcactttcaattttgttggaatcaaaagacaggaggtcacttgcagggctttttgcttctgcactgtgtctcttaaagatggccgtaagttgcatctctgtggagcttgagctgtagatagcagaggacacattccccacccaaagccattgttacatgccttgcaaagagaatcactagattgctacaaagcttcaggatagcttccacctctttcctgatgggctcggagagaatatcccactttaaaacatttcaacatttatcagaaacttaaaatatgaaaaaagaataaatatatcttttagttctaaaatagaatggcaggagggaggtcagtccacctcaaagaaggattactaactgaatcaagtgaccatagatttttactttaggtttttttttttctttctttcttttattttttttttgcgacagggtctcactctgttacccaggctggagtgcattggcatggtcatggctcactgtagccttgaagtcctggggcccaggtgatccttctgccttatcccccagcatagctgggaacacaggaaggaagtgggctaattttaaatttttttgtagagacagagtcttgctgtgttgcccagactggtttcaaactcatggctcaagcgatctgcctgctgtggcctcccaaagtgctgaggttacaggcctgagccactgtgcccacctaggtctttttgaaaaagtgctttttgtcaaaaaagttgctggtattgaccactattttttgtgatcttataagtcatgccgtgccaatcaggaagaaggatgaattatcctttcttctacaaatagcctcctttaggaaggtctatgaaatagcaatgtaagatatagcagtaggacaatagtatatatatatatgtatattatatatatgcacacaatatatatatactattatgcatatacacatatatgtaaaatatatatatatagtatatatatgtaaaaaaagtccaaattacccatccatatacccatatatgggtatgtgtgtatatacatatgtatataggtgtatatatacacacatatatatacacctatatacatatgggtatatatacgtgtgtgtgtgtgtatgtgtatatatatatatacatatgtgttgtaaccaagtcaaaggttcagttcttaaggctatttcttttctacttttttaaaataagtattttttaattaaaaaaatacaactttaaatgatacataatactcttttccctcaagctgcttttaaaataacatcttagaaggaaggtgtgagaaaagagaaaaataagcaggacataggtaactgtatttattatcctattcattaactcaaagcttttttgcatgcaaaaatgaaacaggattctctatgtctctgtcctcaggaattaggttttacctttagttcatgtcataaatctagacagagtgatgtagaagtgttttaaaggccacagaaactgatcacgtgtattcttggtggtttttcagatgacacaatcatttagagtctatcgtttgttatttcactagtcaattacagagccaaagttgattcttattactgagctctccaaggtatagtgggcccttttctcagttcacattgaccttggaaaggagcaaattagtttctctgctttattccagacttaggttgattccatgtatgtgtgtgctttcagatagacaactgcccattacaaatggcatttaagaaataaattatgcttgcagcacagatagtgtttttatgtttttctaactataccttgagtatgataaaatcctgttcagctgaccaaggaaatatttacctgtatcccacatagtgactttgataagagaatttttttttttttaactactggacaattgttcaattacttccatttaaataagaaaccatcaaaaagtaatgggcttatccaagacattatatgtaaaaattatttgtgcaaaatcagtatataaatttgggggagacgggaatgtactatatttcaaaacttaaagtccaaattacccatctttttctttctttggtcttcatttcatcatgcacaatggaaacatgaaaaagagaaaaaaatttaatgacatttattgagacattcaatgaattattttatatacaaaagaaaaaaatatttctttccattgtctcttttgtttgttcagagctttgaaagattcatataaactgccatcagaatttgaatggaaactttgagagagatatgaatctaagaagtaaacatcattatatgtttctgattaggatttgagccttagttcaaagattatctgcacttttggtcttcttcttacattccttaatttcttcatattccatctaaaaaggctggaaatctatcctacatgttttacattttggggggtactggtgccagaacattttaaaaaagtattttgtaaatggatttctcagctcttactggcattaaatgattagtttattcctgaagataatttatctgaggcaaaaccgtggaactggtgttttcttgacagattatgttttgaattgttgctatcagtaagctttgagggattgatccaattcaccatgggacagcttgcaagaaaaaccaccacctgtttactgggtgagtggtctgtactaaacaatttacatgcattctcatttaatcttttcagcaatgtaatcccagcttcacagaaaagggaacaggcacatagaaggaagtgtcaaatgggaattgcagggttgaaatcctggccttcctgacctcaagcctggctcatttttccatgctaccacctgcttgtgcatgaaaaaagaccatttagtcaccaaactgatgaacacattttgcactcctttggacacatgtatgaattcagtttagtagctatgtccagctttctccttttacatttcaaatggtagttgctgccaaagacactctacacatgtgatgggattggggttgttgccctttctgcctggactatattaactaatgtaactttcatccccagatatcatatgactgaaatgtacatgctacaggcatgccacaaccctccttctgcggaggcaaggaagaatctaactagtgctgctgtatgggtgagacttccttctctaccaaccagacactcatcctccctcttgcttgttttcagcaatagtttgtaatccatgaggttctgtaaagaggccaggcttcctgggtcaagaccctagtccttttaatttttaaataattgttttgttgaggtatcattgtgataaacaaatgggacatatttatggtatacgatccaagaattttgatgccatacacctgtcaaaccattaccacaatcaagatagtgagcatattcatcaatcgcaaagctttactcatcctactgtgcgatccttccccttctatccctatgtgcctcaccttcctaagcaactgctgatctgtttcctgttactataaatcagtttgcattttctagagtctattataaataaaatcatgatgtacttttgtttggcttctttcactcaacgaagttattttgagatgcacccatgttgttgtgtattccaatagttcatttctttgttgagaagttgtttatggcaagaatatatgacaatttgttgccctgttgatagacacttgggttatttccaggtcttggctattaagaataaagaggctttgaacatttgtgcacaagtatttgaaggagtataccctccaacaagactgcatgattgttaatagttttccacctttgctgagagataaagcaatatttaaagtggccctttcattgttcatcttcataattgtgttaatgatacatgtcctaactacttcccagtcacgttgaattcaatgaagtcactgataaaaaagtacttgttaaattgtaaatcaacctttatacaaatgagctggaggacagtcagtaccaggagactcacagggtttttggtcttcttcagggatctggcccacaaaaaagcaatttccttaataacatgtttactttataatattctgagcatcattattaatggttacaattttgccactgtcatgagcacattatttattgtattcaagggccaaaatattttatggtggactaaatcttcatgtcatcatggaaatcactgggaaaatgtgatcaaacttactttgtaggcatctttggcagaaataataataaatccttacaaagataagcacttggtaaaaattcagtgtcaagagatatatctttaaaatatttaccttgtaaaatttcatcatctaacattttggtttacttctaaaacagattttttaaacctttgtttttcatttattgaagggaggtggataatgaacattttaatattcaccaaaacaactgttcccatcatttccttcagctttaaattaaaaatttgttcttccactgcagtggtttattcagaaaacctttgcatttatgcagaatatttttctatcaacttttatttttctctaatccatctgatttcacagaaaatactaccgagcagcatcttgaaataaagaaaaatgagtctgctttggtagatattaagggtttcatcttttataactttcacttttcagtatttcctttctctggagttatacaaatcagaggggcctgatagctttgaaagaaataaaccatgagagctccctgcaaagctatttctttttctgggcctgtggagcccttgctctgtacatcttcttgctttcagacagtaggcagtgaaggagccagaaacacttctgggggagcccacgctccctggtttacaaagctcgtttggggcaagaaatctcattctgttcataccagggctgatatttaccctgtggcacattttaaaaatagcatattatgagttcatctgtagacgttttgaaaaatgagaacttacaaaaaaagatttaaaaattatttcccccaatcatgaacccacatgagagtgttgggatgctgaaggatacagccctccttgtgccaaagatgtgggaatatggttaaaccctctttagtgtggcactatcttatgatcttatttttttatttaaaattttaatttagtaatttttgagtggtaatagattactatgaatcagatgtcaaaatgacataaaaggtatattttagaatgtcttgcttatgctcctattcctttccaccccattttcccaactctcctacctggatagctatgactttttattgttcacttgtctctcttgggaagcatggtttgtttaaatagtgatgttatttagcatcccataggaaaccaggcaatcagacacctggttaaaaaggtaggcaattaatgtctaccttttttcatctgtctctactgaggtattttcctaagaagctcattcataaccacatgaccaaagacagcagatgagctctctatagagagcactatttctgattcccagaagaaggaaggaatacagctcctgtgttaccccttaagaatcacctagagtcatgttctaattagacagttcctttatctgaaacgtactccgtttccaggatttggcagagctaaacaactggggaaaaaggaccttataatccttatggcattgtttttacaaaaggataggaagaaagtaatttaaaaattgagaagagtttgattctcttacttacctaaatcctaacacatggatttttttgaatcctggaagtttcttaaatatcttttgcatctgcagagagaaagaaatttgtaaaatactctttggttctgctgggtcagttcttgcctaactgaaaaacctgaacacttttgatgagttaggggaacagctgaaaatggaaaatgattattttttcttttaaaaaaactctccaaattgatcagatgaaaaagaaaaattgaaacaactaaggaggccaaactctttgttcctagtgatttccaaaacccagaggaaagtgttttgctatttatttaaaagctgtaactggatagttctgatctgctcttacggttactttaaataaaatataaaatagctttaaggtggtatttgaaggaaacttttttattttattttattttatttatttatttttttaattacactttaagttttagggtacatgtgcacattgtgcaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaaaacttttttgtctacaggagttttacttatacacatagggtaatattttctgactataattataactagagttagctataatattttagctatgatattttctgaattaatgatatggtttggaaattatctataatgtgaaagggatgattacattcaaaatggctgctgtacttaaagtggtagaaatagattctaatctaatagattagatttactcttagattcatatggacttcacaataaattttcttaattaatttgaccttactaatgaggcctgttataatattttataattgctgtactaactaatccttaagctactacagcctggccattctctccaggccactgtctctccagctctctctaaatccagtggcaatttctgttccccctctacagtgtccctgctctttcctggttcttcttccacctctctgaccactctctccatcttcattgctccaccctatttctgtatttactttctacttaaacataaggagccttcgagtttccatcttcagcctcctgcttcactcagtcactctctcttttcttctggaagctcgactgtagatgctgtgctaggctctggggacaccgtcacatggacaagtactgccccatccagctttcctgttggagactgggaggcaagagagactgaggaagggatagtggttgagtagtgaagcttgggagagagagcagggtgaaaggtgaaactgaacaggtgagcagacacccatccctttcctctcttccctgtcccctctctcctatccttgtccccgggggatatcattttctcccatggcttaattgatcagtgatacgcagccttgagttctccacataaatatcccaacatttgccactaaatgaatctgcccaaaccagagccattctcttcttcccaagtctgcctttgtcctcagcctctctgcctcagacagggtcatgaaccccgactgtcttccattctagaaagcgcagcatccctagataccttccctcccaccccccacatgcagccaccgactctggttggtttgaattccacaaggtcttttgttttcaccatgttctcattcacaggtctggcataccctccctatccctactcctgcactgctgaaatgggtttatgtgtgtgagtgggcagagaagaaatggttttctgggtgtgttgggagaggaggaaggagaaggtatctccttgactacatttattctgaagttaatctttttactaagaatctgtactaacagttcattgctggacccattgaacaagatccaactgtttagaatggcatttaagaccctccagaatctgcaccccacccccaggtaccttaccattcacttcctgccatcattatccccttggccaatatcttgtcctttactgacactaaactgacccctgttccttcccacatacaatatacacttctatgtcttcaagttcctatgaattattttctcttcaatttttccaccttctgcttattaactttccctcctccccacactgcacccattttcaaagccagctcagacatcttctgtactgaaaagcatttgtagagccccaaagtcaggttcaattatttcttctctctactactctagagtttattgcagtataccccataaaagtctgtgaggtacatgtcagtttccctcaccgagatcatgctccttggccatgtcctgtttattcatttttctttacctccctcattccatctagcagattgtcatacacatagtagggacccagcacattttgtttaattcagttgagtgcatctcttcattctctaaattcactaccattccactgtgttgtcaccacatcaaaaattactgccaactttacattgttcgtgtgaaggactagagcagtgatacacagataatccccaaatcacttacactgggctttagactgcattacaaattttttcccccagcagactgatttaccttctaattatatacatattttttgtgacaatattaaaagcagtttcattccctgaacataagaggaatcacagtgatgaaggtagctcagcttttgggtgatccggagctctttgtacgggatggggtttaaatattggttctgctactttctagctgcaagatcctgagtttattgcttaatctctctgaatcttggtctccttacccaaaaaggaataacaatgacaactaataagtaacaagtgcctggtacacagctgggcagttagtgatttgtattatttactttcttattctctacttctcctgctggattgccagctcctgagagcccatttttctcttactcccccaagtgagcacacggcatggagcctggaaagagcagagcaagtctttagttagtcatttttgaaactcagagggaggaaggacaggatgagggtccctgtagaggtcaggggcagaaggcctggggagcgagtttctgtgtctccacccacaccctgccatgggctcaacagaaatctaggaggttgggttctgcaaagctagtctttattctgagggcaggcaggaaggtctgtgtacatgcttcacatctgctgtggcttcctaggacaaacagctttggggccacagggaatttgccatgctatttcagtaacagctccagggatttaacatttaaacatgagctgcagtttctggagcagcagattcagatcctgaatcatccatttttcttctccaggataccagagatgctgttatatacatgaaaacagtcaatcgaccctgggactggcattgtagatgcctgcagctgcagcatcagcaacagggagcactgcgggggagagccctcctcctctccaggagggctccatggcattggcttgggtggaagggatttattgtttatgtccatgccctctttgtgaacctatctgggattgattaagagtcagctttgtttaggagtgtgaggaaggcatctagggaggatatgacaaaagcctcagttaattctgctaaataatcttctggggaccttctagtcatggagcactaaccactaaattgctaattaagtgcccagttaaccttattaataatactaaatgcacaggggcctccctgattctgctggaatgtatgttaactgggctataaaaaggcagctgtgttgagttttcatgaaggtttgcacaggagaaagcattcagacaacaactaaatgattccttttgacatttgtattaaattgctcattaggtttattgtggaaattaaattactgcgaagcactgtccattaattcctgattaggcctgaatgtgctaatgcaggcattgggctgtggtggggctgattagttatctgatggcaggctgtgaggtggttggggccctgctagggagcctggggagggaacagatgttgtaagcagaggggttcaatcttagagaaatcagtgacgactgtgcaaatggaaccagcagcactgacgccaggggtctctggaacaagattgggcaggatgtactcttctttggcttataagtttttcagaggctagcaagacatgcccatttggctgggtgcggtagctcacgcctgtaatcccagcactttgggagtccgaggagggtggatcacctgaggtcaggagttcgagaccagcttgatcaacacggtgaactcctgtctctactaaaaatacaaaattagccagccttggtggtgcctgcctgtaatttcaactacttgggaggctgaggcaggagaatcgcttgaacctaggaggcggaggttgcagtgagctgagatggcaccattgcactccagcctgggcaacaagagttaaactctgtctcaaaaaaaaaaaaaaaaaaaaaaaagaaagaaaaagacaaaagacatgcccatttgatgatgatacaatagtcccttcccacaaacatttatctgggaaaaataggaggcatgacatggtggttaagagcaagagttctggtgccaggctgcctgggttggaatcttggctttgccagacaataaaagtggcaccgttggacatattaatctcctttcctcagttacctcttacaaaaagaggaaataatattactcacttacagaattgcatgaaaaattaaatgagttagtacatataaagcattaagaaaagtgttagctattatgtctatacacagcagtttagacttggaaaggaactctgaggtcatcttctacaatttctaagcaaggaagttaggccagggatctccaatttctcagagctaatttttggcaaaaacaggactagaactctgattttttaaaaatcccaatatatttgcattattctacatcagattgttgtaagtgtttagaaaattgacaatagatcatcaaaaagtctatggccaattatcctactttgaagatactctgactatactaaggaattgccaaaaagaatgttccaaagaacaaatggaaatgttaacaaactattctttaattcatttggtctaataatccatgtctgagtagttttctggttcataaatgccccatgctgattcttttactttgacatttatagaaataattctttacattttattggctgaatgctgatgcagagagaggctggaggttaagaatgtttcacttattcatctcctctcagggtgagaagaggtacgtattgaattctccaagtatgagaagggggcctgtttgttccctggccatgctgagtaagattcgtgtgcactcctgttgtccacattgtagttcttggttacgtaatctcatggatgcttctattttcagttgcatttatacaaacaattactgagtagttaactgcatcccaaactctgtattagaaggttaggcatcagagattaaaagaacagctcctgttctctaggagaagctcatagcctggtggtgatgagtggggtgaatgaagaggaaggagtagagatagcaaaggccatagacacataagcaagcagtctcaagaaagggtgttgtgaaagcaatgagtgagcccaggagagacactggatgcagaatggatagagggaactttccatgttgaagtatgtaaaacaagacttggagaagggcattctagacagagcagacagcacatgtaaaggctaaatggggggacaaattggaaatagtttgcattcctggaaactagagtgaaaaggagggggatgataaggaactggtatatggtgaggctcaaaaaaaaaaaaaaaggcagagatcttattatggtatatagatgccacactcagcatagtagctggatttatcctgcagggaattgaagagatttgaatttaattagagacagacagatataacaaaggtcagagatggaagagacatcttgggaaagctcctcagtttattaattgatgacatggacaatataattgccttcctcttatcacccatgaaaaatattgtgtctttaaattgcatcaaactgtaaaaatagaaatattatataaagacaaagtattatgaattaataatttatactttaacccagcatcttctctacttggtgcctacatagtcattttgttttatttaaatctactttattgaggtataattgacatatcaaaagctgtacatatttaatatatacatcttgatgaatttgtctataagtatataccagtgaaaccatcaccataatggtcatctaggcatagagcagctgcataatgtctttcagttcaatgagattttaaaacctactaatttttatttatttatttattttacatttgtttacttatcttttgagacagagtttcactctttcacccaggctggagtgaagtggcacgatcttggctcactgccacctctgccccccgggttcaagcggttctcctgcctcagcctcccgagtagctgggattacaggcgcccaccaccacacccagctaatttttgtatttttagtagagacgggattttgccatgttggccaggctggtatcgaattcctgatccacccgcctcagcctcccaaagtgctaggattacaggcatgagccaccgcggttggcaaaacctactaatttttgaagaaagataaatgtaaacacagtggtccctttttatccttggtggagggtatattccaagaccctatggatgcctgaaattgtggagagtacctaatcccatatatactacattttttttccatacacacatacctatgataaagtttaatttataaattaggcacagcaaaggatttacaacaataactaataatgaaatagaacaattgtaacaatacactacaagaaaagttatgtgaatgtggtctctctctctcaatataatgcctatgtgatgagacgaagtaaggtaaatggtatagaagttgtgacatatgttaggctactattgaccttcttaatgaattgtttatttctggaattttcaatttaatatttttggactatggttgacagggtaaccgaaactgtggatagagggggcaggtggggaccactgcaagttttgagaatagaaaggctggaatgaaaaactttcctggagatccatttgttctaacatgttagggcccattgtaattttggttttcttttaaatggttaaacatgaatgccaggagaagctggaactgttcgccgtaagggtttatgtcctatcggctcccacctctcagtcacagcttgaggtgtggttgtatgggccgggtctactcacctgaagttgggactttcctgctagctcctggtaatatggggactgggagtcagcgagctctgccttgaacttctggtttaccagagagacgctgagctccaccctctgctcctccaacacagcgaattctgtttctctttcctgagtttaaaaaaaaaaaaaaggacttctgttaacctaaaccacaaataaatggttattttagataatatatgttgatactgtctcaagaagtggattatgaaggcttaagtgttttgcaatcaaaatccttttaactagaacttagagaagagcctagactggtttaatgagaaaatttgtgcttaaatttcacattgaaactagttagaaaatactatcaagccaagagaaagtttgaaatttctctcagaaggaatgatgtatttgggccacctttggaagcaggtggctaagaacggaggcatggttctgaggatctggacttggtctccatcactaagggccaagaggtcatccttcttgcctgttggtctggaaaccagcaggggtttctcattgctctgaattcatatgggcttccaggacacagagcaagcccagagctcagtttcaaacttgggtttgacagagttttcaaccttggatacccagaagatactaaggcccattagttttcttaaaaaagtaaaattatctctgcggaaaattgaatatctctggttacgtacatggtctcttatagtgaaatcagagttacagaagctgaaagaagagaacagttaatggaaattgccctgagggacagagctcaactggataaatggtagcatatgtatttcctcctcatttcttgtcacaaactcccctccaccatgggcatggacaatactacagcctctctctaactttagtaggacacaaggaggatgtggattcacatttaaaagacttctgatgtttgtttaaaagactttcattcattcaaaaaaacacacattgagcatctgtatgggtgtagcatggtgctaggatcaatgggacactgaaaagtctgacatgcagtattctttagaagtattccattttgttaggcaaattggaagtttcatggaacatttaaatgactgtgaaatgaaatattctggggatatttaaccagagagaagaacttatattagcttttgaagaagatgggacagaggggttgtgagaaaagagatgagagatgagttgtcttagaaattttatagtgaatatatactgaattatggtcaacaattttttccaacagtacttttcactgttgagggaagaacatttttcagaaaaatacaatattttatttatttcttttatttatttatttttttgacacagagtctcactctgtcacccaggctggagtgcaatggcgatcacaactcactgcagcctcaacctcccgggctcaagcaatcctccctcctcagcctctcaagtagctgggactacaggcatggaccaccatgcccaggtaatttttaaattttttgtgaagatggggtctcccagtctcgcctaggctgatcttgagctcctgggctcaagtgatcctcctatgttggtctcccaaggtgctgggattacaggcatgagccaccatgcctggccgaaatacaatattttcattctttattcatgccagcagttcaaccaaaactggaaccatgtggcctaatgggcagataggatggccagcaaggtctaatctctgatttatcttgtagagctggtgaggctgaactttgtgcctttgccctgaagctttgacctgtgccttggagagaggttgtaatgaaggggaaagggttagaggagtcacctctcaggccccaggggtggtaggtctggtggtagtggcagtgtgagatgccaggttctagtctgccactccttatactactgcctcctttggggcctactgcctactttgtgcagccaaagctctacacacatggctaatgagtgaggactaagctctgagtttttcttatcttgcccaaattcctatctaaggggtttggggagtcatgccctacaaaccataaattctcatcagatgggttttatttaaccctatatatatagtgtgacttactttccaatctgactctggcataacattatgtgacaaagaagaaaatcaacttgtttttactccaaaacatgtctctttgccatattttgaaatggccatgcaaagtcatcctttgtgggtaaaaatttgcatctgtaaagaatctctattaacatagctagatcattttctttcaggccctccaaatcctgaagagaataactgagagtctagcacattttaaaggtctgaatagggaacacttgtcatctattgtctctaagggcagccactatgaaacttcaaaagaaccttggtctacacaaccttttatcttaaccggaacatttcctttctattgatcccaggtctttagacaaactgaaccaattgtcaaccagaaaatgtttaaatttacctatagcctggaagccctccccacttcaaattgtctcgcctttctgtaccaaaccaatgtacttctgaaatgtatttaattgatgtctcatgcctccctaaaacgtatgaaaccaagcttcaccctgacaaccttggacacatgctctcagtacttcctgagggctgtatcatggaccatggtcactcatatttggctcagaataaatctcttcaaatattttacagagttcgacaatttgtcgacaatgaggacagtgtttcccttcttccacaattaaattctgtaaccatcctctcatcccacataccttcacactcagagtggtggccagtgctcctctttgccttagaacactgtgtttatttttccctagttttacacacaggattttgatcattttgatatctatttgacctattcatcccggacataactgagaacaaaaccttcactcttgttgtcaatgtggaattatacttcagtggtgaaagagcttcatgattgattgattgattcattcattctaacacttggagagcatatatatatatatatatatatatggttttgttatatatatatataaggttttgttaggtgctggggaaaaagagccccagcactccacagcttataattaaattgtttcttgtaactcctccccttttattctaggtcttaatctatgcttcccccctcagtacctaggaagaagtgagaataaagaatagaacaaagtcactgactcttaaccagagtcacaaaaatacagcactaatattatttaaaggatggtttatccattctcttttcctgttttgctaaagaacaaaaacaggcacatgaagagctagatcaactctaggaacttcttactgttgtaggcatcttggtgtcgttgagtgtattatcgagaatttcattgaggagggtgtcatcaggagtgagagggaaaggcccaagtgagacgttggcaacatctgtgaaaattttaaaaattaaagacacaaaaatgagaatggaggagtttaaattagaacgaggtcaaaattcaatatgctttttctgtcattctggaatttacagatattaggtgccttctgaactcatctttttaagatcacgtaaatatgttcttgaaaaaatatgactcatactctgtcctaaattcttcattctttctcttaaggacccaaatttggtgcttccctgtatgtgttatacttaaatgcttttgccagatgagacctgattaattttttcttaatgacactatataaaggacacataggcagatgtttaccttgaatttgctcttctgagggttttcttagaatactgcccaagtctttaaaatgtagattgcttaagcaatcattgaggaataagattttaatcagaaaatccaagagatgaaagaacatttaagatgctatgaatttcacttcttttagaacagatcaccataaaccatttcaaatatgtggcaaatgttttgatatttttaaagatcttcatagagtgcaagtctgggttctattcaagcaaagaaaaaagcgttattataatacaaatgcatttctattttgtaataaattattatttaaaaaaatgctcagagaaaatagtgttatagttaattggtttatatttagccagaaacaactttccatttcaaccttaattaggcaaaaacatagaatgccttagtttattcttgtgttttagaaaacaagatatactgaaaaatgattcaatctttccttactccctgaagagtatgtggtacctgggaatctgcggtcacaagtggttacttgtcactgtgaggctctgtgaagtaattgccctgggtgtggaattgtgcttcctagtgggggcgtgagagtgggtatcagaatcatctaggcaaggcagttttttggctaataaagtacataccctgtggcatatcagaacctcaaaggatgtggtccctggcatcttccccttctgccctcattgaagaatcctgctgtgagcaattgggatggaggtgttctgtgctctggacttcatcagactattaccaatgtaaggcaccttcaaactttgtaattctatgaataatcggtttatgctacaatttttgttacaataaaaaagtacttagctggtaccctagaagaacaaatttttatttggctatccttccattttattgccttgaaaagataaattattcacatacttacacctaaaaacaattattaggtagcctgggtttgtcttcgagcacattcagcctcttttggagatttctcactcttccttcacacctaggcacctagtaacatttcccaatcaaaatctaatcttaactgttctgtgtgtatacttcaactggaggtgtccagaagtactggggaaataattctaaaacatttgttgctagaacttaaatatatggtgatgatatatcatattatattataatatatgaattgtccactgatccctcaaagtttttatttaaaaaaatgaaaaataatttataagaaaggggtcatattaacttactctaacttactaaatctaatcttgttattacaaaagtttctatcagctaaagtacattaccttcaagtttaaagtagaaatacaaatttcaattctcttattaattttgttttcccatattaaaatgaagtcagtacaaaacgtctttttacatgtttatatgctcctcctctaaataatacctttttgaataagacttgatattaggtgtcacaggtcaaatttgagctgtttatatgggggaattaactatgtagctcttctttttattgttaaaaatgcattttactgtcattttataattaaaattcaactaggcttgtcctattattagctacaagtcagtccagaaatgataaattagctgaacttaggagaaaattgaaatataggcacagccggctttctctgaatgtcagtaaaggaagaaatgggaaagtaatatcatttatttacaaatatctattttctcaatttctacattttaagtcatgaaaaattaatttcttaaaacattattcacattaccaaaaatcaaatgaactggggaacacattgcccagagaatagttttattgtgtatatttaaaagtattcttttatgtgaaaatgggaagactgcaatagaaatatacatgaaagagaaatttcaaacatctaataaacacaggagaaatgattttcctctgccttttggcaaactctagaataaatagtaatattcaatattgataagtgctgcaatgagacaggttcttgtcttttctgccagtgggatatttaaattgtaacaaaatttctggaaaaaaaatttggcaaaatttattaaaagccttaaaatccatagtgtttgacttagtaatctattttgagaaattagtgatttgacaaagatttatgtttaaatatcttaattaaaacactatttgtaatgtcagatacaatgatgcaatggttaagttgatgacatccatatggatgcaacagaatgttgcaagtcattaaaatgataactttgaagaaattttagtgaactataaaatatcctttacatcaggttaagtggaaaaaatgatacaaactctaagtaaatatggtctcagtaatatgtgtatataatagaagaaagaaggcagaaaataggcagtaaatgttcatgatggttgtttccaaactgtaagatattgaatggtttggttttacctttattcttttctgtattttccaagttgtatgcaataaatttaaattatgttataaagttagaaatataagctagttttgagaaagtacattataaacattatctttaattaggaattgttttataaataacatgctatcatgatgatttgaatgaaagttgagaagcaaagaaattagatctaagcttacctgttgaaatgacaatggtttcaccaggctctcccaatgtcttctctgcagatatttcatcttttctattagtacaatagaaaagaaggaagaggtggtgaaagagaacttgatgacagtagagaacatacatttaaatttcttatactgagtaaacctaaaagttataggaaaagcatactttaaaactagattgacctatttttaaactacagaagtaatatttgaatatattctcattgaggaaaaatgcaaaaaactctccaaaatggttatgtttgactccagtgttttccgtaagcatccttttttttgtggtcctggggttctgtggtaggcaaagctggtctttggggtctaatgttgtagttccattccacttacactgtgttcttgacatcagagataattgatgacatgatctgtgactgaaatattcttgctaaaatctcagaccctcaagcctgcatatccagagtcattaagcttatctaataaagtaactcttgtggttacagtaatgggaaagagatagatttctgggtaatataaatttactaaatctgtattctgggcacagccactgtctgtaatggtaactagccaggaagttgggggtaggttctcagtgccatggaatgatgatgtggaagagattctaggagcagatccaaggtcatggtggtagagctatttgtgtataatattggcccattctaacaagctttacttagaaaggagtagtggtgagagagccaggtgggaggaggtccccccaaaaactccaactggcctgccctcagggatggagccttgggaagtttgtgcagtttgcagtggggaggagcctggcccctcctcttcctgtgtggaacctgggattcaagctgcatgcgggaagcactctagcagggactctgtgcgggaagcactctagcagggactctgcgctagcaagagtccctattttccccttttcttccttttcacccaataaaaccctgctttactcacccttcaaaccatctgcaagcctaaattgtcatggctgtgggacagacaaggaccttgtctttagctgaactaaggataagtcctgcaacattttttggcgcccaacgtggggctcgagaagtggtgagtgaaatggggactcaaatcctctcgctgttgcttctaagccttttcatccttggacttctcagggtgggggaaaccatgcccccataccccattgctcctgggccttttcatggccctttccttccattctcagggtcaaaaaaggagcagtgagcagcagctccccgctgctctcccctccctgctggggctgggacgtatggtccaagggtcccacacagctggctggcttgttcccagctatgcatcaccacagcagccttctgcttccctggacaaagggttcagctccatcggacagtaattaaacttttctccctggtggaggaacttgcataagagtaagaggttcttccccaggcatttttaaatgtttttttttcttttctcttctccaccctgtctgcagttaacctttaaagttctttttcccctttagcaggccagacccccacccccaacaactatcactgtgttctctgcaaagttttggttgttaaatcaagcctccattttgttatacatcctgagggcatggcttgtaactccagtggcaagactttgccttatggaatgagccctttctggttcaatatctgcatgtttttctaaatctgtctcttaaatagccccattcagtgactaggttttcttctgcctctctgtgtgtgtactgtgtgtaacgtctgtcaaagagctgtaattaatttggcctaaagaaagacaagcacttggatctaatttttttaagggaagttaaaagctgtagtaccttgcagtgcatgtgactttactctttaagaaataaaaacagccttaaagattattggtaaaatgaaggtgtcattaaaatgtaaataggtgaactaaactatgcaggtcagatgcaaggtttgctaagtgttttgaggttataaactgctttttgggttttgagaactgtctgtcttgttggcttcacaataggtaaggcctggggacatatgaaattaattacacccttaactaaaaaggcaaacctcggctgcagtcagcacacaattaaagtaacttaccaggttttaccttaaagttaaaaattgttaggagttaacattataccatgtaattgaaactactgaaattagatttacatgtaaggggtgtaagaatagtaaaatgtgtttttatagtaaaaggttataagaaggcatggaaatgtaaactttggcctagggttaaaggattgtattaaattatatagaaaaaagctgaaggttcaaagaagtgctggaagaattgtggaaattactcttgcagaagaggttctttgtgtgaacatattgactattcaaaaaaaggtattatatggttttttccgtaaattgagcattgagataaaaccataacaaaattttcttcaggcactaatctgctctttggcaaaatttgtaaagggttataaaaggtttttgcttctttaagattttggagtcatcattttggcacaataaataatttatggctatctggaattatgtttcataatatcaagtgctttagacatatttaaaaggcttctcaaaatcaaacttcagtttcaaaattgtccttcctgacacctggctttttggatagtccagagagcccctagaatgtccagaaaagaggtaagcaggattattcaacatatttaggtacctgggattgtcaaaatcatgttcactcttctttagttcatatcttggtaaataatgctaatctatgttccaaaattctatgggatttcaaaaattctaatatctaaatgtatgctatcaatcataattaatgttgttaagttattgtaaaccatggagataaccaaatttgtcaattgtgttcctaactgtaactacactggacgttttgctattcacagacaattgctgtcttgttttcatccttttcaaaagatagtttataataagctgcaggactttaacaggtgctcgcaaatacatgattctgttaactttggagattgtaacattggaataaaggaaaatgtacaggactcatgaggagctgaaatgctcacgaatatcaaaccaaacaagagttaattaaatggacagaactcagaaagctgaagcaacttttgactttttcttggaatactgctgatccttgttttatttttcagagtcaaggaaacttattttgaactatttatagcctttaacaagtaagggccggacacggtggctcacgcctgtaatcccagcactttgggaggccgaggcgggtggatcacaaggtcaggagattgagatcatcctggctaacatgatgaaaccccgtctctactaaaaaatagaaaaaatcagccaggcatggtggtgggtgcctgtagtcccagctactcaggaggctgaggcttgaacctgggaggcagaacttgcagtgagccaagatcgtgccactgcactccagcctgggtgacagagcgagactccgtctcaagaaaaaaaaaaagttaagtaaggtatactcctggggtgaaaatttggagcatgcttgtttctctctgcctggttcctttcgaatttggaaactatctgtgagtattcttaacttacggcaatatagttgtttgcatcagtgcaataagaatccatttttcttttgcaacaagacacaattggaaaaattgggtattttatcaagggtttgactgaaagtgtatgcttccctttaaggagtcaatctcaacttacagaactaataaaactcagtggggaaactggcctaatacccttgtctatgcagtccctgtacagggttcttgacctatggtcagtaaagaatgtcactttctaacaggtccaggagctccaagtttatctttggaccttaagaggaggggatcacccaactcacaggcatttgaggatacaaacccagagctgggatcagcattaaaaggtctcacctgagagtcctcgtggaacagacttccatcaaagccaatccaaaaggcttatgtagaaataattattcttgctgcactttatgcaaataattaggccaagtttaaaaccaaagtctatttgcaaacaactcagtcctattatgattttgtttttaacaaaaatgaggactggagagagggaaattatgtttcaaaacttatcatacatttgtcattaaattctaaactcattagttgtttttaagattttgcctatattttagactaaccctgcttgttcctgtgaaccaaccagcaatctctggctgcagctcagaaagaacaagagggatgggtaatgtagaaatctggatcaatattctggttctgagcaattatcctgcaaatcctgccaggtgatggaataaatagggaataaatagggtgcccatcacctggaggtttcatttttggggaagtaaagaccaagggaactaaccaaagccaagcaccatgcacctaaattctagcaagcataactatagctaccagttatcttggtgtgtcacaagacatccttttctctcccttgttggaggactcacttccacagtttcaccttagcatttggcttttgataaggagtccatgtaaccccccgagacatatttttgtcccaaactcaattccaagctttaggtaaaagccctaggaaggaaaactggatctgaggtatccagaggcaaattacaacggaggttaaaaggcacagtgcaggtgagcatggctgattcctgtcgattaagccaaccccaagcttcctgtttcatggataaagggcatgttaatatctatggtataaatgaggtctagggaattccaaggctactgacagtagcagggatagagacataagggagagcagatcattcttattctctaaggccctccctgcttgatgggtgtaagctgctttggcactcatggtgggacctgacaaggtcactgggattcggggatgcaaggatggaggagggaaagaggatgcttttcattctctctctcatgtatcttgggcatatgttaggaagagaaggaaaccagagatgcttgctcccctctttctagatgggtagccattcatcttcagtctgtacccctttcaaatgcatcctgaacccctgggaatcctttaaaaaatgcctttttctcctttctcctcctctgttctctcttcacggataggtaatacgctcccctgagatgcatcctccaaactggaaagagttaatttcccaagccttaaactggttgtcttaggattgggctcaggggaaaggaacccagaagcccaacatgctggcaaaaagggccatcagactccaaacagtcatgcaaccagagcctcggacaatggccccttctgctgggaatccttaaataggcctctgaggaagctctgactgcttttccccaaatcagcagcccctgtcagcaggaagcagttaagattggtctttgtctttattcttaatccaacaactgttagatgtacttctttagagtggggaatgagacagccaagtggggagggggtccctggaaaaactccatccagcctgtccactggggtagagcctctggaagttcatgacatttgcagcgaggaggagcctggcccatcctcgtttggtgcggaacctgggattcaagctgtgggtggcaagcagtctagttaggtgagtgtccctgcttcccccttttcttcctttccacccaataaaaccctgccttactcagccttcaaaccatctgcaagcctaaattttcatggctgtgggacggacaaggaccccaattttagctgaactaaggaaaagtcctgcaacagtggtagtaatatcttctaaaactcactgaaaggtttgttactataagcaagtaggtcccaaagcattgtgtctgtgttagtataatatagtagcagttgaccattatatttgatctaattttctgtggctcatgatgatgggaaggccaagggtaatggctaggtgttctgttgttttacagtacagttatctagaattagtcatagccaatagtatcatgtacatatttctgccacacccaattctgccatattgttaatgtgtaatatacaaaatattattaatcagcctgccacaggctctggccaatcagaacagatgttagttgtaaacacagatgactacagtggtccacacaggccagataaaaattttgctgctatagtggaatttgaaattagctattcttgttatttttttctggtattatactatgtacttaataaatggtttttatgtagaccatatttaacaactctcgttatatcaaatattatagcacttatagcctagacagtttgttttttactttacagatctttgtttatagtaagatctccttcttgttaatatcactttcatctccttccctgtcttgctgtaaaaaaaagtaaccaagaagaatagttagtaaaatcctggctattgcattagttacaagtcaacagtccattttgtgcaggactctgtgggatgacgttttcttgtcctttactaaaagatgtcattctgccactaaactggcaatctataccatcaccgaggatctgtaatttgggaagctgagctactcagttcttccactggcttttatttcaaagtcatttgaaactggcagacttacgggttagtcaggtgagaaaattttgttttgtcttcttggaaaggtttaaagtaaaagataatttcttttctttcttttttgaaaacaaattggtaaacatagctaatgtaaaatatttgtttcatgttcctttctttctctccagaaatgctggcaggcacaggagtagatgaaatgcttctatttccttttctttctggcttgggtaattgtttcttataatttttaatggttgtctgtcaaggtttggtacattctgttgatttttttttcttatggatggaccctgcgttgctttctttgtatttttttgaaaatggaagaatcagtaaagtattatcctatatttaaatgagaagaatcaatatgtctgtgttttgtgagcaaaggtaatactctagtactaagattttccttagtcacattatttctcctggcaatatctttttaaaatctataaaagagtggcttgatagacataattgattaacaaaatatatgaggattttgctcagttctgtatagtaggtgggaaagtatgaaacagttcctgaccttgaggagtttatactcctacaggaaaactggagaaagcaagagactgttcaataaaaatacaagtaccaaacagagtacaaagttcaaagcaggaagagattgctgcaaactcaaatagtctgttaagacatcctggtgaggtgggattccacctggagcttcaaagagagtagaatttggatagatggagtggaaaaggcagattcttccaagcaagagggaaaggctagggtcagaatccgagtgagtagggtgtggtcgatatgcagtgaggaagaggcatggtggcagccgcggaatcatggataataataatgggggccaagttggaaaggtcaggaggtgaaaggtctggattagttagtttggcttctgcctcagtgaaagttctagcaagaaacagatgactctctcatagtagggtaacttgtgcaaagttcactaaagggattatttatgaagttgtgtgaagagtataagagcaaccacaagggagagtgtagtaccccagaggttcagtaacagtggggtgctaaaaatatccttggggccagaaggggtgagaggagaccaggagccagacacagagaaggccctgtggaaagaacagtcaggcaggaactgagctgaagctgaagaaggccaataggccttaaagactctgcaggtgtgtgtgtaaattttctgccagcattctcttctctctctgatttcttcctcctcactggctggccataaccagaagccagaggcaagggatgccactgatgcagttcttaccactcagcctcctgcacacagacacggaggtgggctggaaaaggttgggagtggatattcagaatggcaagaggaagatgtaggaatcttttgaaagccattgaacaagactcaatgtaataaaaggaatatttcagacataaatctaacagcagttgtgcaagttgaggagaagaggttagaagcaaggaaatctgtcagggagatcagattagacatttttcacagagtatattaataaggtcctagactaggttagtggcaaagggaatagaaacaaagggataaatgtgtaaggcattgtaaagtattgtcagtaattcatatggccaaatttgcgtctctctttgtagtattatcttcagatttagacttctaaatgtcataagatgtatgtaatttgtgagtttagagtttgacaacatctctcttctttaatcatttaatctaatgaagttttccttttctctttattttgttttttgattttcttatttgatattcagttcttgttgaggatataacttagagctttagtaatttagtttcagagttattaacacttcacagaataccaaatgagagttcaaaattcaagttgttctttgattgtattaaatattttcttgatgtaactaatagtttaccataaattctaaaaatcaaactagtttaatttctctatttcttataagtgaaggtgcacattagatacatatcacatagcaataaattcattttatgtgcaaacaatgcaaatgtctatctaaatctataaggtctatttatttttgttttatgtactgatttatcttcagtacattatatgcaggaattgtctgtcagaataatctacacagctcttagtggctgacataaaatcctacaggtagaatagcttagtttcactccattatatgatctttttaaattcaaaagcacacacacacacactctattttgggtacttgcctgtcagggaaacttctctgttttattctctgcaaaaagataaagataaaatgtaattttaccaggagataatgccaaccgaagagttaaagtcaattttcattcccttctcccttaacctacacttcaacctgactgtaccatattattttgcaagaataaaatttctattggcctaatcagatacctccaagcacttcttcaattaacccttacgttgtggaaaccaattcaaaaggcctaggggctggagcctgggaactgttcgtgcagtgttccaaataaccatgtggtgtttaggctcacctgctggagaagatccaggtgctcctgggaattgctgaagttttttccaatgtcaaagaggcagaaggtctcctgctggcagatgctgacccagtcctgatattcccctgtgtcagggatgcgatccagaaagatccgatatgcttcccatactgcttcctgacacactgtaatacagagtcattaatggccatgccctaagagggtccccgtacccaatcccaagcaaagtctaataacatggaaaattatttcatggcttatgtcgacacactaatttacagtctctaaaagttaattcatttaacaaatatttattgagtacttactatatgctatggagaaaaaggaaagcaagaaaatagggaatattatgtgcgtgtgtgtgtgtgtgtgcgtgtgtgtgtgtgtgcaaaactgcagtttaaaatagagtggttgaggaagacctcactataaaggtgacttttgagccatttgggaaaagtaaagtctcccagtttgtggagtgctaggggcactgaaggagcagggaggatgtcactgtggccagagcaaggttgagagtaatagaggatgaagatagaaagatgtggcgagggccaggcgtggtggctaatgcctgtaatcccagcactttgggaggctgaggtgggcggatcacctgaggtcaggagttcaagaccagcctcaacatggagaaagctcgtctctactaaaaatacaaaattagctgggcgtgttggtgcatgcctgtagtcccagctacttggggggctgaggcaggagaattgcttgaacctgggaggcggaggttgcggtgagccgagatcgcgccattgcactccagcctgggcaacaagagcaaaactccgtctcaaaaaaaaaaaaaaaaaaaaaaaaagaaaaatgtggcaaggtgaacacagattgtgtagggttttgcagaccagcagtctccaaactggagtgcaggtcccctggctgtccttgaagactttccaagtgatgagcaggcacacaatatttaaagagaatcaatttccaggtgtccattttcctgtgcaggctttcctaaaattggtctctctaaagacacacctctttgttagtacttcccttttgatcacaatcctttccccattcatccatccctattcttattgtggcacggtgcctctaggttatcacaccaaggagcaatttgcagtaacaatactgagtttgagaaagggagtgaactgagttgagggacaacacacattttggcagtctaggtgatttatgattctttgctttcaacaaattaaaaggagtcctaataggttgacagctgattgatagatcattaaaaataatgatgacagatcatgatgtgattattggcatataatgacaaaggaatttaaagaataagaacagtgctgtaacaaaactccatctgttcccatctacttatttatgtaaagaagttttctcaacacctaactgaaactaagtaaaataatagggataaaattgatgttaaagttttctcaacacctaactgaaactaagtaaaataatagggataaaattgatgttaaactttgtctcattttagcaatgcacaatataaataacgactaattgtatatgaacaattagaggagcaaaaccaaagcaatcactttgatccagaggcagaagctaaggaagcataagctacagatccttttttaacactgatttcttccaaagccctgtttagaatattgcatttgcaattttgtatttacaaacattaacacccacaaaacttgaatctcactctatatccatccatcaataaaaactaaaactatatgtgtttagttttaattgattatatatttaaaatgataaatgcaactgaatccagaagaaatttctttttacatataaatcttatagtcacaagaaacaacgtaattttaatttatgttcatatttttgttacaaaaaagtattttagagcaatcaataacaaattttcaaggataaacataaattacattaaaatgagactctgaggagaaaagtagaatggaaatgtgaatgtgtggagaaaaagtaaccatgtgacatttcctactgttaagaagaatttgctcacgtatctgttaaaagaatttgatggtaaatattgagtggctatggtagattctactagatacatgagaaagatccaattctagttttattttaaatatcaatatttacaactcaccaaaaattacatcctatttattaatttaaacttgacaaaaaactagatgtcaatggaaaagcatgcgaggggattatatagctaaaaattgttttaggggattaagagagcaaaaaatgttggaagcctccctataagcatttgtaatatgttgatttttaactctagagcaatggaaacaattggagcctttagggcagaggctgacaccatctgacttactgaagaaacacttaaagaaacactgctgtgctgagaaaaaggaccgtggggaggaatagggtgagacgagaccaatctggagactcttatgcctatatgttattccttcctccccacttattccatgtctggatttctcttagctttctgttttaagaagaaaattccagatcaacagaagctcaggtcatttaccagcagcaacctgaccagaaccttcaaggtaattgatcttttaatgagtaacccacaaagacaggagagggtgcagtcctgaccacctcaaatgtgccatctggtttctcacactgggggaaataacagggtgtcaacacgtgggaagcaatggaatacctcaccttgcagaattcatttttgtgaactgtctactgccaggcaaggatcaagaagttttaatgccttttctgatacaaaccagcaagccgtctctgacccttcatctctggtcaatagtctacataatatacaagaaggaaacaacacttggatgttttcagatttgtccagaccctaacagttgtatgtccagtctaagcaaaccagctgcctttgctagccttctttcttacatattccacactctctctggggatgttattttgtggctacttcaattcaaaaccagtataagtgtcagagatacaacaatacataaaataaactagcactgtctttggtgactttcatggacaatatctaagtgttggtgactttcatggacaatatctgtgtgtgaaacatcggggaagatattatgtgacaatctcttctgtttacaagttaggcacaaccttgagtgtgttgcttttggtctccgattaagacttgcttttatttcattccaatttaagtcttgaactaattgtgttcttcgttgagcctagctgctcccagttgagcccaaactcagactggcaggcatcataactgatgcagacagatgtatacagaagttcattttcctgggtgctatgtagcctgaggatgcatcatcagttatgcagagatttctgcaggcagtccctgtcatatggctgcggggactgaggttgagcagtcaaataagaggtactatttttgttgtgtgcatcttcctagttctgctcctttccctgatgttctttctcctaccacaggacacagaactactcaaaaccttccataagggccctgaaagaatcttctttctagagcataatgtctgaagttgcttgaaaaattatctccctgtgacattgtagtttatgggaatcataatgttaaggatgaaatctcagactctttctgaggggcaggctttctttttttgtggctcctctgatgttatttttctcttggaagcttctcacaagccaggaggcatagactctttccatgattggaatcaccagcccacttacccaccaggatagtcccccatccttactggggaagtatcaaaaaaacccttgaaaattgaggcatcaaaggacctcagggctgggagggacctgaaaacttctcaaaattggatttttgtaaacctttgatttacctgttctgtactatcctcctttgaacctgctgggagggactgccacagtgattctagagaaatccagcaccttggcctcactcccaccccagtcttcccacagttgccggccaatgcctgaaatctgatcacagaacatcagcttctctgtcaaaggtcatatcctaagtcatttgatgatgcaggaagaaccccagggagcacataccctggaggccaggcatggcagtctgtaattggaagtcctggcctgcagacagttattcgcaattagtattgttagaccaatggtatgtgaaaatgcacagtacagggttgtgcacacattagagggtgaaataacacactgaaatgggaatcaggacactgagttctacccccgttctgctgccagctgttcccctgaacatgccattttacttcatcagatctcagttttcttatccgtacaacgggagtgttggctagatgttctctagattagtgcttctagaactttaaagtacaaatgaattttacctggggaacttgttaaaatgcagattctgacagtaggtctggggtgggatgtatgattctgcatttctaacaagtttccaggtggtggtgatgctgttgatctgcagacaacatggagtagaaagaactaggaccctatccatctttaaccttctctaaggcacacttaaatgtgaaagaaagatctagctgtttttttttttttttttgggacggagtctcactatgttgcccaggatggagtgcagtgacgtgatcttggctcactgcaacctccgcctcctgggtttgagcgattctcctgcctcagcctcctgagttgctgggattacaggcgtgcgccaccatgcccagctaatttttgtatttttagtagagacagggtttcaccatattggccaggctggtcttgaactcctgacctcaggtgatctgcctacctcggtctcacaaagtgctgggattacaagtgagagccacccacctggccaaggcctagcttttgatgttgggtatgggaggcagagagggagggaaatagagggagagacacaggtgaggtgacggggatctgaagggaggcatctgtatagcaggaaatttggctggggcacagagttcagcctgtagattagcagaaacacacttgcctcttttgcatttgggctttgagataagcacatttatgattctaccacaaagctcagaacatttcactgcgttgcttttaagccctgggaaatgaaataattcaatgttccatttgatttgggaatatgagtgctttctctcctaagtttgaaagatgtcaatggataattttgtaaaagtagcaacaagaacagtaagtgggtctctctgtcagaggaaaaccgctttgtagctgggtcttatttcttgtttctttgtgaaccaatttgttcgacttaagaaacccatgctgatgaatagtaaaatttcatattacctaggggcagccataaagataatggactgtcattgctgtggggagaaaaacaatggtttgtttcatccagggaaacaagaatgaaagaggcaacctaatcaagaataaagagctgagaataaaaattcagagctaaaaattttgttgcagcaataaatagggtattccaaatacttccagtgaatcctatttgtgaatgttgtaaagaattagaagttatgtgaaaataggaatagttgcattcatattcagtgtgatgcaaatactgtatgtacgtccatccctgagcaaacgatatggaatttaccagggtcattatctgatcaatgtgtaggcacactcgaaattagtaatttactcatgtcactgtcttttctctattttcccaatgggctctttgcattctgtgtccaccaacaagcattggctagtacctgctctgtggagatgcccttctaggaccttagaatagtaatatagtgcccttgattttctacagtgagagtcctctttcagactgtgatccagtagttttcacttttctatgggtgtggcttctttcagaaagtgaatatctttttacttccacagaaaatgagacacataaggaatataagacttgatatttttgaaactgttagttaattatgcttccaaaacccaataataactcttcagattaatttaacttgggcacatctaacaaaaatagacatccaagaagttttctggatgttggtattgtgaaatgggtactcagttgtcatagtgtacaacacatcacaggctggaattgaacaagcttgctccagtagatgggctttaaataaagcagggtggctctgctttttgcaatggaagcaaacatctagtgtgatcaagatagaaatcagtaaaactctcaactttcgcatgtaagataaattgaatttaagactcagagagacaagatattttgcattatttggagccacctggggaattttaatagtagctaccaaagatttgtttttttttcttttaaaaaagaagccatgagaattttgtcatccataggaagttagtgaaaagatagtcactgatggctgtgctgtgattaactccttaatggtttctggcaatgccatcagaatcctgtgaagcagtcttggggtaaaaagtggactgtgactctgctggaaaccactgtaattgtgttgtaaattctgctaacactcttgcattatatcttggtaaccactctttatttgtttctcctctgcacttcaatgtgcctctaggtttccaaactttaaaagtttctgctggatcatcaatacacaaacttataagaggatctggattgtaatgttgcttttgaaaaatgaaatcttaagtcatgaatcaatttgcttagattcctgacattgcaatcatcctgtacttcttacccatatgaacaacattaaaatggaatattgagcattggcaaaaataaaaaataaaggggtaaaatctggatgccaaggttttctggtgatttctaaatgccctattggttctatgctgcacaagatattattttaaaccataagagctgatatctaccatagttttgaatgtttattattcattactatcagattatcactaggttgatttttataattcttgtggctaaatgacagaactggaagttttaggctaaagacaacctatggatgaatgaaagggaagggatggaaataacacaaggctaaacggtttcatctctttccttacctctcaatctataataagcttgaagactgtctaaaatctgtttcatggattcctgtggacagactttaacccccgttgggaaaaatgcggatctttttgttcgatgctttgccaaatcgaatattcgtctcatagttgacattttgtacattttttcagtactttcagttgtttcatttcttgggggattgtctatgtctttagtttcagaatggtatatgttaatggagatatctgtaaaagaaagattgatatcctggtgaatatatacatttatgtgttatatgtgacatatatggataaatgactgaaataaactgaaaattataatcctttagtttatgaaatttctaccgtggtgcaactgctaaacgtaatattccaaatgacaaggcattttcagaaataagagaatagtataatgagccgatcaagcgtatttttaaaaagccaatgtctcaaatcatcttgcctttaggaactgccaaatattgaaaccatttcccacacatctttctaaaaatcactccccacttagcactcaagcctctcaagagatgtctcttatgatagataatataattcaagcagggaacgatatagcattgtggtgcccagaggtgtactgttgaggaagtggagtgcttctaaaaacctagcggaacaatgcaacaaaataaccttcctgcctattagtggtagccctaggaattctatatgggcagggctcagagcatggcaatctggctgagagtggattggagcaaggatgtatcttatagttgcatttatagtacaagctttgccgtttcatgaaggatggtgagaggaaggataaagggggaggcttcacccttcccaacaagggggaggctggcagagaatgtaactctcttctaagccatttcatcctgctggcatggctggtatctattagggttaggtctagactgcatttttaactttctggacctctcataataacttagattcatcaaacactttttaattttgaatttttatatgtattacctcatatcctcacaaaagctttactacatcgatgaaacatatcatttttctcagttcatcagcatttagggtactgaggctcagagtggcagtgtgtgttaacagtgtagtaagatctaagttacatataaatgtgaaagaaagacctagtttttgatgttgggcttgggagaaagagagagagaaggaaagagagagtggcagagagtgttaacagtgtagtcagatctcaattcttcctcttctactccatctctttccttttatccattctaccattaaaaaaaaaattaccgatgaacagttgggacctcttactatggcctcttgagactccaaacatggggcttatagagatttataatcccattttactagggaaggctctcaaacccatatcttctgaaatgtgataaaaggggaatccaagcaggatagctgaagagcaatttaaatcttgctgtaaagcataaaagtccctcaatattgtagagggtggagaaagtccgcctgggaacacatattcctgtcactttgagaagtctcagagtgccctgtgttcctcttgggcagaggtacattcttaggaaagaatctccaggaagggaggaaatttatagattaattggctcacccagcgacacactagacccataaatcataatctctgtgtagaatacgggcatcagcaaattttgaaaatccttgggtaatttcaacatgcaggcaggtttgggaatcactattttatagatctactaacatgcttccagataaagaatcaagatgggtgcatctcaaactggcttacacagtaagaaagttgtcacctccaaaggaaagccagaggcagggaatgcctggtggaaatggaggtctggctctgacttgtctggttctgtcccttcatgtggtgatgtcatcctcgggcaggcttccatcaaattcccctgatgatggccagcagcaactggatcaccaccttgactctcattcatgttgaaaaatagcctttcccttaggtttggctgacttaagccatgtgcctggagcaagaccagttgcaaggcatatgccagtgctatcggcttgatctgaataattacaaggcagggaactgggattacttgaagtggctcattctaaccatggagttggaaccagtttttcgtgagtcaaaatggctgcatggcaaagtgaaaggtgcccattcaatctaggggcaaagtgcaagagagggataggagccgagcacacagctgttagtacccattacagttagtaaaatgtgaatttttgtttaggaatattaattttaataatcctttcaagcagtttatagattgcaataaacttgtcatagtaaaaagtaagtttttgttatatttgaattgccatttagaatggaagaaaaagctgcctcattgggtacttctaggtctaggcagtgtaacacagaccatatttagggagactgtgcccctacatgcctgcccttctccattcttctcactgtgcctgcctgtaatgtgtggggtcctgctatcggcctggtcctgttccgtaccttgtcatcaccacagtctttgttcctttggggctggtcctgttcttactgcctaatgttatgccctgtagaactctatgagtaacttggcttgggaagagtatctactctaccctggctctgggaacaatgttgctgtcctggaatttttttccaggtggatccttttggatcctaacactttgcgcatatccaggctcgctgacagagatcctatttgatatgagtctttaggtttcatcctatcagggtaggtaacttgacttgggaagagtatctactctaccctggctctgggaacaatgatgctgtcctggaatttttcccaggtggatccctttggatcctaacagtttgttaatatccaggttcactgacagggatcctatttgatatgggtctttacgttttatcctatcggggtaggtgcagaagcaggggcgagaaggtcacagatttgccctgtttctcagcacgtccatgagctcccacttttccctttcccctactagggtcagtatttccctattctccacatgtcagcaagtacacacagctgggggtctacaagggtgaattagggtaatgtgaacccatttgcctgggataccccagtttatagctgttattctttcattctcaaatgtgtccctgtttgggaaataaattataaggtcacccagttttaaatatctcctgctggagaagacccaagacaaatgttctacaaatggttgtttctttcctctaggatgtaccatgttccacttttgagtatctccacttaacaaattccttcctttgggttgaaaattactttctgataactttcacatcagtcctatttctgtcgtctggtgcagcgaacaccaagctacaactacttccataaacacttcctcatatttttcctactttaggttctcttggctgaacaaacaacctccatctttttttttttttttttttggtataacacaaatattagataccttgactactctgtttctgtgacacaaaaccaaccacagagaacccccctgtgatgatgctacagcttgagctgggattagaatcttttgtctatgcctctgccccatcctcactagagatgaggtgagagatcaggaacttaggatcacttgagtccaaggatgacaggccacagtgacaaagtctgtttgttacagatttcagtgaaataaaaagagctgatagttgttggagctaatgaaagcacccttgagtaaggcaattagaccagatcagatgctgttctccagtcctgcataaattgtaatgttgttactgaactgaacttttaaagattctttgggtcacttttatgagtttgatatttttggtttatataagtatttgaaaagaggaggtgaaaatttaatgagaatgaattgatagttggaagacttgctacaaaatagagtatatttaataaaagactggaaatttttttgaggcaggaaatctctaagatgatgacaaaatgagtgtaacctacttgatgatgaattggctgccatcaacaactgtttctgaataaaattcaaagttacaaagagaagggcaaagtgatttcagaaaaaaaaaaataaccacctttactttaagttgaaaattactttctgataacttccatatatcagtcctatttctgccctctggtatagcaaacaccaagctacagctacttccagaaacacttccttatattttccctactttaggtagttctaaaaagcgtattggagtaaaataatattagaacagtttaattaaataaattatgaattaagaaaaaaatataattgtactattttaaattatagattaaacactaggaaaacaacctttaagccaataggttttggaaatagtcatatcattgaataaagaaaagatagaaatggaaagtaatacatttgaatattcagaacttctaagtacagatgaggaacagctgtaatacacatggtgcttactttctgaatttaacttaaatatgttcattacttatgaaagaaaaaggtagtagcagcacaaatcatataatgtcactcaactattcaaaatgttttcatagaaccaatggtacacagggcctggagctgtcactagttgtataatgtgggtgtacttgacatccaagtacatcctgagtttcttcacctataaaatggggaataataatacctcccttacagggtttctgtgatattaaatgagttataacatgggcagcagctaaaacagtgtaagacacagtgtaaacgctcaataagaactcctttatcagataatcgagacatttcacttgctggtatcactcttcctttccttaccccccttttcttttagtaagatctctaaagctttattcaaaattttcattagtcagtagaataacattttataaatcagtgaaaacctgtacctacaaaaattataaaataaaatatcagcaatagcatgaaatcacacagtgtaaaattagacatatttagaactggtttgtgggaaaaatgcacctcacaagttttcttaatatgtcatgggttagatagagtgtttttgttaccagcatagcttagctcttattcccactctgccctaccactcttcttttctaacataccctttcactgtgctattcctcagtcctcagacagaactatgtctatgccctgaagtcttcctgcttccacactgcagtgctcatcttgtgtttgtctttcatatgggagggcccttctcttccttctctgttgttttcctacttttcttttaagagccagtgaaatgttacattctccactatgctttctcagatcccacattcagaattcattcattgctccctcctgttcctccagggtggttcatatctctatggcattcactgattcacctgtattcactaagcgactactgtttcaggtccactatgggacatagctgtaaatgagataaacaaatgccatgaaacttgtgttgtagtgcttcctttgtcctgtcttgaatactaatttgttgtaaatatatgagtttctccctttagactgcaaatacctttgggatctgtattgtaatcttgccctcccctctccagttcaccttggtgcttgcctagtacaatgttttgtacatgacagagatgcaatacatattaattaagtgaattaatgaaaaatgtgtgtggaaatattaatgggatttttagaatatatatatgaattagatttgttttaaaaaccattagactatgaaaaaatgcttcatgtcttgcccgcatccattattgcaactcctctttgaaatttctgtcctctttttaagtatctaatatcagaggcttaggacacagtcatcttattaaagataatatcctaagtgaaaaggcaaataaaaattcttttctaaataaacaccaaaagaccagaaaagagatggtttatatataaagtatattttagtacaatctgcattcccagacactttcaatctttccataagtaaataatcaatgggaccaattaaatatgtggagatcaatgaggaagactatcattattacctggctcttgaggatggcaactcccttgcccctcaattattgtacttgacaggcaaagccataatcatggttaaattcaacccactgcctaccccttacctgaatctttgtatagctgatcatggctggagaaaaacaagcattagaacacactttaaatttctggtccttaagtaaaatcacactatatttctctagtctgactcagttttgtactgtcctggggagctacacacttttctcagatttctggtaccttcttgctgattctttctcttagctgatgagtttgcttcacattttactgaaaacaagaggagccagaagagaacttcccaagcatccagcacagcatctgctcactgatcactggctgcgtctgtgatcatagtctatgctttgcctcctgtgactatttgatgattggtctgtgctcctacttaagaccaactctccacttaggcagcaggtcccatcctttttcacctttcaagaacattcttccagaaactcttctctcactttcctacatcattttcccttttgctattggattatttctagaagcacacaaacacgctattattttacctctattaaaaaaatcctctctctatagcatgtttcctccagatactagctcatttttctgtttacactgacgcaaaactatttaaaaagatctggctttttggtgtggcaattcctcaaagacctaaggacagaaataccatttgaccatttgacccagcagtcccattactgcatatacccaaaggaatataaagcattctgttataaaggcacatgcatgcgtatgttcactgtagtattgttcacaatagcaaagacatggaatcaacctaaatgcccatcagtgatagactggataaagaaaatgtggtacttatataccatggactactatacagccataaaaaggaatgaattcatgtcctttgcagggacatgggtgaagctggaggccattatccttagcaaagcaatgcaggaacagaaaaccaaatactacgtgttataagtggaaactatatgatgagaacacatggatacacagaggggaacaacacatgctggggcctatcagagagtggagggtggttggagggagaggatcagaaaaaataactataggatactagacttaatagctgggtgatgaaataatctatacaacaaacctccatgacactgttttcctatataatgaacctgcaaatttacccctggacctaaaagttaaaataaaaaaagatttgtctttccctccttttccaagacaaaagcaaggtcctagtgagtgaagatttcctctgataccacatgcatagataccaatacctgccccctacctttattctctctctctctgtctctctctctttcattctctttatattttagtatttgtgatgtgcttatagagcctggtgtattcaatgtgtggatatgacacttcaccagaaggtgtgactatctaacacacaatatacagaaagtgacagtaaactaaaactccactgatcgcttctgtgaatttggatattgacatttgttgataggggtggtggtgagggtggtggttttgtaacaaaacagacaatttgggaaaaggcagagatctagcacagtaggatgggctcccttgagctgggagggtcttatgaaagacctggcaggtagaaagtatttaggggggcataaaggaggacaagatattggtgggcagggaaacttctagcagactaaggaaaatggttggcaccgaaggcttaagttggggaggttggtgttatttatttatttattttccttttaaaatttagccactctatcctggagctgacctagattctgcaacccagtgtaactatgataattttggaaatttccgaatatatagacagggaaattaaaggaacaaccactgaatttaaacactttcaaacattactttatcctaaaaaacagtcaaatctgcccaaggatgtgagtggcagttctgaaatactgggcttttgactcttcgtttatagtttaaaaattaggtttgggccgggcacagtggctcacgcctgaaatcccagcactttgggaggctgaggtgggtggatcacttaaggccgggagttcgagactagcctggccaacatggtgaaaacccatctctactaaaaatataaaaaaaattagccagacacagtggcgcacccctgtaatcccagctacttgggaggctgaggcatgagaatcgcttgaacctgggaggcggaggttgcagtgagcagagatcgtgacactgcactccagcctgggtgacagagtgagactccttcaaaaaaaaaattaggtttggatcacctaagcatgtttattagctactgtgaaagccagccctttggtcaaagtaccattttcactctaggttgaaggctgatggccatgtgaccacaatgttgactggcatccctgaagacataggccacatcatctccttgtcatatcactgaagagcttattatttttttccttccagtaccaaagttggcttctagacataggctgcttacaaagtttctatttcaggctcagctttgcccacaagtcattctctttcttggctacatattcaagtggatacttaccaacctgtttggaccattcctcaccaaactcttctagaggaaattttttttagctatttaaccttgtaggcatacagaggcttactgtacacatacagtggcaatagtagacatcagggataagagaatcaggctttcatggtagcattgctatgaaagcaacagccattggtataagcacttagcaaacccattatgtcttcctaggggaaaaggtctcaatgtcttaatgaataaattagcacgaccagagacaaaattcactgtaatttctacagaacaaaaatcataatttgaggaacagaactctatagagagtaagtaggtaacatttcagcaccaattcaatgactggaagttaaaaaaaaaacacaatttaatctttcccaaatttttctaaccttactaaaaaaagtgagggactatggtgtttctgcaaatgtttctcttgtttgagattcattatgccctggtcctcccactacattagtagattctcaattacacacctgagaaatttttcccaaagagcaaaagcaattaaatacaaatcgtgcttaacatacctgaatatgtatcaacaaattatgcaggttttctgaataccttgttcagtctatcccagaagactgcatggattttaagcatactgttttctaggcaataaaatggagaacagagaagcttctacaacttgctgtcccacttgccctcctacaggtagttctcaacaaacttatacaatgccagccccaatctgtggccttagaggcaaaagttgttggaataaatgatgcaaaagaagatcatagaaagtaaggaaacttgtagttatttcttttaatgaattagaaagtaaacagactttcacaatcagcatgcatgctgattatcaataatgcatggggtggatgttataccatttccctctctgtagcttttgaaaattggatgccatcactgtcttttttacctcccaaactggcatttgttcagcagcagtaatccctgctgaggataaaaatcagcagtctcttatctcaaataattagagtggttgcattattttttctcttcttgcaaaaatcaggtttaaccatcagacttgctatgtcagaaggaaatggttaggaccttggcaaacccttacaagaaataagaggttgctagtgcctaccttctattccatacgtgtacatatgtactgagccctacctcattgcacacacacaagaaaaaaaaaaagaaagaaaaggaagaactaaatctattggtggcatgctgagttacaaacataggcacttcttgctgagggcctatgcagtgtagtgagtgggtaggaacagaactgaagttgaagggagaggtggaaaaggaagttgcctctttcgtgcccagaggggatgaccctctgaacaggtggaattgccagctgtttaagtctggtaaatgtcagggagtgaagaggtaggagtctagcagggccatgttttcaactgtacccagaacagaaatgtgtgcaaactcatcatccgtcttagtagggtgagagggcagggcatattgagaagaggaggagtgttctttctcaaagctgactagtttctgtgtcctgggaaaggagagaaacacattgcaagaaaagatagtacacactgcctccatttaaggcatgaaatcacttgataatgcagcctctcgaatgacgtacattaacatttagctgccacctgcagaggtgctgttcctgcaagttgagaactatacttctagtaatgggggaatgcctttgcctctcaaatagtggtacaggcgccctcaaggtatgcagtactgtgccaggggttgtgagaaaccataggatcaacacattgcttcttcatggagtactaaatttactttggcaattttagcaaacatttaaaatgttgaggaccacctgaatacataaacaaaatcaacaaatcctttctctacagatgagtcaatcttagaaaatatgagagtaggatatttttataagctgtgattagttgtaaaatgcattatcactttgaaaaaaatggtgaatagagttggattaatgctgaggtgaagttggagtaaacagaatgtgaaactgaggtaagaacagttacactaagattgtcaaccagcttggtgaagatttcatacatggctgcctagttttcaggggctgacacaaataaaccagtcctttctcctgcagctggacttttccatacccctccatcatcctgctgccatctcctcacatgtataggttcaggctgattaagccactcctaatcatctcatctttacattaactgaagttccactaaccttttttactgctctgcctcccaattcttaattatgtgtactttttggaaaccatctccataagtttcagaatgtggagtttaaataagtacacaggttaccataagagaatctgcatggaattgtacaagtaaatctgagattgtgattgtacctcacaaatgtgagcaacactatgctttccagagcactgttatagcctaggttgacacaaagtttggaaaccaaggggttatgccagaaagtgccaggtaatgcatgagccggaggaagattcagcccatgatatttgaagctgacttggaggtggatggggacaacaagtaacaagaattcagagacccactaagagcttataaaacaaattccaaaaaattcaggaggaagctaacttcagaagctgaggtgtactgaggaaatattaggggaaaggaatgtggatttacttatgagacataatgatttgtgccaaatatccactttacttctggttccagctgtactgaggtgctgaaacacaaggtatctttcttcctgtgattgctaagagtgctacatatttggggacaaaatttgtatcatccgattcctatcatatctgaagtacttatatcagagtcggctctaatttagcccagcatctctgttttctggaagtttgtgctgtccatgattataattttacaaaccacacactactctttggttttattgctatcatgtaaacttaatcttggagtatgttgggaattctcagtaaagacaattgcatatatatagattgttgcatatattacaaaaaaagaatgatattctaactactcaagcagagcagaattggagcagatcaaacagaaacagctgtatatctttgcctgttaacttttggatggataaggacctatcagttcctgcagaaaagtaaggtaaacttcattttgggtacttggagactgaagcataggaagagcactctgccacttcctcaatttgggcaaataattaatttctatttgctctggtttgtaacttgaaaagtagataataatatttccaacactatagtttttgattagtgcttgcttattatgtagttgtattttgaaaattaaatgagaaaatagatgttactgttttgcagagagcctggcacattgttacctgttattatgatctagtgccactccattctgaggtttagtgctaggcctggtaggaattggattgcctgatttagcaaataaaaatataggaccaagtcaaatttaaatttcagataaattttcagtaaaagtatgtcccatggaatatttgggacatagtagatgcatatggacgaaacgcacctgttaaaagacagtgattgtcagactacatttaaaaaggttcccatgatttgctgttttaagaggcatatttaaatcaaaagacacagaggttaaaatgagaagaatggaaaaaagttataatagaagaacactaatcaaaagaaagctgatatattaaaatcaaatgaagtcagagcgttgctggtaaatattaataaccagctctgggagatgggtgagatttgtctcatctgctgctttctgtgtgttaatactctttcatgactgatttcaagccaccaatgtgacataactgaacactgagtttggaaaagatgtggccaattggctcttgttagtacaagccagttccagcaaaccagtggacaaagttcattattaggcagaagacattacaaaggcaaagacagacaggtcacaatgataacagtttaaaagtcatagaaagttaaaattctatgcacttaataatatataaatatataatacaaaggttgatagacaatacagaaaataaaatccaggataatagtaggtacattttaagatatctctcttaattgatggaatgaacaaataaattcagtaagggtagggaagatttgaaaaacatgctcaagcctgacctaatggacatgtatgaggcatcatatctacaagctataaaatatgccttcttttcaagcagagggaaaataaacaaacattggatatatactgtactaaaattcaaatctgaatacattgaaaaggactgataacatatgcatcatgttctcagactaatagagaagtaagctagaaattagtgtgaaaaacaaatggaaaatctttatgtatttgaaaaaaattattcaaaataacccatatgtcaaagaagaaataattatcgttattagagagtatttttctgaaatgataaaattactatgtaataaaacttgtggaatgaaattaaagcagttcctaatggtaaaatgatatcatcaaaatgtttattttagaaaaaggaaaagctaagtattaatgacctatgcatccatcttaaaagagtggtgtaagaaaacaaaataaaaccaaagaaaattagaaaaaacaaagataacagagagtaataaaatgtgaaagagatcataaatataaatgaaaaaaagaaatataaaagtcaaacttttttggaaaatactgataacaaaaacaggtaaacaaacagatgagattgatccaataaagaagacaaaattaactaatatcagaattgagaaagaagaacattatgctttctacagactttctacaaaatgttctataaacataaaaaagttaacaagacgatataatgaataatgttttatccataaatttgaagtttgatatgaaatgcataaatttgtagaaacgtgtaacttactataactcaaaaagaggtaggataattaaatattatcataaccttaaaaaattgagtagtcaaatatctttctatgaatatctttatctggctttaacagtgggtactatcaaacattcaagcaaaatgtaattccattttcctacgactcttataaaacttgacaaaacgagtatgagaaaaaatttatggtccgagcttgcttatgaatatgagtgtaacaattagaaaaaaaaatagtagcatatagaatccagcaatgtatatgcaatgtatgacccagtttgatttatctcaggaatgtagggttggcttaatatttgaatattgattaaggcaatttatcacattaatgaatcaaaggagaaaaactatttggcaatctcaatacacatagaagaaacaataaatttctatgtttattcatgattaaaaactcaacaaattagaattagaaattttctttacttgaaaatttctttacttgaaaaagaagttgttacttctttacaagaagaaaacaaacaagcaaaaaaagctaaaataagcattatacttaatgatggaaatgtgaaaatagtcgatggatatttgagttgttcccatgtcttggctcttgtgaataatgctgtaatcagcatggaagcacagatatctatggggtgcttatttcattttttgggcatgcacccagcaaaggaattactggatagtatggtaattctatttttaattttttgaagaacttccatactgttttccaaaatagccgtagtaatttatatttccaccaacaatgttcaaaggttcccttttctccacaaccttgccaacacttatctgttgtctttgataattgccatcctaacaagtgtgaggtaatagctcattgtggttttgattcacattcccgtgatgattagagcaccttttcatagctgttggccatttttatgtcttatttggaaaattaactacttgggtcctttgcccatttaaaaattgggttgtgttataacaaagacatagaatcaatgtaaatgcctatcaatgatatagactggataaagaaaatgtggtacatatacaccatggaatattatgcagccataaaaaggaacaaaatcatgtcctttgcagggacatggatagagctagaatccattatcctcagcaaactaattcagcaacagaaaaccaaataccacatgttctcatttataagtgggtgctaaatgatgagaacacatggatacatgtcggggaacaacacacatggggggctgttggaaggtgggaggagggagagcatcaagaaaaatagctaatgaatgctgggcttactacctaggtgatgggatgatctatgcagcaaaccaccatgccacatgtttacctatacaacaaacctgaatatcctgcacatgtgcctctgaacttaaaataaaagttggaaaaagaatccaagtaccagacctgcacaacccatatgcaatgtgatgaggcatgtagcagtggggaccggggtgcttgtgcaccagaggttgggatgtgcagtggggaagagattcaaatctgcttgtgaggtgtgattatatagtagtcatgtagtgcttcctcaaagtggggcttaaattgcataccaaagacagagtataagcaccccggctagacagcctaatatgctatttcataacaaatttaaaagaaagacaaaggagtcttctgtgggttttgtccaaatgggaggggtaaaattccctcttaagggtattgcatttgcacatgcctggggttgaccagaaggactccatctgggttattactcatgagtgcttaagtgaaacccataggtgggggggtggctaaaaccacaatgctaatgttatgttaatgacattataatgagctgggctaaattaaggacatttatgtacctatatgtttcaaaattgagatcatattgtttgtaaaatttttaatataacattgtgtcatctttccaagtcactactagtctttgaaaacttttactttaaatagctgcatgttataaactttaataatcatttagattgtttctatctttttctaaataaaggtgtgcttcagtaaaaataaaataaaataaaataaaataataaaataaaatagggttgtggtttttttcattgtttgatttggtttggtttctttgccagtgaattttgtgagtccctagcatattttggacattaaccctttacaagatacatggtttgcaaatattttctcccaatccataggctgccttttcattttgggaaggtctcatggaaattgattgtaaatggagttaaagtcataggtagatagaaataacattagcaaagacatgaattcattttactctctctgaaacaaagagagtgagtgtttggataaactcagagaaactttgaagtagagagaagatacttcaaatgaagtcaaatgacttctattttctcagtaagtagaaggaggtgataatagtaacagtggtagttgctatagccatcttaggagttagcacttattgagcatctttgtagcagatacctcgttaaaaactttagctcttcaaggcagacttggctattattatttttattttataggcaagaaaaccataaaagggagtaatatttgagattgaacaatttgccaacgtaacaaaattagtaagtggcagagctgttctgtgcagaatgaagttctgtgcaagccttacagcttctgctcttaactacattgttatcactgcttctgtgaatgaagggaaatcatgctgcaggctcaacggtagagggaagttttggaaatctggctaggggactagtttagggaatcagatataaatatgactatggaatagcttgtagggcctagctaactttatagtgcaggaacttgttttgtggcaacactccgtttgagtttctctaataaaacttgtaggctcaggaatgagagtagaaaaagcaaaagctaagttttcctagagtgagattaacaaagccaatgggacagaggtcaaagagcaagatttctattgtaccatcaagaagactgttgagagtggttcagtggcaaactatataggacttaggatttatgtgagcctattgaggcctggaatagcctgaagaatcggacaaaatggcagaggctgagggactgatgttttgataacaggatcagatccaatagaaagaaggcagggaaattattgaaaagggggtgtttcagaatcttatatctccagaggctgaaaagactgcaaatctggaggtgaaatttcagtgttttgatagtggggtggagggagtgatatttttgaggggggtggttttgaagagattttcccattgtgtcaagttacacccattaagcaatgtcctgcctttagatacataacacactgctaaataagctacttactactaaacttagagtttggtcatgggcatttaaaatgacactatcaataaacaactccagttctttgagttcaagacgttacaccttttttttttaagtgaaaaatagaaaccctaagataggttcctccatttctagcacagagctgaaggatctgaccagctattctgagatcagttatgaaaacagatgttagaaatggcccagaaccagcagtcatctggtagtgttagcagaggaaagttggcttttgagttaatagtaaaaaccacactaagtcctctcatcatattatagtggactgattattattaatagattaagtagatgtaagatacaactggatacaggtcacatcccaactttggttctaaccctctcacctcaaatgatttcagaaatattacttggcactctctgccttaggtttccaaccataaatgaacgcaaattagtttgaacttttatttaaaaagatatgttaatctaaatgattgttaacataattactgtccgcaaagtgttttgatcaggtctaaactgatctgggtacaatgggttaataatagtgtcatagtatttcatagttcaacttaattaaatgtatcatttacttgtttataaatgcagcaggaagcttaagacagacaaattagttctacatgtgttattttcttcatgtagttaaaatatttctgaagcagaaacttttcactaattttgaggttctgacttttctccacaaaatttcttttggtttagttttccttaactcttttcctgggggcaattatgaaaatagatgctggctatggtgaagagaattaagatggctgaatgaagaaaatgaagtcggaatgaattaagatgactttacaaaggcacacagaaagacattgtttcctcaagaatgagtgaatgtaaatgggaaaatatttattgactgaatacaaccatatgcttcgaggcagcattgctgttccttagctctttcatattcttcttacattccctatggctggaagagaggagcaatagagggagaatattctccgtaaataattacagcggcacattctgctgctagttcagagcttgacagcagcatttccatatatgaattctcattaccagggctgtgccaatcaacctcatcaactcattgtgagataagcttggaagttgcgttggactcaaagcagagtgcaccctcctcctttattacaggtttcatctgccttggtgctcttgttttgtgaggctgaaatcctagccttggatgaaatgatcttcttagacagagaacttaggtccagtggttgctgaaaactgtccactgtggaagattaaaactcacattttggtcagggttcttttctttcagcaaattgctttgtgtttttctaaggcttggtaccacaagttccttccccacgactgcagaggtcttttctacccttaagcaagaaggggcggtgtggatggagacctcacttacccctgagtgtgatactttataatatagtgaggaggtcaggacttttagtatggtcattacaacatgtattctcaattaaaatataagcctagagactactgtgaaaaataaactttcttgcttcagatgaattattttaaaacaataaaatatatgaaaatgatagtggcaccaaaggtatagagaatctgaatttccagacataattagtatgcaaatacagctgatgttcaaggtggttgcattctcatgattaaacagaaacggctaagaaagtagtaggtcatttcagccctgtttaattagctctcacatgcaatagtcccttagtgacacaagcctaaaggggccacaaggcagcaagtgttttttattactaaagcaaatatataatctaataaatggtttcaggtgtgctgccacagattgttcatttgtacatgaagtatctttaatttacatagtttcaactttaaggacatcctcttagacacagttgaacaagaaagtctgtctgggacctttgaatgacactgacttgagactagcacagatgaacaaagtataggggctgtacagttaatgtgcctaccattaggcagctatctcaggtatgttctctgttaatgaagccacaatgaagcaaaataccttttgtgtaatttcatgaaatgagagcatacaccaatagtaaaggattggcaagaagtggagtgtcttaaaatgcaaattccctgacatctcacagctactaaaataattatcctatcttggtgaactaataataacttagttaaaggtttcatttagtataaccaaatgtaatgtaaaagacacatactaagataaacattatttccattttaggacttggcaagggtaaattttcttttttctctttctcttatacattgaatgtcacaagcaattaaatgaaattatttaggtgaaatggaaaagtaagaacataaaagcagtgatgcacatatcagatgcaactggtatttccattatgaacctcaaagaaaggagccttggtgtctttttgaagtaattgttctttgagctcttcaactgtctttttttgtgctaaaacaattttatttaatgaatattttgaaatcaaagctatctcacctttatgtatctgtgaaaaactacattcagaatctgcaaaacttaaaagaagccttttgaaatattggcatgtctttaaatcattgtatattctgtatctagcacagtattgggtatatggtaagcattctgtagaatcaaattggtaaaaagtcatctaagggcataggaaaacttttgagaaacaatttggcaatatgaatcaaataccataaagctgtttacattgctttgactcaataattttacttcagtgaatttatgctgagtcttaaatactgaggcttatgtgcaaagctctttattgcaatgttatttgccataacaaaataattagtaacaattagttttcttttgttgaatatttagataaagcaaatcttgacacatttactgaaagaaacattatgcagccaataaaatgatgcttgtcaaaattagatggcaatgtagaacatttatatgacataataaaactacaaaaaggctgatataaaatttgtgtgtggtagaactgcaattatgtaaaaattaaatacacatacctagaaaaagtagtgctggcataggttgtgtttggatggaactactattggtaattttcatctcctattttttcaaaactactcatcttttaaaatgaaacgttgaatttagctaaacacccaatcgttatgcttaccagctagttgtgttgaattgaacctttcttttctctccccaaacacttttctatgtaaatacactcatggtggttaattggttacaaataagaaaccagttggctgaggtaaaactttaattaatatagacctcaataattgaagattaacatatattcacagatctaacacatctaagatacttatgaaataaaaagccctaaatgagtagcaagttaggtttttttttttttttttcccctagtatggctaactggagagaatggatgccagttctccttagaaagaagacttggggtggctcacgcctgtaatcccagcactttaggaggccgaggtgagtggattatttgaggtcaggagttcgagaccagcctggccaatatagtgaaaccctgcctctactgaaaatacaaaaattagccaggcatggtggcaggcacctgtagtcacagctacttgggaggctgaggcaggcgaatcgctggaacacaggaggcagaggttgtagtgagctgagacggtgccactgcattccagcctgggtgataaagtgagactccatctcaaaaaaataaaataaaataaataaaatgaaataaattaaattaaaataaaataagaaagaaaaagaaagaagactcaaagttacagttgaatgattttacacagaatttcaagaggaaagtgctggagcctagaggagaactcaccagaagaaactagggcacaggaaaagaaggaagcaagaggttgtcagagatgaaacccagaggggcttggtatttcatgaaaaggattagcgggagtgtttttgtttctccttgccctggtggcagatccttggtatctgaaatgtcagagagctcctctgtcctcatgaacccaaacactggtgtggcagtgatttggtgacttcttgagggcattgcactagtataccagcatgtacagggttgcttgtcctccttctctacccaaactgcagtggcaggcacgattcttgggctgcatccattgaatgactgagttctgcccaggaaatctcagcccttgtgtttccacattgccaattcctcacaggcattccccagcatctgctaaaattgcagcagccacatagggctgggtgactccaagagagctgcagtattcctcttgttccagccctcagggagtgctgctcctaaaggaaaagagtgcagtgcaccaagggagcacccctttgcacaaaggaacccagagtgtgtgctttctggtgctcaagagcttcccgcttatggactgagagtaactgcactgcttctagaggagatgtgggtgttgtgttcagccctatggggaagagtatggtccaccccagcagtcaggcagcctcagtgctgaggcacaggaatggagagggggactactcatctccctaccccacccactgttgtggatacagttgtggatacaggctgctcttcctgaaggttacggcatgtgtaatcttgctagaataaaggacagccattctaggggtagaatggaggacagccattctagggctattgggaattactgcatccctgctggctatgtgcctaccaggctggggcttgcaggaaaggtaaggtgtctccccttctgtcatggagtggcagtgttcctgttgcatagaacagggctgagggaggaggttctgcaccacagacattttagtggagagccatggggcaaccatttttttttcttttttttttttttttaatggccattggctaaattggagcttggagataggcagtggtgtctgtacaatctgagtgtcctgagagctgggccaggaatatgacagggaagaagactgtgtttctgcctgcccaagccatggagctgaggtagctccctctcctcactggggagacctcagcacatttcaccgggagcttcccttgccacccctcttagggcttgtttgtgcctgccattggggtatccaagggtgggcttggcagtccaactccacacagcattgtctctcacttaggtgctgagggagctcaggccactgtgcattccatagatcagcccattgcctggaacaatggagaacctctcctggtaaacaaagatcaagcatatacctatcagcttctgcttcagctggctcttaccagtaagtaagtactacctgctggcctggagatggaactgcacaacctaatacacaatctgctggcacaagtgcacagtgctggcttcctgagacctctgccatattggcaccataggagacaatgaacttgctcacatgcctagtacaaaggctacctacaactaaggaactcatatagagtcattgccagtgaaagcacccagaaccaaagccaaaagactatttttctcccttcaggatgtaactataatgtatatacaacatacattatagttacatcctgaaggggaaaaaatcctgtccaaatgcaaataaattcaaaaatgaaagaagaggtagtttatgcagataagaagaaactctgtgaaactctggtgaaaaaacagagggttacaggatccccaaaagattacactagctctcccacaatggatcttaaccaaaatgaaatctttgaaataccagataaagaagtcaaaatattaattttaaagaagcttaatgagctctaagagaaagttgaaaacaaatacaaagaaatcagaaaaacaattcaagaagaaatttactaaagagataaatatttaaaataaaaaacctgataggatgtctgcaaataaaaaattcattgaaggaattacaaaatgctgtaaaaagttttaacaatagactagaccaagtgaaagaaagaatatcagagcttgaaggcagatttttgaattaacccagtcagacaagaataaaaaaattttaaaaaggacaaagccttcatgaagtgggggattatgtaaaacatccaaacctatatgtaataggtatttctgagggaaaataagaagtaaaaggattggaaaatataatttaggaaattcaggaaaacttccctaattttactagaaatttagacatccagttataagaggctcagagaactccagaaacatccattgcaaaatgaacttcacagagatatatagtcatcagattatccaaaatcagtgtgaagaaaaaaatcctaaaatcagcaagagaaaagcctctaatcacctataagtgaaatctcatagtattagcagcagacttctcagcagaaaccttaaaaacagaagagactgaggtcctattttcagactgcataaagaaaaactgtcaacaataaattttgtaccctgaaaaactaagtttcataaatgaaggggaaataaagtctttcccagacaagcaaatgctaagaaaatttgtcacctctagaccacccctatgagaaatgctcaagggaattttaaatatggaaatgaaaaaacaatatttgccatcataaaaacaaacataaatacaatacaggtgttataaaagtacacaactgagactacaaagcaattaggtaacagttaacagtataacagaaagaaaactccacatattaatattaaccttgaatgtaagtgaattaaatgctccacttaaaactataaaaattggtgaaatggattaaaaaacaaggtccaatgatgtgctgcttataaaaaacttggtaaaacactcatagactgaagctaaaggggtagaaaaaaaattctatgtaaacagaaaccaaaagtgggaaggagtagctatagttacacaaaataaaacagacactaaatcaacagcagtaaaaagagacaaagcaggtcattatataatgataacgggatcaatttaacaagaaaatataacatttctaactacatatgcactcaaaaccagattcataaaacaaattctactagacctaacaaaagaggcagcaatacaataatattgggggcctttaacattccactggcaacactagacagctcattgacacagaaaatcaacaaagaaacagtggacttaaattgtattgtagaccaaatggacctaacagacatttatggaacattctacttaacaactgcagaatatacattcttctcattagtgcatggaacattttccaagaaaaaccgtatgtcagaccacaaaacaagaatcaataaatttaaataaattgaaattatatcaagtatcttctcagagcatagtggaataaaactagaaatcaatcccaagaggaactcaaaacaatgtaagtacatggaaagaaataacctactcctgagtgatctgtgggtcaatgacaaaattaacacggaaattaaaaaaaattgaaacttacgaaaatagagacacaacatacctctgggatacagccaaagcagtgctaagagagaagtttatagtgttttatgcttacatgaaaagatagaaagatcacaaattaacaacctaatgtcacacatcaaggaactagaaaaacaaaaacaaatcacacccaaaggtagaagtaaataaataacaaacatcaaaggagaactaaatgaaatggagactaaaaaaaaaataaaaagcatcaatgaaatgaaaagttgtttcttcaaaaagctaaagaatattgaaagactgccagctagattaaccaagaaaaaagcaagaaaattcatataagcacaatcacaaatgaaaaagacaacattactactgataccacagaaatacaaaagatcatcagaaacttctgtgagcatctctaccctcacaaacttgaaaaccgagaggaaatggatagattcctggagacatacaacttctcaaggttgaaccaggaagaaatagaaatcctgaatagaacaataatgaatagtgaggttgaatcagtaataaaaaaatctcctaagaaataagagcccaggaccaggtagatttacagctgatttctaccagacatacaaaaaagaatgggtaccaatcttactgaaactatttcaaaaaatcaaggaggagggaatccttcttagctcattctatgaagccagtgtcaccctgataccaaagccaggcaaggacgcaacaaaaaaagaaaactaaagaccaatatccctgattaacatagatgcaaaaatcctcaacaaaatagtaacaaatcgaatccaacagcacaagaaaaagacaataaccataatcagatgagctttattccagggatgcaaagacggttcagcatatacaaatcaataaatgtgattcacaacataaacaggattaaaaacaaaaactataagatcatctctttagacacagaaaaagcatttgattaaatatagcatcacttcacaataaaagccatcaagaaactagacatagaaggaacatacctcaaaataattaaagccgtgtatgacaaacccacagctaacatcgtaccgaatgggggaatatttgaaagcatacccctaagaactggaagaagacaaggatgcccactttaaccactcctattcaacatagtgctggaagtcctagccagagtaatcaggcaaaagaaagaaataaagtattccaaattggaaaagaaggagtcgaattatctgtttgctgctgatgatatgatcttatacgtagaaaatcctaaagactcctccaaaagactcctagatttgacagatgaactcagtaaaggtttgggatacaaaatcagcccataatatcagtagcatttctacacaccaataatgatctacaaggagagttacagaacactgctgaaagaactcagaggtgacacaaacaaatggaaaatcatttgatggtaatggcttggaagaatcaatatttttaaaatgtccatactttttttttttttttttttttggagacagagtctttccctgttacccaggctggagtgcagtggcatgatctcagcttaccgcaatttccacccctgttgagttcaagtgattttcctgcctcagcctcccaagtacctgggattataggcacccatcaccatgcctggctaatttttatatttttagtataggtggggtttcaccatgttggccaggctggtcttgaacttctgacctcaagagatccgcccacctcagcctcccaaagtgctgggattacaagcgtgagccaacgcaccaggaaatggccatacttcttaaaacaatccccgaattcaatgcaatcctatcaaaatatcaatgctatttttcacagaattagaaaaaacaatactaatattcatatggaaccaaaaaagagctcatatagaaaaaacaacaaaagaacaaagctagaggcatcacatttatattatactacaaggctataataatcaaaacagcatggtactgatataaaaagatatatatagaatggaacagagtagagaacccacatacctacaaccagttcatctttgacatagtcgacaaaaatatacactggggaaagaagacactattcaataaatggtactgggaaaattggatagccatatggagaagaattaaactggaccaatatccctcactgtatataaaaattagcccaatagagataaaagacttaaacatgagaccttaaaactctaaacattataaatggaaacctaggaaaaactcttctggacattagcctacacaaagaattagttactgagaactcaaaagcaaatgtaacaaaaccaaaaacagacaaatgggacttaattaaagtaaaatgcctgtgcacagtaaaagaaatattcaacggagtaaatagatatcacacaaaatggaagaaaatattggcaaattatgtacctaacaaagggctaatatccagaatctataaggaacacaaacaactcaacagaaaatactaaataacttcctcaagaagtggtcaaagaagacttctcaaataactaaaaacagaactaccatttgacccagcaatcccattactgggtttatatccaaaagaaaataaatcattctaccaaaaagacacatacacttgcaagttcatcacagcactattcacaacagcaaagacatggaatcaacctaggtgcccatcattggttgatcaaaaaaaaaaaaatgtggtatatatacaccataaaatactttgcagccataaaacaaaccaaaaatgaaatcatgtcttttgcaacaacatgaataaagctggagaccgctatcctaagtaaattaatgcaggaacagaaaacccaatactgcatgttctcacttataagtgggagctaaacactgggtccccatggacataaagatggcaaccatagacatttgggactactagagggaagagggcaagaaggagacaagggttgaaagtcttcctcttcagtactgtgctaagtacctgcatgatggggtcaattgtaccccaaaactcagcatcatgcaatatacctatgtaactaacctgcacatgtatgccctgtatttaaaatagaaggtaaaattattttaaaaaattaacaaagaacatgaacagatattttgcaaaaggagacatacaaatggccaacaaacatatgaaagaaagctcaatgtcactaatctcagaggaatgcaaattaaaaccacattgagatactatctcacataagtcagaacggctatttttcaaaagtcagaaaataacagatgtggagaacagtaaatgcttatgcactgttggcagaaatggaaattagtacgacctctatggaaaacaatatggagatttacctaagaaccaaaaatagaactaccctttgatccagcaatcccactgctgggtatctacccaaaggaaaataaatcattatatcagaaagatacttgcatttgaatatttattgcagcactattaccaatagcaaagatagggaatcaaccctagtgaacgttaactaatgaatgaataaagaaaatatcgttatatattaatggaatgctactcagccaaaaaaatgaatgaaataatgtcttttgtagcaacctggatggaactggaggctgctctcttaagtgaaataactaagaaacagaaagtcaaatatcacgtggtctcatttataagtgggagctaaataatgtatacacaagaaagacatagagagtggaacaatagacactgggcattcaaaaagatgagagagtggaaggggaatgagggatgaaaaattacccaatgagtacaatgtaccctattcaggtgatggttacactaaagcccagatttcaccagtgtgcaatatatgggtgtaacaaaactgcacttgtactccctaaatctatatttaaaaaaaacaagtaacatgttaggattttttattatgcaattactggacattgtttcctagaagtaagcatataacaaatggcagttttcttgataagcttatttcatttcaattcctatatgtataatatattacatatattaaattatatgtatatgtaatacattagaattataattatatgacatataattgttatatataaaaattatatataattatatatttggaattgtgtataatagctgatatgcaatatatgaaaatagaaaaaatcgttaaattaacagaattaatgtaacaaaaaatttaacacagctgaattgcttgatcaagtctacgaaatagtcaaattggtttacttcatcagattcagttcagaatataccaaaatctcattatttatttctaattaaaatgattttataaatgtaaatatttatatataattgataatttaatgaaaaagtaaataaattttgcttctttcactattgtgaaaacatgaagaaatcttttccagaaatttttttctccctccaaatgcaatcactgagaagtttcatataacatgactgatggaatcacagttattttgtgacttacacatgcaatgactattaattttactttttcatggatattccaaaccaatactttagttaaaatgtttatcatcatgaagctatgtcattcttaaagaaattcttaaccttattgacttcaaatgtcttaaaaagattgagtatattatgataggtaggcttatccttatataaaaaagtcaaactttctccaacatgtgtgtttcttttttaaaacacacattatttttcttaaaacatcctgtttgtggcttattttaatttcatattcagatgcagatttgccataagaacatacattgcctagttcttttatgcgtacaacttcaaaaacaaccaaattttgaagtggttgtcatcatgaaccctgaagatgaagaatgtttgctattttctaagggaaagcaactcatgatttcattgtgagaaggtaagaaatacttacttttttttgtctgaccataaatgacttaaaacattacttttatctttaggttttatttgttgaatttcggtggataaatggagttagtttcacagatctactaatattatttacattaataataagaattttcaatgaatgttttagaacagcaaataggatgcattcatctctcctattttgttaatcttcactgcacttaagaccatgtagtaaatattaaatcaagtgaaaatcatttctgatagttaattattcaatcaatcaagcaatatttattcaaggcctactatatactagcccgtgagatcaattggtagccttgttggttctaaatattcacttctatcggtagattttatagataagcaatttaaaagtaaacatttaagtaacttacctttggttccttgaacttggagaaaaatccaaaaaacaaaaatagctcttctagtttccaaatacattctggcttttgtgcattggtaattctgataacaatcacagaacaacctcaaatctcattaaaaagtaacagaaatgtgaaaaataattatatattgataccagatgattgaggataaccttcttggtttacctttatgagggtgttaatttatgaagaacatgtagcagtgtctgtttctggaataatctgcttgtctttccctcaggtgtaatctctgcttaagggccagctggaggaacctttatctcattaaccttctggaggagcatctgtcagcctagctccaggaccctgaatgccattataaacaagtgtctacagacacagttttttcttagttattcacctgttacagtgacacagagagccaggggaagttctgccaaacagagaataaggctgacagttagggtcagatgttttctaaaatgacatgtacaagaaacatccattaaaagagcttaatttctgtccctgaaagtatatggttatccaatatgtattagtctccacagatagcgaaactgtctccattctcttctatgttctgctttataaattgcttttgatttggaattacatacaggtggcttttttgatttaagtctggttttaatgtttaaaatctgtatgcactgtgtttaaggggtcaaatactttttttctacaaagtttgtaagaaaaaattgtgcctttcttctacccatgccttctttcaaaggggagccatttttacttcatcaacctaattcttctagtagtctcatttgcacttctaaataacatgcctctattactattttggaggttttcacttttaggtattatcaaataatagatattgagaataacttcacttccacacataccctttctactcattgtaaacatctttccatctttcttcatcagtattattgtaatttcagtttttgaatatttgattttatattattttgactatacatgctacatattgctgagtcatgaaacacactgcaactactactgtatatggagctcttgtgttgtggatagacattgttcttagagatgtccatagattatccatagattcctcaatatgacaatataaacactgttaatactatctcttttaaatttgaggagaataaagtatatgtggcagagctaggatttaaacctaaagagtctggttcaaaagcctacacccttttttttttttttttttttttttgagatgggggtctcactctgtcacccaggttggagtgcaatggcgtggtcttggctcattggctcatttcagcctcaacttccatggggtcaggtgatcctcccaccttagcctcctgagtatctgggactgtaggcagatgccaccacacctggataattttttgtattttttgtaaagatgaggtttcaccatgttgcccaggctggtctcgaacttctgggctcaagtgatccagcagccttggcctctcaaagtggtggaattataggtgtgagccacgcacctggccaagagcctatactcttcaccactatccttctatgatactttttgcatagtctcattaaaaaaaactttttttagtttctaaatacaaaataataaattatccccaaatattcccctggatatgtaaatctcttcacataaacacttcaaatagtctgtctttcccagggctttctaaccctctccagtctgtattatttaatttcttgtcattgttcatagcagtcatctggggattgcccttcacagtcatcctgaggattccttcaacctctttcttgtgttggatcttgtgatttctggatcctgtattgtcttctttcttaacttaatctcttgttttagcggagcaactgctctagtacattactgaaagtttgtggtaggtaaatttaaaatcttacatgtttgaaaatggtttccatctgccctcatacttgtttgatagtttggctggatatagaattctgggttgaaaacaacattcatttagatattgaaaatgtcagctgtagaaattctaaaactttattactgttgtcttctttctcgtggtttgttgtggctttatacttaaaaaaattccttaaatattattttcttggggtattcagaggtggtcaaagggaatggatttttagctcttaccttcaactacagattattttggtaatatttaaagaaaactaccatcaatcggtatataagcctgcttataacaatgtatttgaaaatgagaaatgaactaggtggaagatgaatctatttttccctaattatatgtagaaaaaatgatattagaatgcaatagactagatacatacttatacataagtatttctaaaatacattcatattagttgaagaaatacttctctcttggtttgctatatagttctatgttatacttacatttctaaccctgttatgaaacatttcttctttctctaggaaagaaaccaacaatttcaatttccgaaaacaatttcctcttaatagttttcttaatgaaatgtgttgcttaaagaaaaatataggatagactaatttgtgttcaagaaggtatcctctatcatagatatgaatataaaagtatttaatttgttttaaaataacaaatatttaaaagtttctcttgatggcagtaccttatgcatttttcctacttttgatgaaaaatctgggtaactaatgttgataactcccacttagatagcaaacaagaatgataagcattcattattcccaagaccatgctttctgggaccatcaagttgttctctaattactgttgtgtttaattttgggtcactgttaattaatccagaattgcttcttcaaggtggttgactgtcaactataattgtatattcttaaagagataggctttcccctgtattttctggcagaatttcagtggtgcatttaaaatgtacaaggtagagtggaaaaggcagtgtatctttgcagatatattccttcatctgaaatcagtagatataaataataagttttatattagtaaattttcacactgctataaagaactacctgagattgggtaatttatgaagaaaaaaagtttgactaacaggcaggcttaacagaaagcatgactcaggggttgcagacaacttacaatcatggtggaaggggaagaaagacctgtcttcttatggcggcaggagagagagaggaactggggcaatgccagacttttaaaccatcagatcttgtgagaactcactcgctatcatgagaacagcatgggggaaactgcccccatgatccgatcacttcccactgggtccctcccctgaaatgtggggaatacaatttaagatgagatttgggtggaggcacagagcaaaaccatatcatgtttaccaaaatgaataagttaatatcacaaagaaatgattccttttgttaatcaaaatagacataattttttgagttcctattaaatataaaactctcaattaagtgctttatatgcatagtatgacattttctcagcaccctcatgaggtaagtactattttttaattaaattttattagagattttttatttttttgtagaaatggggtctcactctgttgcccaaagtggcctcaaactcctggattcaagtgatgctcctgtcttggcctcccaaagtgttgggattacaagtgtgagccactgcacccagctctcaagtactatttttatttacatctcacagatgagaaaactgagagttagagatggtgagtacattattcaactatgcaactaataaaactgaagcaggttttccacccaagatctctctactttcaaagcctatgttctttctactgctcctcactatgttctctctacagggaaaacatgctgagaaagtaactgatactcactggacaagttaatgacactgaacagaagagaagccattgaaaaggcagggtcctatcaaaagttcactgtttacattgatcttttccttcacattacatctactgacttaaacttaggtaaggtgactacctaggaatctagaaagtttctgtctctggaatggtgtagtcttttctttggtagtaggactaatgtcctcttactgtttctaggtttctctttgctcacattattggctgtttatttgtctctccaatccaggcaggcacaggggactcttgaaacatttctatcaccattaaaatgtgtaattagtcaggagtagctgaacttctcatagaagtaatcactactaggaggagcagttaggcactaccatatgtatgaaatctgtaatctggaaggaataggttctattagttatgaaaaaaccctaatgtcctcacctgtatttctggatgttttgaagaaatgcctttcttgttaatagaagattcactatctgtagctcagagagttttcccttcattattattcgtaacttagaaattagggatatactacacagaaacacaagggtaacattaattgggatgtcatctaaggtaggcttccatcccttgagtttaccctctggatccatctcactttggctgtcagctaaaaactacaggattaaacaaaaagcgatttctcagacataatgagggagaaggaagggatggaacctaccaaaagctgactgcactagagcaagaatgaagggaggcaaccatagagcctcaagatgacagttttagtgaggatgagattgatagcagcccaggtacagaggtcctgcatccttatccacattcattatcttctcagaggcctctttaattaatcccagtgtgggaagggttgaatgaccccatcctcttgtggagaaaaagcaggtcagccttcctccaagggctcctaacatagggttctttcctgtcttgcttccttgcccctctccaagttcttggtaataaatacagcaaatacagaataaactgatttagtctgttggtaaacataatcataagccacacactagaaaagcacacaagcaggtaacattttttaaaatcttaaatgtgtcaatctgcgtgtattttgacatgcagatttttcaaaaataattagccacaactgctaagagaatccacgtttggtctcagcaagttacatatattcccttctatatgtggttgaagaagtcatgataaatgttgcacattctaagagcagagtgacttgaattgagagacattaaaacccagtttaaatgatgctgctgaaatatctttgtggtttgcattcctccagtgtttattgtctgagcacttaggcacacggcaaggaagagtgaatagttagcagagtcgagggctgaaaagaaaatcaagaagattagtgctgaggaaactctgttaaaactgtgataaggaggaatctgtgacctttgagaggccatttcagtagcttagtggggaaggaagtcagcctgcagtacattacagattaattggatggtgaaaaagagacagtgagtgagacttctctttatatagtcaaacagcaaaagatgagagagaattagtttaataagctagtcaggaaaaaaaacaagttttttttttttttttttttaaagtattgtttagaggtagagcaagaggcatggtggaagtgtgtagcacagctaagggagaaagagagagagagatggagatcgagttcgagatctgctagtgcaagattttgtctgcttaacaagcacttgcttaaaaagaagttcctgaattgcttcacgtcgtaggactcaaaaaagtgttagagcatgaaacacatagacatatgctctgcaggggcatacaatctaaaagtgatacaatgcatataaagatgatgaaatggggttaccagctcagcacctttcaaagtgatgccacacaaaaaatgctagccaaaccactttaatcataataacaaatattttttgagttttaagcccttcagatgtctttaatttctatattaaccatattaggtgattactattgtcatgttgcatatgaggacattaaagctatgggaggctaaggaagttcttactgtctcatagctaataagtgatttaagcacagtccctgatcacaagttagaaccctacacttattaactacagtcaaaatgagtgaaatgcatgacctcaagtctcaaatagaaattcagcaaagaagccacactccaaacatgctactacaatcttcaatgacttttaattctgattaacaccacagttttaaatactagcataatgaaggatagagttgggcattaattggtgaaattagtggcttgttaattagatcatggaaatgggcatgtactaagtgagattagcaatagttaaaatttgtgaattggttaaaatattttagaaagatttcctgttctgacactagtctattgcatcactcttcatttttaggatgaagttggaagcttgttccttcaagagtcctgttgcctagtcatatctttggaggatgatgaaaatgaggtcacttaaatttgcctctagactgtcttgcatttgtaccaaagaaagctcacgtaaggcatggttggaaggacttcaattttttttttgaaaccaaagtgggatttcattgaacttacagaacaggcagtatggtctacttgaggactacttactaatatgtgctaatttaacaatagtttgcatgtgtggaagattgttgtttgattctttcttttactgaaacctggtaataaggttgtaggagagcagctatctctaaaccacttccaactattagggcccatataacgtactaaacaacctgtctgtatttacctaaattggcctagatcaatttaacacataactttgtgagttttctctataaattaacttcccagtttacaaaaaaaccattcttcaccttcttcttaatactaccatcctgattattaccttcccagacttcacctatctgccctctagttttactgagaaaataggtatagtcaggaagtcctagcaagagcaatcaagaaagaggaagaaatgaaagacatcaaaataggaaaagaaagcaacttgtctctcttcactgatgatgtgattctataccaagaaaaccctagactctgccagaatgctcctgggatggataaacaacgtcagtaaagtttcaggatacaaaatcattgtacaaaaatctagtatttctatacccccaaaacattcaaggtgagtaccaaatcaagaatgcattctcatttacaatagccacacacacaaaaatgaaatatctaggaatacatctaaccaaggaggagaaatatctctacaaagagaactacaaaacgcagcttaaagaagtcaaagatgacaaacaaatggaacaatattccatgctcatggatgagagaaaccaatatcattaaaatggccatactgtccaaagcactgtgcagattcaatgttatttctatcaaaatatcaatgtcatttttcacagaactagaaaaactattctagtttttcgattcatatggaaccctaagacagccctaatagccaaagccatgctaagtaaaaagaacaaagcaagaggcatcatattacctgacttcaaactataaagatagtaaccaaaacagcatggtaccaatacaaaatcagacatatagactggaacagaatactccattaaaaagtgggcaaaagaaatgaacagacgcttctcaaaagaagacatacgaacaaccaagaaacatatgaaaaaatgcttcacatcactaatcatcagagaagtgcaaatcaaaaccacaatgggatatcatttcataccagtcagaatgactattagtgaaaagtcaaaaacaacaatgctggcaaggctgtggagaaatggtgacacttacacactgttgatggggatgcaaattagttcagccactgtggaaatcagtttggagtttctcaaagaccttaaaacagaactactatttgatccagcaatcccattgctgggatttatatccaaaagaaaataaatcattctaccaaaaagatacatgcacttgaaagttcatcacagcattatttaaaacagcaaagacatgaaatcaccctaagtgcccattagtggtggaccggataaagaaaatatggtatatatataccatggaatactatgcagccatatgaagaatgaagttatgtcctttgcaggaacatggatgcagctagagaccattatctcaagcgaattaatgtaggaacagaaaaccaaatactgtatgttctcccttataaagggagctataacattggatacttatgggcatagagatggcaaccatagacactggggattactaaaggggagagtgtgagagggggccaagggctgcaaaactaacttctgggtattttgctcactattttggtgatggaatcattcctaacccaaacctcagcatcatgcagtatacttatgtgagaaacctgaacatttatcccctgaatttaatgtaaatttgaaattataaaaaaattttaaatacaaaaatagttgtaatcagatggatagtccttcagctttcctcatcttccatcatcaactgttaactcttaaccatcaactattaacctggatttggtgtttatcatgtctatgcatgtttatatacactaatgcacaaatatatatttgtattatttttatgagttttcaaatgttaaataaataatatattgtacatgtcattttacaacttctttattccacattatgttcttgagatttatttatattaatttattcatttcaattttgtttaatatttcattaaataactgctgtcaagtttattctctgttgatgggtattatacaaatttccatttttaccaatgataaatgagaagttcctatttttccacattcatgccaacttgaattgtcagactttttaattttgccaaactgaagagtttaaaatggtgtctcattataattttaatttgtatttcctacgtattagtctgttctcatgctgctatgaagaaatacccaagactgggtaatttataaagaaaagaggtttaatttatttttatttttatttttttagatggaggctcactctgtcacccaggctagagtgcagtggtacgatctcagctcactgcaacctctgcttcctgggtttaagcaattttcctgccttagcctcttgagtagctgggactacaggtgcccaccaccatgcccggctaatttttgtatttttagtagagacagggtttcaccatactggccaggctggtcttgaactcctgacctcatgatccacccacctcgatctcccaaagtgctgggattacaggtgtgagccaccacgccaggcgaaaagaggtttaattgactcacagtttcatgtgggtaggcaggccttaggaaacttacagtcatggtggaaagagaagaaaacacttcctttttcacaaggcagcaagagagagaagcaccagtaggggaaatgccaaatgctttcaaaaccatcagatcttgtgagaactcactcagtgtcatgagaacaacatggaagaacctgaccccaagatccaatcacttcccactgggtctctcccatgacatgtgaggactatgggaattataattcaaggtgagatgtggatggggacatggccaaaccatattattccacccccaaatcttatgtactcacatttgaaaacacaatcatgcctttccaatggtcccccaaagtcttaggtcatttcagcattaacccaaaagtccaagtccaaagtctcatctaagaccaggcaagtcctttccacctatgaacttgtaaactcgaaaacaagttagttatttctgagatacaatgggggtagaggcattaggtaaacacacccatttcaaatgggagaaattggccaaaacaaagtggatacatgccccatgcaagttcgaaatccaatagggcagtcattaaaccttaaggtgccaaagtgatctttgattgcatgtttcacatccaagtcatgctgatgaaagaggtgggcccccatagccttggggagctctgcccctatgactttgcagggtacaa

SEQ ID NO: 1267 - DNA, 94203 bp, Homo sapiens
gacctttgagcaaagacataaaggagatcagagaagaagccatgaagatgtctggggaaagagcttctcagtcagaggaagcagcaagggccaagaccctgatatgagagcatgcctggtatgtttaaggagctccaagcaagctacagtgatgaaagtagagtgaattaggaggagggtcgttggagatgaggctgagaggcaactggggtggtggtggatgagcagatcatgttggatagaccttgtagcgctctgagaggtctttggctttgctctgaatggtggatgatccaaaccataaatatagaagatgattctggtcaccatattaaaaagagattgtagaagtgcagggaagacagtagtagagacggggcaactcctgcaagagatgatttggggtaagacgtgtgtgatagcagtgagagtaatgagaagtgctcagccaccatgcatactttgaggcaactattaggtatgctgatttgaacaatttccaataaatattagcaagtaaaaaagcaagttgcttggcctgagatactgggcacacaaaaaagtatgtcgcaaaatagcatatgtggtacatcatatgttatttaatgagaaatttaaagtgtgcgtatgtgtgcgtatgagtgtgtgtgtgtgtgtgtgtgtgtgtttgaaaggaactggtagtaggagctaccttgggtcaacttgctctctcagggaagtagcaagatggagacttcatttctaggacattcccttcacagagtaagactttcatcagtcatggatagccttcttagggtgttgaaaatgttctaaaaattaaattgagagggctgtacaactctgtgaatatataccaaacattaccaaactatacactttcaatggatgaattttatggtcaatgaaacatatctcaataaagttattgaagataatagcaacacgtcagtcttgacttatagatccaatcccattgtcttccatcattctcttagataattaaataatccctgggcaggcatgttaaacaaggctttaatatgacatcagaagtacatattgcctgctttacttgatttttatttacaagttttgggtaatgtttcttgatgaggaatgtggtagagcatggataagctagaatccaaattttagagagcttacaatcagtagaacacacactgaaaaaacagaagaaaacaggagggcaagtaaatacacagtagagtgataacaaattggttgaatgaacggtgactctaataccctttaccattatattcaaaaccaacaataattgtttcttaagaagaaaaacaatcaaaatcacaattctaaggatagttttgcatacattttaagtgagcctaaggttgaagagctgtgaagagtgataacacaaaacagtatatacaaggcacagtatatgcagacatacaagattatagaaggctgaagtctaaacgtgcattgtgggaagtggtttcaagtcaataacttttattcttcatctatgattttgaaaagcaagggaagtagacagctatatatagccttttcaatgagtgtgcagcccaggggagcattgtgagctaggcaggatgtgagggtggggagatttccataccatacacagcatgtacaggctgggtaaatcccctggcctaaaatacaatccacagtgcttttatgtcaatgttgctcagcagaggtggcgtgggctgagctgcggtcagcctggggcacctaggacttcaggaagccaacctgatttctgccttatcttctggctctgaaaagactacagtcacctaactcttcccctgaggaccatatgcaaatcagcctgcctctctgccttgggttgaaaaggaaaatgaactggtatacatacaaaaaagaagtcagacaggggatcaaaataattttatttctcaacatgatgatccaactagcaccgcctgtcttccccctcctatctctcatcctgtcttgcttctttcctgctccctgctcagcatatttggccccactaccaagcggaatccttccctgctcacacaggcttaggacaacttcactgtctccactccctgttttgctctgtttacaaatcatgagatgtcctgcctccgtttacatattatttatttaatgttacattgaagaaacttgcagctaaattcacacacacagacacactcgcaccataataaaacacttaacattaaaaataaagatcaggctgggcgcggtcactgacacctgtaatcccagcactttgggaggcggagccgggtggatcacttgaggccaggagttcgagaccaacgagggcaacatggtgaaactccatctctaataaaaatacaaaaattagctgggtgtggtggtgcgcacctgtaatcccagctatctgggggccaaggcacgataatcacttgaacctgggaggcggaggttgcagtgagccgagatcacgccactgcactccagcctgggtgacagatcgagactctgtctcaaaaaaaaaagatcagaaactgtctacaggtagaaggaggtaactgatccagtagctgggataaaatgattattctaagtaaatattaaatttaactctgaaaaaatactggaagaatgtaaaataaatattaacattgattatttctgaaggatgagattagatgtaatttttatttatttgctggtctgctctttccaccaagaatatattttacttttgttaccagaaatatatatttcaaaaaattagctctaagtttactagccatttcagtcattattgtcttctacgaatcaaaccaatgatttttgacaaatgacatatttttcttttattttaaattggaaagtaaaaaatccttccattttaacatcttttaaattatgtaaattaaaaagcaaaacatttctttacctttccagttttatatgctggaattttgatatacaaacttcctgctatcaccatgtacatttaaacatacattaatataaacacaaaatatacctggaaaaggtatagaacaatatgtatggcttgtatgtaaaaacaaaacataaaaacatacaagccaaacatattgttctgcaccttttccatgttaacaatatatcctgaagttttttaggttgatacattatgaatatacattattggtttccataaccttgtagtgttccattgtaaggatgcaccatagattattttacttgtctctcattgatgcacagagaagtagtttccattacaaaaaaatactgcaatagccaggcgcggtggctcacccctgtaatcccagcacttcgggaggccgaggcaggcggatcacgaggtcatgagatcaaaaccatcctggctaaagcggtgaaaccccgtctctactaaaaatacaaaaaattagctgggcatgatggcacatgcctgtaatcccagctactcaggaggctgaggcaggagaatcacttgaatctgggaggcggaggttgcagtgagccacgatcacaccactgcactccagcctggcgacagagcaagactccgtctcaaaaaaagaaaaaaaaaaaacactgcaataaatatcttgtacagatacctctctgtgctcacgctatttttcccccttagaattgatagctctagcaaacgtaaggtgttgttgttgttgttgttttcagaagaaagaagttatgtaggtgccaaaatattctggatatgattcttaaatggatattaataaacctaattaagtttggatgggaaccacaaggaaattaaagggcttcaaagccacatccaaagaggacaattgaaggatgtctttggcctggacacaagagggccctggagttatccaaagggcaagtcctcggactagagaaggttggagttgtaggacttcaaaagataaagcaacaaagatgggttttaggtaacagtaagagagcaatcatttatctgatccagcagccattcccctacctctagtggcaacactctagtgttcctcagagaaccatccctcccccatctgtggatgggtaggtccatgtggctgggtagggctgactccaccccactcccagatccaggagtgtgtccaggcctggaaagggtcaaatgaatattccattgtcttggctctaatgattgaggtacctgcgagcatatcatgtgagctaggccaatgactcaaaattctgggacttttactagaactataaggaaagagatctagctccactggtaagatgttagcccagcagccattttgctgccatggaggacagcttgcccatgcatgaaaccagctcagaactaaagaatgaaaaccaaaacctctgatgtcgtcgttaaataccagcggacccagcagtgccaggttgaattgatttttcctttgttatagaaattgggttaaattaggttttttccaacccagtttcagttgcggccccaaagccctatattaatgtgataaagggaatgaagtacctccatccacacttgacgcattaagaggcaaaacagattctgccagtaatagcgttcgcccaccttcagcctttagaaaacaaggcatgaaaatgcaagagagagaatgttgggggctctgtgtttcctctcaccactagcccacaggggaaggtgggtgggtgcttatctaccagaagccaaccaaaagggactttaagagactcttcagggagcttggtgtgagtcccagagttttgcagctataaggactagtgtctaaatcccactggagaaacataatggtggaagtttgtggaagagctacttattcggtgtcagagggaaagggggctctacttggggcaaatggtatatccatcattggctgggacaggaggcccgagtcttccagtagaaccatgggagggaataagtggtatgtggttctgtttcttttttcttcatttgagacggggtctcattctgtcccccaggctggattgcagtggcatgatttcagcttactgcaacctccacctcccaggttcaagcaattctcctgcctcagcctcccaagtatctgggactacaggcgaatgctaccacacccaactaatttttgtatttttagtagagacaggatttcaccatgttggccaggctggtcttgaactcctgacctcaagtgatcagcccacctcagcctgctaaagtgctgggattacaggcatgagccaccttgcctggctcttttttctctttatttaatagaaatgagatttccctgtgttgcccaagctggtcttgaactcctgggtttaagggatcctcccacctcagtctcccaaagtgctgagattaccagcgtgagcccccatgcccagcctctgtggttcattttcaaggaaattttacccaagaggacaacctatgtcctgacaggacaaatgaatcccgacaggagctggaacagctaaagcccaagggctgagggttgggctccttggccaaggagagtggcaactcctacatcagggaaacagttgtcagaaccttcagctggaaaatctctgaaaacagcaaagcacatgaaacatgcaagaaaaagcagcaattgttcatccaccacatcccaaggacatcatccccagattactgctgcagcttcatgaacgttgcaccctttacccctcttcctcttttccctccagcctgagcttccgactcaggtgtgtcagaaaccaggcttgtgtgtgggaaaagagaggttaggacatggtggaaaagccaacatgcttcaaatcctgaagcaaacccatgcaaagttacggaaaagcatcaacttgaatacatgtttggagttttgattattaccttgaactgaactgggctttctttttcttttctttgtattgttgttgttgttgttgttttgagacagagttttgctcttgtcacccaggctggaatgcagtggttcaatcagctcactgcaacctccgcctcctgggtttaaagctattctcctgcctcagtatcccaagtagctgggactacagccacctgccaccatgcccagctaatttttgtattttcagtagagacggggtttcaccatgttggccaggctggtctcaaactcctgacctcaggtgatccacccgcctcggcctcccaaagtgctgagattacagacgtgagccaccgcgcccagcccctttttctttgcttaactttttattatggaaattttcaaacgtgcatcggtgcaaggagagtagaataatgatgtacccattagccagctttagcaattatcaagtcatggtcaaacagttttcatcccttcccctaccaatttctccccctccactggattatgatgaagcaaatcataaacattttattgttttatcaataattcagtgtatgtttctatacaaaataaggactattttaacatgataatagtgccattattacatcttttttttttttttttttgagatggtgtcttgctctgttgctcaggctggagtgcagtggtaccatctcagctcactgcaacctccgccctccaggttcaagcgattctcctgcctcagtctcccaagtagctggaattacaggcacacagcacgacactccactgacttttgtatttttagtagagacaggatttcaccatgttggccaggctggtctcgaactcctgacctcacgtgatccgcccaccttagcctcccaaagtgctgggattataggtgtgagccaccacacccagcccattattacatcttaaaaaataacaagtttctcagtattatcaaacatctctttaacattcaaatttgtctaattgtctcataacgtctttatacagttgatttgcttaactcttaatccaaagtccaaacatgctcatatgtctcttaaagtctcttttaatctaagggttccccctttgatttatttgttgttttgttttgcttttgttttttgagacagagtctggctctgttacccaggctggagtacagtgctgcaatcccagctcactgcaacctccacccactgggctcaagtgatcctcccacttcagcctcccgagtaggcgggactacaggtgtgtgccaccatgcctggctaattttttgtagaaaaagggtttcaccatgttgttcaggctggtcttaagctcctgggctcaagcaatccacccccttgacctcccaaagtgctgggcttacaggcatgagccaccgtgccctgccctctatgacttatttgttactgatactgagtcatttgtccttagcatgttttgtattctggactcatccaattgcatctccacagtgtcatttgtcaggttcgtttatctcttgtatttcctgtaaactcgaatttatatctcgaagtttgattagatttgtgtttgattttgttttctcttggcaagactcccgagttgccagttttgtgtacttcctcttgcttcacctcaggagacatacaatgtctggttgtccttcttttaagattaatcagtgtgttacagtgttgtcagcttcatatgacagttatacattttcctattggctttttgcgtaataattttaacagccattgatgatcattgcctacatttattatttcattggcattgcaaaacgatagtattctgtcactccttcattgattagtttcttggaaaaaaagaacttcctcattaaatacttgatcactgaattgaaagataattcttcaagaaaagcaagcaatatgttttatttttttcctttgtttccagttttcagaaaaacaagttggttcttcagcatcctccaaaagtgatcaaaaggttgggatgcttttttcaattctcttttgaactcattgttttaacatttttgctgttcttcaattcatggcaattattattccttttgatactcaaattgttccatctttggcaagtgggaactccttgaatttggctcctatgaagtgaactttttaaaaccaaaacaaacaaagggactatttgtttttgtttatgttttccttaaagtgagaaaaaaatattgagcctcctaagtttgcatttaaaagttggcaaagatgagtctcagttagtgggtttgatggctctatgagaaagagaataaaattacttacgatgacactccatgtagactgagcaaacgaaagactcctaagtattgcaacagctactgatgatattttgttttcccggatgagaacactttgtgaagtctataactcttttcatctgaaccaagcaggtgtaaaatgtactttcctcagaggagtttgtagtctagtttgagaagatagcactgtattatctaggtttgctggtagtgacagaaacctcaaaataactgagacttagaaaatagatattaaaaaatgtaatccagggctggcatggaagatccatggtcaccagggtcccaggctctttctatcttatactccattgtcctcaacattcaatttccacctcatgatactagatagctgcttcagctccaactgttacctcaatattctagtcacaaggcaggaggaaaagggaaagaaaaggggatgacagatcccactaaggaaatttcctagaagttgtgcacacgacttctgctacattcagttgaccagaagacagtcatacaactacacctagctacaagggaggctaaaatttgtagtctttattcttgctggccagatgcccagataactgtcagggattctgttactctagtaagaaggagagagtagctatttgggaatagtagcaatccctacctcaagcccatactcagaaaaaaaaaatactatcttgtttgggcagtgtatttccacacatatgtcttaagaatctcagaatgggggaggtaatttaaaatataccagtaccgtaccctcctgggtgtcttgattatgctggggcatccagtatatgaaataaaattaggctgttgtctggtaatttacatttaaaaataaacattggagaatttcactcctatacagcaataattattatttcatttattatttatccctacccactacatgcaatatctgcttacactaaaatctcttgattattaacatagtagaggtaactgtcacacattatacttcaactatgtactaactctaaggtgacatgtatgactagcacctaccattcataagatgtatgggattcagtcctccaaaggaccctcacaaggaagctaaggatcagagaagtcatggcttgctcaaagagaaacagcatagtaagtgacagagctgggaatccaacacaagtttgtctgttttcaaagcccacatatactttgtttattatgccattctgaaggattcacttatttttcactcttccacaaaacgtcaggacagaaaggcagtcatctatatgtagcattgagaaatttctatgggctttaatttaaatcttaaaaactaataaacttcagcaacatatttcttcactttaatgtgtgagggttttgtgctcattacctcttttaattgtccaacccaatttggtgatgatccattcaacaaatttttcttgaacatctgttttatgtgtcaggtactgtgatggttgctgagtatatcatggtaagcaaaaccacacattgtccttactccttgtgctacatgatttaactgctggatggattaaaccaggaactataaagattaaactgtaatccttaccacaattttgagtttacagtttttcaaatatcatttcaagccattagcaaaggctgtatgtattttttacatatgcctcctcgttttgtgaattttgaaaggatgtggtttcggcctttgacatcagaggagaagctcagctatgttggctgaacgttgatagaaagataacgttgaaggcaagttgcccttgagcagctctctgaagatcaactgcctccacattgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatggggtatgtgagcagtttcatttgtcttttttcgcatagcattttatgtttggactgggctaatgcaaaaatatatacatagcataaaatagagcacaggaaacacaaacatgcttattgtaacaacataaaaagtacagtaaaagtaatcagaggagaatgcagagagcagtcaagaggtgaaatggtggtgctaggtgatttcagttctaaaaactgtaaatttaacattcatcagctttttccccctgcaaggttatgtttggtttttaaattatgaataacattttaggtagcaagtattatgattcgataaaacttgaactttctatgaaacatactaaatttaatgaaacatactaaatttaatgaaacatagattaatacaacactagcattcaatgggatgatctaccccagctttcttattttttagtggaagaaactggtgtttagaatggttaagttttgggttcagtgttaacgttttcatgaataactctgtttgtctcaatactcgtcgctagcctgatcttgaaataagatttcccaggcatttaattatctaaaagttgtaaggcacaatggcaaacctcttcatctcttgatagacttcttaggacaccagggttattaagaacaaagtttctgcagtgcagaccagcggttcttacccagaaggagtatggctgctttgctaggtcagtctatctctttatctaaaaatagtcttgtgcttcttaacatcactaataacaaaagcaacaggaataatcctaataatgtagtttggtagaaaaagcattggacaaagggtcaggagaccaaactctacttctcagtaggtgatccagtctgggcaaatgtctacctcctgtttcaggttctttcttcataaaatgaaaaaactggaaataacaaccttcaagatccctttcttcttcaaaacttctttgctttatgcagtggctcttgtttagccctatgctgcaatttttcaaagcatgtttgatttcttactgtatggttatattatttttacatcattagtggggtaggacaaggattatcacttatattttactgaagggaaaataatattaggtgcctgatggtcacttagaaacaaaagtgctccagttctttgttggagtctgacttagtaggtggtggcatgagtttgggattctttggtgtgccagggtttaaagcacttcatgagatggagctccagaggaggtcaggctgggtatagagcctatggatgcctcactttttaaagttgcaggtgttgcatgtcttttgtgaattaaaaaaatacagaaaacaaaaaagttgcaggcgaaatagctctgcctctttagaagtgaaaagaattgcttgtcttattatcagactcttactgataacaatttaccagtcaatcagaaaacacatggaattacgtgcaagtcctctttgctaggtggccaggagcccagtttgtgaacttgggggatttatcatgtagagctaataaatcgcatggcattactcaatgcttttttgtgaatggaacatttaaagtttttgtttcatattgaaagaacagtcatgtacctttaaatatttttttcaaagtccattttgcagttttcaccagttcgtttttctgattcaacatagtatcatctcatttagttagtattaataattccttagcccaactgctatttgtgaactgattgtgaattcagctcaatattatttgtaagtaatcacaaaaccagatggccttaattcagaatattattggtcataatttgcatgtagacaaggttgtaaaatcaccctacttctttatctgagcattatggaaaatttcaagacaattacttcattctggggagccctaggctacagtttctaattcttccatgtgagatatagagaatacatgtccaaacatcaaatttcttgttttctaatgccttttttactcttataaataacattttaaaagtatttctttaattatttaattattatagaagtttattaattagaaatttatccaagttccctgaaaaaggtaatatatgtgaattattattgttcatgtcttaggtatactacatggtttcaggccaccaatttgcacacaaggctgcattaatattactcataagtaaataacattacacttatgggaagaacattttcatttttaaattaaaggcttcattttcaatctgtaaaatgggtgtgataatagtacccatttcataggaagatggcaaagactcagaggtataatgtctttaggctgaactttttgaaattatttggcagatcgaatatcagatattagaagtttcaaacaattcaacttaatatattaggtacttagcataggccctgtcatctggtaagcatctagtaaaaattaaccattatttgtatccctttcatgtctctacagaagctagcaggctgtcataacaattcattttcaaattatgggagatattcaaggattcttcaaagtcaagctaagatcagggtcctggattccttctattctgtggctaaatataagttttgtggggtagatatacatgcattatgagctgtttggccagttattgcccctcttagggtgtcgggtgtcagagcttctttttctcttttctcatgtgtaaaattatgattcttgcagttctcatattctatgaatttataacaccatatgaaaaataacccttctacatactcaagaacatattctgtaattctagaaatcaagtatgtttattctaacctaaaaaatcatgcctattgtcattataatactaattgattgaggttttactttaacatggttttagttctggtgttcgatgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctttggtgtaaatattcccatcatggcccattttaaactaccaatgtgatgtctgctggctcacagattcctgaaaacttaacaattagctacctcgggccagtacaagccgagtccagcacaccgtcggcaagcctaagtacaaatgatccttggagaggtagccaccaactaaacagcatacttagttgcatgtgactgatatcggatccttttcagcggtaaagggaaaatggagagcctcaggcactttgagtaagcacaggatggaagaggcagcctaaatgggaataaagcatcatagattggtgtggctcacgtggccactttctagatgtgggatctcagaccagacacttgacctctttctgcctgtgtcctatttgtaaagtaaggaccccaacactacctacttcaagtgatgttgagtatttcatgagaaaagtatgttataagctttttaccaattgctacatggtaaggtgattattactcacaattttgcccaagcaccaccttggtcttctgaaagcccctctggagaactggaaaggttctcctattttgatgactctttgccccttagggatcaagtgtgctgtgctccttatgatgtgggaggcattatcatttacatggaacaagagaaacagtcaagatcaccattccagtaagcatctgggtgagggtctccactcctcatggccttttccctttagcctacagtcttatctagcaacagaaccatctcctgcttgcagcaagcatcctttctaaattaaagatggtaggtggggagatggtcccctttccttgcttttgaaagcattactgctagtgatcacaaacactgcttctggaatcagacagatctgggtcaaaaactagctcacatttgatctgtgtgattttgtataaattatataatgctgtgcaattctctaaaaagctatctttttttttttttttagacagagtcttgctgtgtcacccaggctggagcacagtggtgccaccttggttcactgcaacctctgcctcccaggttcaagtgattcctctgcctcagcctcttgagtagctggaactacgggtgcgcgccatcatgcttggctaatttttgtatttttttttagtagagacggggtttcaccatattggccagctggtctcgaactcctgacctcatggtctgcccacctcggcctcccaaagtgctgggattacagatgtgagccatcgcgcctggcctatgtttttaaaataattaagcaaggccagacacagagactcacgcctgcaatcccaacattttgggaggcctaggtgggcggatcacttgagcccaggaatttgaaaccagcctgggcaacatggtgagactccgtctccacaaaaaaaaaaaaaaagccagatgtggtgctgcatgcctgtagtcccagttacacaggagggtgaggtgggaggatcccttgagcccaggaggttgagactgcagtgagctgtgatcatgccactgtaatccagcctgggcaacaggctgagacctggtctcaaaaataaaataaaataattaaacattccttcatgatcttatttccttttaataagatggaggtcacctttattctcataagatagtaactaacatttactgagcacttactacatgtccaacactgtgcaaaaatgtgaattatttcacctaaccattataaccactctgtaagttaggaactgttattaccccaatttgtaggtcaagaaattgagacaaagagggtttaaacaacttgcctgatgtcccacgtctctagagtctacattactctctgataaatagtacttattaccatagttgttactcataggtaatcagggattccattgggttattacacagtatgcaatacattcttgctctgaagtccccagtgtaaaggacagtcctgaaaattggtaccccctgccaaatgggtcttctgcaatgaaatattttaggacctctacgttttccacaaatgccccaggacaaatccttgtctttattcacttcaagaagccccgctatgtgtcttaaaaaaaaaaaaaaagagagagagagaggcgggcacgatggcccatgcctgtaattccagcactttgggaggctggggcaggtggatcacctgagggcaggagttcacgagcagcctggctaatatggtaaaaccccatttctactaaaaacacaaaaagttagccaggcatggtggcagatgcctgtaatcccagctactcgggaggctgaagcaggagaattgcttgaacccaggaggcagaggttgcagagagccaagattgtgcgattgcactccagcctgggcaacaagagtgaaactccgtctcaaaaaaagagagagagagagagagagagagagagccttggcaagctttgcctcctaaagttctcctagaatctccccagattcccacaggatatctctcacctgggactgtcagcatatctatcacctgggactgctaccacctctcatgttgtccctgcacccgcttcacccctgcctgccacttcatcctccacatggcaaccagcaccagcttttcacatgtgactgtagtcaagtcctgatgaccttcatcagacgttgatgtgtccctacagcggctctccccattgccctaacgatggacaccagcagaatctaacacatggtctcgtctgtctcagctcatgtctcactttccctcatctctggaatccaaccacaccaggttttcttcaacgttaaagcctccgttttaagtgtcacttacttgggaaagccttccttgatgtccctagactaagtcatgtcctcctgtcctgttctaccacagcaccaggtgtcctttcttcacagcacatgctgaagttgtaactactcatttgttaatgtgatgatgtattaatgtaatttccccacctcaccctccattgaactatcagctttatgagagcaggcacccaagttgataaagatggccttgccagtgtctacaagagtgtctggcacacactattcactcatgcatcatttgtggagggaataaaaggagaaagggagaaaagaaaggagggagtaaggacataaggtatagattcagctggagaggttagagacacaaacgaagctcaaatagagaaggttcaatacccaaataatagagaccaaggcaagtgacataggacttcaaaagggagattactgggtgtagaaacaagtaacaaagactccctggaggtagtagtgtgtggcctatcgttgaacaaggaagaggaagattcagatattcaggtggttggaattttaagtgctgggtcagaaaggcacatgtaggaactagcaggagggccgggtcccagccctcaactctttttaggagaattaagcaactcttttctcctttttcctctgcctgtcttacccctccttccttgccttttacagctaaagcctccgtagataatattctttttttttttcttgacccagaaccttgctctgttgcccaggctggggtacagtggtgggatcacagctcactgtagcctcagcttcccaggctcaagtgatccttctgcctcaacctcctgagtttctgggactagaggcatgcaccatcatccttggctatttaaaaaaaaaatttatagagacagggtctcactatattgcccaggctgttctcaaattcctgggctcaagcaatcctcctgcctcagcctccaaaagtgctgggattacaggcatgagccaccatgcctcgccatgcagataatattcttaaaactacccaggcatttttacttgtgacattgagcagtcatgggctctcttctcttcattcccatgtcattcagttgccttccagctgggcttctgctggcatttgaagttttttacagtctgttatccacacaacacctagaatgaaccttaaaattttaaatcagatactactttctaccttaaaaccctccatggctatttagggtatttaaataaattctcaactatgcccttcaagacccttcatcctgtggtcccagcctgccttctttatttcacttcacaccacactccctttatgtgcttctgtcacatctgccttcttcctgaaccataagcactccaagctcaaggtctcagcagggcctttgtacagggccaggactagggtgagacaagtgagacacacacataaaatggcactcattctcaggatgcaggatctttgcattagctgtttccactgtctcaaacaccccagatttttgcaggagggtttgtttgtttgcttgtttgtctgaaacatggtcttgctctgttacccaggctagaatgcagtggcggaatcttgggtcactgcaacctctgcctttcagactcaagcgatcctctcgactagctgggactacagaagtgcatcaccacgcctggctaattctgttgttgatttatttcccatctcttcaaagcacatagataccttagtatctgcatttatttgttaggtttatggatctgcttccctgtttaatttctgtctgtccatctaatggaagggcagttccatgagagcagagatcttgactgtcttcttcatcacagtatcaccatcatctaaaacagttctgggcactggttagttgtagtaggtgatcagtaaatatccggggaatgaatgaaggtcacataactcatgttgcattcagaaaagcatctgaaagctaaaaatgtgggccttgtctagccacacagagacaagaaagggcccaagcaaagtactttgcaattgagacatgcacagtttgcatctgttttaatggagtgtcatcatgaattgatctttgcctgtgtaatgtgaggttaatgttttatggagataaccgttgtattgatattttcttttctcacaataaaattagatttgattcctactgttcagggactggtacacccattcatcagtttctgcagtagaaatagcccacagagaaatactataaacacgagagtttagattctgactcagtctgaaagaaagcagaagagctcagtttcagcctgggcacagtggcttatgcctgtaatcctcgcactttgggaggccaaggcgggcggattacctgaactcaggagtttgagacaagcctagccaacatggcgaaaccctatctctactaaaaatacaaaaaattagtcaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaacagaaaaaaaggaaaagaagaagagctcagtttcttgaactacaagctccatgtaaaacaagacatgtaaatatcaaacgtggaaatcgtgtctacaaaaaactattttaaagctcttcgcaaatgttcatggaccaaatagtaaatcctcattccaccctcattttcttaacgaactaataatacattcctcccattcatcagtgaattatgaggcctactggaaaaagtagaccttccaggacataattttcatccagaggtcagtttgggtttggcttcatgacactcagaggcctcactaaaagtgatcctaaggagaaaacaggtctgtaatgccttcccatgcatataaaagtccccttttggatcaacagtcttctcagttccttgaaattcagtaaaagttttctgtattttaataaaataagagctagatacaggttcttatgtcttatgttgccatataattcctattaacctaaagttatttgtaagtaggcttctcattatatttttccttttctgatatttaaaaagtcacagaaattataactgtttgttataaaaattcaactatagggatttttccccccaaacttcatatattttgccatatctttattatgattattattggtttgtttgtttttattgactctgtatcaaggaaacgtttctgtgttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacagacagcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagctgggtacagtctcctgcagtggtctcctgggccattgtgtagtgtcccatcctacgagttgttcttcagttgtcttatgtttttttatttatttatttatttattttatttttttatttttgagacggagtctcactctgtcacccaggctggagtgcagtggcacagtctcggctcactgcaacctccgcagtggtcttatgttttaacttttttgtggcatccttcttcctgggggtactttgtccagaatcatctcactccatgttttgatgggaaagtgcctggtgtataacctgcgtcaggatcaacactgagctcagatagacagtagcagcaaagactgaaaccaaattagaattgagttaaatcagctttgattaatctcaagacagagcaaggaatattctgatcctcatattgtcaaaaaaaattaatgaaccaagtacattcagaatgttttctataatttggtctgaagacatcaatttactatctgtgtcagcactggtcttttccctcatgcagatgtatcttttgcagagttataatcataatgcatgacaattttatattctacttttctatctattctttcatataaatgtatttccatatatctacaatgcctccaaagtaatcatttttcatatatatgattttttaatggttgagtcagttcattgcaagaacatgcttatctattttatatacgtggaggaataggtgaacttatctgttagctatggttcaacattcaggttgtttccaggtataatgaaaacaccaaaaaaaagcagtatacataatatagggctgtctcatttttaaaatcagcttcttaggatagagtgccccaaataggataattgtgtcacaggataagaacattttctggtcttgatcatttattgctacatcatcttccaaagagattgaagaagcagtgtgtgggccaccaaaagcggcaccatgtttgttttcagaaccattagagaagattatgtttctaaaaaggaactaatagaaacaaaagaatctcactgttgtgattttcaagtactccattttgaatgttttagtgagagagaggggaaaatacgtgatcttttatacataggtgagatggtttggtttaaagtcagtgtcacatgtatgtagatgaacccaccacctgcatagttggatttaaggggtgccaaaaggtctcctactctgcaaaacctgaatgcccgaactgactgtcacagagtaggggtggtctgaaaggttcccatgaatgagctctttgggttaggtcatgaaacaccttatcaaggagcaaatgaaatacaagaaggtgtcacaggagccacttttgactgttccgtagaagttagttttaattttagacagggcctatgacactgaaattctcaggctgtaattccagaaaagcggatgaggtgagcaaggaacaacagggcagcctaatagaaaagagatttggacccgggtcaccgggctaattctttactctctctgggatttagctttcttgtccataaaatcaaaggattcagctgatcaatgctttttcaaaatttaaaaaacattttaatataaaattatacaagccatcaccatccccacatataaaacagagagaagtggaagttctctgcttgaagcagggcagggaaactgcccagaaccctatgccccttggcctgtcccttactttcagggatcaacaagttatcttccaactctgtgacccttccccctgggatgtaaattgaatagtagaaatgaaaagacaaagccagtttagaaagtcaccttgaaacctcattgtcctcatctctaacattataaagttggactgaatgatttctaaagactcttccagttcaaaaacatggaaacttggctcacatttgtaataccaacactttgagaggttggcattacaggatctcttgacggcacgagtttgagaccagcctgggtaacatagtgagatcccatctccacaaaaacaaaaaataaaaaaattagctgggcatggttgtgcacacctatagtccagctatttgggaagctgagggaagaggattgcttaagcccaggagtttaaggttgcagtgagctatgattgcaccactgcactccagcctgggctacagagcgagaccctatctctctttgtttttaagtggaaattgtgtatctctgccaattatatcaggaattcacaaaaagtgatggagattagccaaacatggaaatctttccaggaagtaatacctttagggtgattaataactgtgtggctcatgagaaagcatgttgtcaaaatacaagcatgaccccaagaacgcaccctaaaaatgaagtcagacatttcatgtgtaaccaatacaaaatctgaaataataacagccaatatttaatgagttctcgctgtgtttcatagcatcaaggttaagtgttttatatgtcttatatcataaatattcacaataaccacattcattatgttatcctattgttatccccatgtcatttatgagaaggctgaggtttatagaaactaagtatctctatctaggttacacatataggacgaatattaaaagttggattaaatgttcttcaatggacattttcagatctaagcttgtttgggtctgataagtcttttaatagaagctgaaaaggcagagttggggcaaggatttgttggtgagtttctaacataatccaatagaggtgttgagtcgggaccagcaggcttgctccagattgcccagcagacttacccgaaagacagcagaaacatcatcaacagcaacaattttttttaaaaaaccacaatagttagcatcactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaacatgagttcctggacttgtaaacctgaggatctgttcctggggtggcctctgacaaggaaagatgctgtatccgcctcagcactatttaattttccagattaacaactaatagcagcattagccacttattgagccttttctgggaataacattctgggaaagctatatccaaagtggtaatacaaggagtaccaggaggaaagtattagcctagcgaagtgacccagaaagggagtttgagggagctaataccaaacctcacccttttccacaatccatgctgaggccatttccatgacaatgatccaatttggtgtttcccaaagtggggtactatcaggagcacacaagatggcacatggacaaatctggttttaacatgtctttaatagttatgtatctactataatttatgttagaaataagtgttttaaaatttatggtggtaatttaaagtttcctcctagaataaatttgtttatgtggaaaaaataagtcaattgaaagaatactattgagcagacaatactatttgagggaactagggtatggtagaaattgccaagctaagttggaaactgaagcctgggagcactgaatccttgggataacaacatgaatcataattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacatttctctcaatccaagaaaaggctgttctaattccaaacaagctcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaaaaaacagttgcaaaatgttatgcagtaacaaatctcccatctttgtcccaagtcacattgctgtcctacatcacagcaaccacgatagttaatttcttataagttcttccaataatactttatacatatacttgtaatactaataaacattcttcttttcttcctttttaaatagtagtaacatactctgcacacacttcttaacttttcttttagttggttaacaatgtatcctggagattgatccacactgatacacaaagatattcttcattctgtttatggttgcataatacttcattgtatgcatgaaaaatttcttttaatgaaggttggtctgtttccagtttttgttattatgcacaatgagaaatgaacagccttgtagatgtgtcattttccataaatacttttataacagtggttctcaaccaaaggtgattttgcccaccaggggacatttgacaaaacctggggaaatttttggttgttataagtggggaggagggtgccaccaacatctagtgggtagaagctgagggtgctgctaaatatcctacaattcacaggacagactcacaacaaaaaattattcagcccaaaatgtcaataatgctgaggctgagaagctccagtctgtagaaaacatttctagaagtggaattgctgagtcaaaggatatttgcatctgttattttgttgactatgagcaaattactctctacagaagttgtaccagtgaacattccccagggccacatgtgagaagcatgttttctcaaaacctcacaaacaccattatcttatgttttgatctttgctaatctgataggggtttaaaaaatagtacttaagtataatttatttgcatttctgttgttatagtgacattaagcatctttccatatgcttaaatatattccttttgttcattttcctataagtttattagtattttatttaatttgtaggagctctttaactaccagctaaacactttgggcagactagttttaacctacattttcattgtcaagagatttttatccacctgccaatttttctggaaatcttattccaaatcatttccattaaaagttttgtcatagggttcacaataatcactttctgctgcatacttggttttacttgctgttccttcaatcaattaacagatattaattgaacatcgcctcagtgcaagcagttatttcctgaaatgcaatgaagtttttatgcacttatgtattttggctactggtccttcagtgcttaaaaagaagacacaaaaaatacgttctttcaaactcatttaacatttcatatttcttattctgggaggaaggtctttgaaggaatattcacagctcagagatactgacagaaacaatacagaggatgccttgagaatctactttatgcttggaaaatatcacttagttcttgctcctaatttccacataagtccttttctctctgctcccttttgtaagaaaatctaaacacacatgttttcaacatgctaggatcatgttaccttgatctagtaagaatggggcttggacattattcctgagttatcatttcacttataagataaatatacccatataaaagcacactgaattactttattagaatctatgaagaaaaaggctatccctcaagaagaacatgagagagactgtcatgtacttgaacccccatggatacagatgagcaggtggcaggtgctctctagctgctgctcactgctaatggggttatgcggttacaagggcgtgcatcatttcgcacacccagcatttgatgcataccccttattcctctcccataatcatctaagttgacactatgatgtttttgaaacttctaactgtattaaaatattattttcatttctctgcttttcctcctgcttcacactctctgtaaaaacttcaaatatcataagaatatataactttgtgaaattctgccacagtggaacctacaacaaagaaccagtgttagcagcttggaatgtttttcttcttgtattatttctttggatattgcatatactaatacataatctcttcttccaaaaatgggatgatgctccatctgttgctttaaatctgctctttaacacttggtatatacttttgtccctctgtatagatgaactttattatctgttaatggttacagagtagtcattatgtatgatgacgaatttaaccatacacagatggatgtttaaccataactaatttaaccatttgtctattgatggatatttaagtttttccagtttattttagtgtaataaataatgcttctgtgaaaatcctttttattacatctttatatattttgaacaaatgtttccatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccagcccccaggaccacccacacaggtatctgctcttcatagtttcttatgagaaaacacattttaatagatgatcctaaattgccctctgaaaactgtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatagcacatccagccacatggtaacccacagtgcgaaatgctgaggtggagaaagccagccaacggtgggccagtgatgagtaagaggtcttatggaaaagaagagagaaacgaagacaggtgtgggatggatcagtttcctggctttaaggtggtccagggagccttgaaattaatggtcttagctccagactttcccagagctttagaatagagggaggttaggtctagctgaagatgggctggggagggaggaactaggaacagctcattgcaaattgctctggtgttttacaagatgctaatttttccatagagacagtaatgagcatatcttttttgttttgttttatcttgttttgtttgagacagtgtctcactctatcacccagagtgcagggacatgataatgactcactgcaacctcaaccccccaggctcaactgatcctcctgcctcagcctccggagtggctggtactacgggcatgtgccaccacacctggctaacttttaaaatttttttgtagagacagggcctcactatgttacccagactgttgttgaactcctggcctcaggcgaccctccttctttggcctcccaaagtgttgggattataggcatgagccattgctactagcatttgctagtaggtttatgtaattttaaaaaattctcttaattaacttaatgattcagagactattcttatgtcgcttttgaaaaatgaggcaactgagaggttgagacacttgcctcaggttgcacagctgataaggaatgaggttaggatgcaaacctgagtctgccctacttgaaagctccagttctcccctactctgccttaccagaggagaaagctgaaaactgctatttttttagaaacgtggagatgtccttttcccatgggtagcagacacataacttctcatcgacacatttgctgggctagtccagcagcaaaagagccaatgttgttggagcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagtgctaagccaggaagcatagtagttaggttatcaggctctggagtcatagagtggagcttgtacgctgctcttctacgtattaagagggttggcctctgtgaacttcaattttctcatctataaaatggggagataatatgttgtaggatcgtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctgggttggggttttgtacatagcagagcagctccttctctgtgagatctattgaaagtcagcccttaatacaagggtttgttaaaaaagagaaaaagaaaaagaaggaaagaaagagagaaaggaaagaagaaaggaaaggggaaaagagagagagaaatagtaacataaaaagaaaaaagatataaaagctgattgcacaagcttacccttgtgaagatttgtaagcatcagcatcttgaattgtgtctgacacgtgtcagatgcttgggatgaaacatcagactatgaggatggcatatctttgaacgtggccaagaaaagagacaagggtaagcaaggtcctgtgactttcgccccaagtaatgcagacagaataacaagtaagaatgagagcaggttgtacttggcctctccctttctctggtggcttttgtgtggtttccttggaaagttttaccctggcatttttcagaaatagcacagttgtttgggatgattataggcaatcaccctttcccagagactgaactgtgtcgggctcattgaccagccaccccccggggaccaactagggaggacatagctggtcctgctgtttaccaagtattggatcttgtgagatgccagaagaaccaacctcagggtctttggaaagactgaccaaccagtcaggatggattgtggtggtggatcccaagcactcatttgggaatgagagtgacgttgacggtggaacatgaaatccatcccaacagaagagcaagcctgagagcaagctcatctgacagcctgttaaggcacaggcacaaaggaggccatgtgagttggtaggagaactcctccttggaaatcttggagtctcgctgtccactaaggtaaccactagcacctgaagtctactggcataggggtctactgagcacctgaagtatggcaagtgcaaattgagatatgcacaaaatatacaatttcaaagacttaagtacaaaaaaaactcattaatttttgtgtggataacaatttttttaatatactacaaccaagtaagattttattttcacaaatgcaatgttggctcactatcctaaagtcaattaagataatatacaatattacttgaataaatgtcaaaaaagaacatttcaataaacaaagaaaaatatttgacaaatccaacactctttgtgataaaacccccagtacactaatagaaaaaaaattttgagtcttgcaaaaagtcatctatgaaaacctacaactaacattatacttaatggtgaaagactgagtgctttatctgtaagtttgggaacaagacataaatttccacttttttttttttttttttatggagtcttgctctgtcacccaggctggagtacagtggcatgatcttggctcactgcaacctccacctcctgggttcaagggattctcctgcctcagcctcccgagcagctgggattacagatgcgtaccaccatgcctggctaatttttgtattttcttagagacaaaattttaccatgttggctaggctggtctcaaactcctgacctcaagtaatccacctgcctcaacctcccaaagtgctgggattacaggcatgagccactgtgcctggccaatttccacttttaacactctattcgacactgttctgcaagtactagccagataaattacactataaagtgaaatgaaattctccagattgagaaaaaaaagtagaactctttttcattgcacaccacataattttccacaaaaaaaaaaaaaaaaaaattgtaaggaacttcctaaaaacccactaggactattaaacaaattcatccatgtcaaaagatacaagatcaacatacaaattaatttttttaacttttattttaggttcagaggtacatgtgcaggttttcatataggtaaattgcatgttgcaggggtttggtgtacagattatttcatcacccaggtaataagcatagtacccagtaggtagattttcaattcccaccctccaccctcgagtaggtgccggtatctgtggtgcccttctttatacccatatgtgctcactttttagcccccacttacgagaacatgcagcatttggtttttagttcctgtgttagttcacttgggctaatggcctccaactctacccatgtcgctgcaaaggacacaatctcatacttttctatggctgcataattctccatggtgtatgtttaccacattttcttttcttttcttttctttttgagacagagtcttactctgtcacccaggctggaatgcagtggcacgatctcagctcactgaaacctctgcctcccgagttcaagcaattcttgtgcctcagccacccaagtgcctgagattacaggtgtgcaccatcatgcccagctaatttttatatttttagtagagatggggtttcaccatgttgcccaggctagtctcgaactcctggcctcaagtgatctgctgccttggactcccaaaatgctgggattacagatgtgagccaccacgcctggcctcacattttctttattcattcttttgttaatgggcatttaggttaattctatatctttgctattgtgattagtgctgtgatgaacatatgtgtatatgcgtctttatggtagaatagtgtatattcctctgggtatatacccaagaatgggattgctgggtcaaatggtaattctgttttaagttctgtcagaaatcacctaacaatttgaaatgataatattttagatattgggttaaacaaaatttattgttaaaattattacttgttatgttttgcatttttgaatgtgcctactggaaaaacttttaagttacatatatggctcatgttacatttctattggacactatcactttagaacttcacatagaatttttatccctgttcacaattccagttaatatttgcctccactgtctgccctcatcacaatgctgctaggctgttaacaagccagacttacccagtatttttctaccccaggattttgccctggctgcttgctctacctgggatgctcactcccctagaccttctcccagatggctcctgttcgactttttggtctcttcttagatgccctttctctctccagagaggtctgccttggccacagtttggtcacatcaactgttctattctctttccagcacttctttgttttgtctgccttcccaagtatactacgggctctgtgagagtctatcatgttcatcagttcatttcctgaactcagaatagcacctcactcatagctggccctccataaatatttcctgaatggctaaatgtactagccttaaatctgtttaagattgtttaaactgtgttccaacctgacaccctttgttttgagctaattaagctccactgagggccagccactgctgggcactgggtatatgggaagatgccctggtctctgaccttagggagctcaggacctagtaggttccaaagacaaaaatgtcagcaaatggagttgtcatatcacatgccatgagcctgttgtttttatttcactatgcatgccctaaagaaagaacccaacagaggtcaaaacacagcaacctcaagctcgtgcaccctgtttaccagtagctgcagacagttcttgaaaaggcagctccgctgtgctctactatttgtgaaaaaacaggttaaccattccaaagaactgtgattatgggcaggaccagagcttgcatttctaacagtaaatgagaagatagtttgagcccaaagggcacgtttgcagaggcttttgcgggaagacaaacctcctaatttagcattagactacaaaagcaagttctagactgatatgtagagcaagacactcattttcctttatatataccctataaaagtgcagggaaaagacaaatatactccaaatgattaactttggctacctcagggttatggggaagggtgggataataacacactataaatattttcttcacatgcctctgtagtattttgttttgtttgtttgcttgtttgaaacggtgtcctgctctgtcacccaggctggggtcgacggcaccatcactatcacagctcactgcagcctgaaacatatgggcccaagtgattctcccacttcaccctcccaagtagctgggactacaggtgcacaccatgaggcttggctaatttatgtaattttttgcattgtctcactatgttgcccaggctgctctcgaattcttgggctcaaatgacctcctacctcagcctctcaaagatctgggattggctgggcatgttggctcatgcctgtaatcccagcactttgggaggctgaggcgggcagattgcctgagctcaggagttccaagccaccctgggcaacatggtgaaaccccatctctactaaaatacaaaaaaaattggggaccagcgcagtgactcacgcctataatcccagcactttgggaggttgaggtgggtggaccacagggtcaggagatggagaccatcctggctatcacggtgaaaccccctctttactaaaaatacaaaaaattagctgggcgtggtggcacatgcctgtagtcccagctactcaggaggctgaggcaggagaatcgcttgaacccaggaggtggaggttgcggtgagccgagatcacaccactgcactccagcctgggcgacagagcaagactccatctcaaaaaaacaaaaaagagaaaaaaaaaagatctgggattacaggcattagccaccatactgagcctctacagtgttttcatttgtcacaaaaaacataaatagattttgtactttcaataatggataaagttgtttttacttaaaaaactaaaaaccagacaccacaaagctttcctgtatttgatagggtctgcttctcgcatcttgaattttttttatctcagttctgttcctcagctactaaatcaaagatcagcttccgggctgaggacccaaaaacaggaagtaaagactgaattcactttgggagaatttgatgatgtaatgggtccctggatatcaaccaagcacgctcatatatcacaaatctcttgcgatagttaaggcttccttaacttctttaattgggaagataccctttattgagggcatctgttataagccagttaatttgttgacatcatcctattttattccccaatcaactctcaaaaggtaggtattatccccacttatcagatgtaaaaaccagggttctgggaagtttaatgaattgcccaaagtcacagagctcttatagtaagaggcagagacctactttaaacatagctttcccaaacgtgtgctcatttcaccatcatttgctacctccttaaaaaaataaggtagaatggggtttgggccacaatcctgaacaccataatcccaaatattgaaatacaaaatgtaaaaatacccaaaaatataattctggaaaaaataattttaaaaacttttttaaaagacatttgtttacattttaaagtggatttatttgagaaacatatgaagacatgacgaaatgcttcataggccaccttgtgcaataaaataggcaataataatatacatatttttgcaaacataaacacccaagtatactaaggacagtcacatgggtataacagttatgagcagacaaactatattcctaaagaaatagctggtattcaaggggaacgccttcagctttcgcccattcagtatgatgttggctgtagtttgtcatagatggctcttattattttgacgtacgttcctttaatatctagtttattgatagtttttaacatgaagcaatgttgaattttattgaaagccttttctgcatctattgagataatcgtgatttctgcctttagttctatttacgtgatgaattacatttattgatttgcatatgttgaaccaaccttgcattcctaaagcctacttgatcatgtaaaaaaggattagccttttttttttttttttttttgagtcagtattgctctgtcacctatgctggagtgcagtgtcatgatcttggctcactgcaacttctgtccacctcagcctcccgagaagctgggactacaggtgtgcaccaccatatccagttaatttttgtaattttttgtagaaacagagtttcaccacgtttcccaggctggtctcgaacccctgggctcaagtgatccaccctcctcagcctcccaaagtgctaggattacaggcatgagccaccacgcctggctggattagcttttcgatgtgctgctggatttggtttgcaagtattttcttgagaatttttgcttcgatgttcatcaatattggcctgaagttttcttttttgttgtatctctgccaggttttggtatcaggatgatgctggcctcatagaataagttgtgggggagacgctcctcctcaatttcttggaatggtttcagtaggaattacattggctcttctttgtacatctggtagaattcggctgtgaatccatctggtcccaggctttttttgggtggtaggctatttattactgattcaatttgggagtttgttatggatttgttcagggaattaatttcctcctggttcagtcttgggagggtgtatgttgtccaggaatggattcatttttctaggttttctaatatgtgtgcatagaggtgttcatagtagtctctgattatttgtatttctgtggggttagtggtaacatcctctttgtcatttctagttgtgtttaattggatcttccttcttttcttctttatgagtatagctagtggcctatctatcctattaattttttcaaaaaaccaacccttggattcattgatcttttgaataattttttgtgtctcaatctcctttggttcagctctgattttggttatttcttttcctgtatcttaattacagagattatgacacaaatgtatacatttgtcaaaactcactgaaatgtacattggtaaattttattatatgtaaattatactttaataaagctgatttttaaaacaaaaaaactaatatgcaatatatttcacctttaaatttttttaaaaaagaaacagcttatataaccatggtcatctgaaatgctatgatagacaacctaagtcttttaatgagattaatcaaaaacagcagaagaaaattctgtcccaactctcagagacagactaatttgccttcagtatttgttctcttagggtccctggctgattcaatggtgtccaccaacactgagggcagatctcccccacctcgcccattctgatacacatactagtctactctggaaacaccctcacagacacaccccaaaataatgctttatcacgtatctagatacgtctctttttttttttttttttttttttttttgagtcttgctctgtcgcccaggctggagtgcaatggtgcggtctccactcactgcaagctccgcctcccggattcacgccattctcctgcctcagcctccagagtagctgggattataggcgcccgccaccacacctggctaatttttgtatttttagtagaggtggggtttcaccatgttgggcaggctgtctcgaactcctgatctcaggtgatcttcccgtgtcggcctcccaaagggctaggattacaggcgtgagccaccatgtccagccttagatactccttaatccagtcaatttgacacctaaaattaagtctacaagtccatcccttgtctatttggcacccatacatatcttaaaccacacgtaatttccaaatgaagacaataacaaagtaatagttctgcctaacaagatgcaactaacataatgaggctatcctgtgtacaacagaaaattcactaatcgtgatttttgagattttagatgttaaggacttagacttcagggatttttatcattcaggatttcagcattcaggactatgacattcagaatcgtgtcttttgggattgattggtagtgggtataatgacgtattttgcaactggttccatagctgaattccatagctgaattctcaatggcagctcaattctaggtacctgtgagaggcttcttccatccagaagcactttcctaactatctttccttggagcctgatagaccaccaatggaatttgttccattggctaaagcatcaaatcccctgagatccattctccaagcacaaggatccttagaaataggtaacatgtaacatcattataaatcacaaataccatcatgtgaattagttatcagggaaatacagctagcaagtttccaaggaaatgagacacaggcccagtagtatttgatggggaggttggggaggacatggagaagggatagttatagatcagagtcaggaatgtcctttgggagtgtcattgtgggactgcggataattaaaggacatggagaagccagaggcagaaaaaaaaaggtgccactaagggtatgcaccacaatccaggtcgggtccgagctcaattactatgctaatatggtcatggatagacacagagaagagaaaattgtcatatgtgtgtccatggatttctctacgcatctcagctacaagttctgccaatgctgccatttgtcacaagggcagtggggtacatgaccccgtgtctcactgagtggaaacctgtcaccaagaagaagactctaaaggcatgtgtccccaggagtctgctcagagtgtttatcccacacttagggccaggaggcagttttggatatttggtttggagggttggaataggtttaaaaagccaatggatcttatctagcagtagatttctggagcaatctggacaaaaatattgtcttctttcttacatgaatgggatgttcttctctccccacagaagaagcgcacgctgaaggggtccattgagctctcccgaatcaaatgtgttgagattgtgaaaagtgacatcagcatcccatgccactataaatacccgtttcaggtaagtccatcaggtgggtagttccccattccctggactgtggttaaaatcttcagtcacagccgggtgcagtggttcaagcctgtaatcctagcactttgggaggttgaggcaggcagatcacgaggtcaggagttcaagaccagcctggccaacatgaaaccccatctctactaaaaatacaaaaaattagctgggcgtactggcgggcgcctgttatcccagctactcgggaggctgagacaggagaattgtttgaacccaggaggcagagttttcagtgagccaagatcgtgccattcactccagcccaggcaacagagtgagactccgtcaaaaaaaaaaaaaaaaaatcctcagtcactgtgagagagggtggacacggatgactctctgcctctctgctccaaggttaggacttagacaaatcccattaggaaacgtatgtgttccttccatcagtgacatttatttgttaattctttcacttattgaacaaaaattaagcacaaaatcttgaaaaggtggttattccttatacccctttccctcatgtcttctcttcctcaaggaaagtcctaattagtgaaggaagaaataaagctgctatcagcggcctgaaacctaatgtgctttaagtgcagtttactcatgatttgaggcaacatattgcaattgctgggtatgaattgcttggagattctgaggcaaaaagattcagattttataatctgaggactatctggaatcgcactgtctagtacagtagccactagccacacatggatgttcacatttaaatgtattaaacgatattaaaaattcagcttcttagtcacattgggcacatttcacatgttcaatagcaggacatggctggcagctactgtactgaaacagcactggttatagaatgttcctatcactgcagaaattttttttttttttttgagacagagtctcactctgtcacccaggctggagtgcagtggcgcaatcccggctcactgcaacctccacctccctggttcaagtgattctcctgcctcagcctactgaatagctgggactacgggcgtgtgccaacactcccggctaatttttgtatttttagtagagatggggtttcaccatgttggtcagactagtctcaaactcctgacctcgtgatcgacccgcctcggcctcccaaagttctactgaacagagctggtggagggtatctttaaagtccttgtatatgaatcttggcacttctggcttcaaaggcatggatatctccttgcacatcccagggtaccattcctgcttgccaacctgagggatgaacatatttttaacatggcatagaaaagaactttttttctactagaaaagtgaccctcatgagttggaattttgaggactgaaaataaaaggaatagcatgtatttttcagttgttcaaaatctcaatgataatgagtgcctaaaagagaggtgaaatataaagaagactgcagtttagttaacagtattgtaccaatgacaatctcttggttttttttttttttaatttttttttattatactttaagttttagggtacatgtgcacattgtgcaggttagttacatatgtatacatgtgccgtgctggtgcgctgcacccactaactcgtcatctagcattgggtatatctcccaatgctatccctcccccctccccccaccccaccacagtccccagagtgtgatattccccttcctgtgtccatgtgatctcattgttcaattcccacctatgagtgagttttgaaagatgtgttgtggttacgtaagatgtcatcagtggagaaaagtaggtgaaaagtacacaggaactctgtactatttctggaacttcttgtgagtcttaaactatttcaaaataagaagttttcaaaactctcattgcacatttgtcatataatatctttctcttccatgtgccagaaatatttttttaatcactaaaaacttaagatgagaaataaatgtggtttctagtcaagaggagaactttctcctgctgtcttagtttagtgattgctctcttggggcatggaatctgagacgagcagctgaaactgcttaccctgtgtttttgtagcacccaaacacctggataaaaaggatactggccccctaattacccaaatgtttgcctatatgacgataaacacccgagaccccactctcggctcagtaggtctgctgtcagtcaactatctccatgcacgctgctcaccttgaactctgtgtgtgtgtctccaggtggtgcatgacaactacctcctatatgtgtttgctccagatcgtgagagccggcagcgctgggtgctggcccttaaagaaggtaattaaactcctttgccattgaatcactgacactcttgatcctatagtagggttgggttccacaatagaatagagtgtggtgtgagagcagctgatggctgatttctcttttggggttggtggaagttcccaagttttcatcctgggcccaggaagcaataactggtatcattcagggattgaccaaatccagcctgctgtctgttcttgtcaggctctgagcaatatttgtatataactcatttcaaatagtttaataagtacctacataagatgcttgattttgtctcatggtcagtaaaacctaaaatatttactgtctggccttttaagaacaaatttgccaactcctcgtatagtatgaagaagcagagcataggccctcatgtgagatgacctgggtttaaatcccagtctgtcacttgctatgtacacttgggcgagttccttaattgcctgtgcttcagtttcccatctgtttaaaaggaagaaaaggaagggataacagcacctgcctttggagctgatgtgagcaaagtcctagaaactaggttggcccatagacagcatgcaataaatatcagctagctttcaagcttttcagaccattggtaagggtatttcttaagccttaccttcctgatggcacagttagaggcagcagtgtttaagcacatgggatgtggagccaggcatgaaggtgaaaatcccagctctgccaatgattagcatgtgaccctgggtaagttccttgaccttcgtgtgtctctataaattttgactaaaaacagtcatggagctgttgtgagaattgaatgattgaggacttagaaaaatacccatcccaaagaaagccctggatcaatgttaccattattgttctttagcctgaagcactggatgtgtcagaagatctgggttcaaatactaatctgcctctacgaagctgtgaggaccaaggataagcaaactatttgttatctctggagctgcaattcctctatctgaaaaaaatgagaatagaaatacaagttgtatcttatcccgaggttgttgtgagccttaaatcggttatgagcagacaagtgctgggtgaatggggaagtgctctccgttcttacagtcttgggacatacagcaaacacaaaagtaagaagtaatcaaaatgggctgggcgcagtggctgacacttgtaatcccagcactttgggcagccaaggtgggaggatcacttgagctcaggagttcaaggctacagtgagccatgctcatgccactgcacttcagcctgagcaacatagtgagatctcatctctactaaaaataaaaacattaggcaggcatggtggcacatgcctgtgctcccagctacccgggaggctgaggtgggagaatcacctgagcctgggaggtcaaggctgcagtgagccaagtgagccgagcctgggtcacagagcaagaccctgttcttaccccaccaaaaaaaaaagaagaaaaaaaaggaatcaaaagggccccagctatggtcattggccatttgccctctgtgaagggattttatacacagggtgttaaaactggaaggaatattagagattagatatctagttctgtggttggttcatttatttatttattcattgagacagtgtattagtccattttcacactgctataaagatatgcccgagagtgggtaatgtataatgaaaagaggtttaattgactcacagttctgtatggctgggaggcctcaggaaacttacaatcatggtggaaggtgaaggggaggcaatcaccttattcacaaggtggcaggacagagaatgacagaaggaggaacttgccaaatacttataaaaccatcaggtctcatgagaactcacgtattatcacaagaacagcatgggggaaaatatccccgtgatccaattaccaccacctggtctctccctcaacacgcaggaatcatggagattacaattcaagatgagatttgggtggggacacagagccaaacgatatcagacagggtctcactctgttacccaggctggagtgcagtagcacaagcatggctcactgcagcctcgacctattgggctcaagtgatcctcccacttcagcctcctgagtagctgggactacaggtgcatgacaccatgcccagctaacttttttctttttttttggtagaaaaggggtctcgctatgttgcctaggctaatctagaactcctggactcaagtgatcctcttgcctcggcctacgaaagtactgggattacaagcatgagccactacacccaactctgttctgtgccttatgtatgtatttgtttcagtagcagaccccccttttttttccaaccaaaatcttacttcaaagccacaaacctagaagggagaaaaccaaagtggctgtggttaaaggtaggagaggtggggggtggtaattccaccttctcaaccttctcattacccttaaggcacctttgtagagcccagtgtttaacaatctcattgcatagtgggggaaactgaggctcagataagggtttgcccaacttaagaacacataactaatgcaaggcagagccagacgcaagcctagatgtgctgatgcctaaatgtaacatgaactaccccagtaaatagcacagtgcatttatgcgctcagatcaacccatgcttctgagtggtctgggcaatactcattcaggctcactcagccaggtctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagctggagaagcttgcaacaggctgtgcccaatatgatccaaccaagaatggtaagagactgggaattccctctagtttttgtgaaatgaccataaaaaagtaaaagcttttggcctttaatcattgagggtgtcaggaacagaatgcaaaattctacattttcagaattttccaagaggaatcatctgtctttcctaccagcctgttggtgcttccatctcaaagctgatgtctacagctcctaaccacttgaagtgtgctctttggaccagcagcatcaacatctcctaggagttagttagaaatgcaaatgatctggccccactcatgacctactagatcagaattttcattttaacaagatcccaggagacttatgtgcacagtacagtttgaggagccctgctataacctgcatttgaatggcatggtctatttaaatcttaattaaagaggcagccttaagagatataaaatatttatgtcttacagtgacatcatgtcacacataaatttaattacacaaattcaactctatacccttaaaggtgagaggaattttttttcttttacattttactctgtgatttctccttgcctcctcttcaaacttgcccttgacctccacagtctcagagaggagaaggccgcagtctaaatgcaaagtgaaaacaaaaaaagctgtttttttgcctttgacagtaaaggctcaggtccaggggattgggctgcaactggattttattgatgactttggaaccttaacctccagtcgagtacaactccactcgaatgcatttcacatttattatgctcttgttcctctcaaccatctggggtacatggcgtgatgttaagggaatgggctgccttgagcaattcagtatgctccgggtcacaccgctggaagtgctctgcaaatccattgtcgaataggaataatggcccatgtggattgttttccttccattttcctctcttctcaacctcttttgccatagtttccctttctcatttattcttttgtgcgctaaaacttaatactgaaaattggcaacccaaggcggatgtaacacatggctaggttttctgtggcttcctgattcataggccctctcattgccactttaaaaaccaccacttttcaccctgcaccttggggaaaaaagctcttagacataatcgatccctgggcccagaagaacaatacttaacaagttttagaaattggtaactattcaagtgatcctacacattagtcctgtttaccatattcatgcgggccaatatttaataaaaatgaaatggaaagttttctctggataggatccaccataataacagaacggcatgggcttacctctgtgagtgaaagccctttccaaagtcagtgatctggtctccaaatttctgccaatgccttgctgtgggccctcagatgagtcacgtggccatcaagggccccaatgtcctcatctcaaaaatggcagggagttctgaggggcttaggatgaaataatacctaagcccttttccaattctgaaattctttgacttggtatttccattttgtaattttcaccatgcatgctgcagctattcctcttcggggcgcaagtatttccctcctccaagtgatacacatgtgactgaggtgctagggacatctgaatgactcaccagaatgccagtgggggaggactggtcatgctgagctgttccccatgtgaaaccagggcctgagcactcttggggtcctgctgtggttgtcatgcagtcactgtgctaatggttttgcttttgcattgcaacccattgccatatcctcctctgagcatctcctcactctaccctcttctgatttggttaaataacttcatggatctgagttttgcacagttgagagcagagttttcaagaagcacactgcactgtgaacgcagcttatggtcatcaccctggatgaaggctcacaggattcctggtaccgagcacattggcagtgcgggtctatgagcactgggctttggataatccctctgagcctctaagagcattttctcacctgcaatatggggataatgataatagatagctatgtgtaaggctgggagattcaatggtgttgtggaaagcagtacagctgccaacatttacagagttcttgataaatggtaattgtgtctacttgtcttccttattggtggatgaaagaatctgaggctgagatatagcctcagaacttgtatgggtctgggaagcagcagaagtggatgagtaaaaacagacccagccacacccaacccatagtaacacccatttctgcaaccagaactggccctgatctccccactgtggggagggaaaggaaggaagggaaaagcaaggccagaggacgaagaaagagagaccagtcatagaatgtccagggctggaagtggccaaggctcacagctagtattggtgaagccagagttagaacaccagtctcccagctccaagttgagttctaaataggaaccatacttcctattacaggggttttccttcttctgtggtcattgtatacccaggtcactatcccagcctactctttcttggcaagtctgcacgggactgggctccagtgtcaatgtgtgactctcctctaccacatccctgatgtgagctgtccaacttcaagtcaacctcatacagaaatgaggaactcatcgtctacctatgcagcccattctcttcccatctctcgttattaaggacgtctttgtattagcctgaagtctgtgcagtgcctcccgtaccacagagagccccagacacagccacacacctttgattcattgagtccaggaatggcctttgcagagctacaaaggagaaatagtgagagatgcatatgaagagatgagaggaaggagagagagaaagagaaagagagaggagaagagaagagaaaggaggaaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccggaagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttcctgggccctttttctcagaaaaaccccctggctgctcacttccggttgggtccattagttttcatgctcattttttcttttcctgtttttctcttttcagcttcaaagaagcctcttcctcctactcctgaagacaacagggtgagtgagagcgctagctccgggtgcaggtgggcccacaggctacctgattggcatgttcctatttgcatgtccccctctccccatagttttcaaaccctggctgcatgcagcaggctgtcatgattcagcagaactcaacacattgggtatttttgggcttgaactctcttggggggtctgtccacttaaaggaccattcagctgctaaatctccatctcactttatttattcaacaaatactgatatcaaattgggtggccattcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttactcccaggaggtcgagactgcagtgagccatgactgtgtgccactgcacttcaacccgggtgacagagcaagaccccgtctccagaaaaaaaaaaaaaaaaacaaggtgcacatctactcttcgcaagcattttggagacatacatttgttgatattttatatatttcaaagcacttccacccctttattatctattttaaaacttactatccgttctatccacttcagagggttttagttttattctcattgtaaagcttgggaaatcaaatcccaagacaggtcttgaggcttttccaaggccattcagcaacttagtaggatgcaaggtttctggcgtggtggtctttaactcgagtggtggttctcaaagtatagtccatggaccagaagcatctgcatcacctgggagcatgttagaaatacaaattcttaggccccacccccagacctgctgtgtccaaaacgctgggggaggggcccaggaatctgcattttaataagcctcctcactgatctataatatactgacttacaagtcttagatggcatagtacctactctagggcagcttattttgttaaggagatgaaaaaaaaaagatgggggaaaggatcatgacctttaggtagggaatatgaccctgaccttatgataatattaacaccaatatccacttttctttcttttttttttttttttgagatagagtcttgctcttgtcacccaggctggagtgcaatggcgtgatctcggctcactgcaacctccgcctcccaggttcaagcgattctcctgcctcagcctcctgagtagctgggattacaggcgctcaccatcatgcccggctaatttttgtatttttaatagagaccgacttttaccatgttggccaggcaggtcttgaactcctgtcctcaggcgatcaacccacttcaacctcccaaagtgctggaattacaggcgtgagccactgtgcctgaccaatacccacatttgagtactcgctcttcattccagagcaagttctttaacaagagctttcagattccatttcctcatgcttcttcctgaagaatgagctctgccttttttcccttcagccaaaatggtgacatttcaaaactggcagcgtccccataaaggaagctctaaatcctcaaagccccagcctggtgtttagatctgtcatcagcctactccctcacaacatgagagaaatgtactgaaactgtagcagagaatgagctctctctccttttctttcactgaccttctgcagactatttcaccatcccctttgaaggcctggttcggaaccctactgccctcccttgcagacggttccctcaacagtcccgcctaaacccacacctcccatcttaagtgaggctgctcttgtgtctttatttttggtatcaatgaaggtgaaagccagaaaacactgctggtccttctctccctacactctgccatttggcttttcagccttcttggaggagcatcgtggatactgttttgagtgttctgaccacaaaggttttggaatcattgttctagtttcaaccgcatgtctaaatccaatgcaacggttctcttgtctgagccacttgaaatcatttctctcctcaccttcttgttctgctgcctgagtggtaatgacatctcgggttgtcatacagagaaactgtttttaatccagtctgagccaacaggtctcatgctctatgtgagaaacactgtgagcagggccagtcctccggggactggccagtcctctgggggttgggggatggctattttggttcaagatgtaaaatatccatggtcagagtgaaggacaatcctaggcctcttttgcctatggatacaaacaaggtcgtatatcacattgaagtacaaattccgattcctcttggccccctgcatccatgggaactcaagtcttcctcttacagtccctcccagtcaacccagggcttgctgaggggccactagaatgtgtctgcatgtgtcctttcttgctggctgcctactaaggcaccctatccctgccactgctacctgggctctctgtgagggcccctcagccccgtggagctcttcccacctggggccagcagaggtcctggggggtcaggttgtgctgaggcctgcagcagagtggtcaggaggcaggatcctcattcctttcatgcctcaccacatcatggaggctcccaaacaacccttcctgagcccacagactcagtttctccaaatgccatcccttgattttctcactcaaatctaatggttcccaaccttatcaaactcaatcctgccttttaatgacagatattttgtaaggttccttttgttatcctgaaaagaaatttataactaatataacatatatatacacaattttttaaaattaaagtacttaattaaaattttttgttgctttgagacagggtgtcactctgttgcccaggctggaatgcagtggtgcaatcatagctcactgcaccatctgtctcttgggctcaagccatcctccctcctcagcctccgcagttgctgggactacaggcacttgccaccacacctggctaacttttgtattaaacatactttttaaaaagaatcaacaaatgttctaactgtaatatttaaaaaggaaagaaaaataatatatataacaaaatatgtgtttctatataaatattgggacatgactgcactggaagacagaatgaaatagtcgaattcttgcactggcaggtaggatccattggatttggcatctcgaatgcaactgatacaaaatgtggtattgggactcaactacagcattaccaccagtgatataattttccaaaatgatgaacaactcttagtaaacttctgaaccaaagcatagtcttccctcaaagtacaaggtagttgcattcttgggaaatccagtactttggatagggtacagctaggatctaggctcaggatgttcttatataattactgtataagctggtttctcaccacatgaatgtttaccaggatattcgaaagttgtggggaatgtgggactctacagagcattttgcattaaaggcctatagcatacctcaaactgtgatgttcaaaataacccccatattccaagcttgcatgattattagaaaaaaaaatacatgtccagtgtgcccctacagaaaggtactatcataatttgagggccctgctctgacctttctcttcacagctattaaccaatgagttgacctgcagtgggatgaatgccatagctctgtttcttcttcaaacatccttgaacactattcctccctccataagctcttagagcaaaagcctcaggccatccactcttgtccatagcaccccatttacacatcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccgatctgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagcctacaggagaaggaagggagacaggtgctagagtagagagagtcttagggctaattcaagtggtagattggccaggtccatttctccatctgggcctcagtttcctcatcctaaatgaaaaagtgtattaagtgatctgttagaggaattccagctccaataacctatgattccgtagatctagataaacccacaaatcatattagtaaagcacaaactgaaagatttcatgttgactgcatctcctttgccaagggcatgatgcatccagcagagaggctgctgcatataacatagtgcagatagagaaaccagcagacttttgtgaaaatcacgtggctgcttggaattcactgtggtcagaatttacctcatagaatgagcaatgtgatgaattccaagcactgatgtctttgtgtcatgttcagcgctgtaactctaactcataaagaaagtctaccagaggaaggcagactgtctccccagacaccccgatgaaaggaggcattttacctccttttttatgtctttgcttggttttgttgtctctcttccccagcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggtaagtcatctttgtggctgctgtccccgtgtttgaggtgtggtgcgaacaaataaaataccaggatgatttgtcctatctcccacagtgtaaccacagcactgaggtgggagaagagagcagaggcagaaggaagagggaggaagaggaagtagttgaggctcatttttcctcttctcagaagtggctctgaggcagtcacttgctatgcttgttccctgcaccccatctcaggcactccagacccaaactcatctaaaaaaccccctggatttttccactgacatctacaatttgggagcttggcaatttgttctgcaaagtgctattgttcctgagtgttaagtgaggctgaaggtacatcccattaggaagtgcttatttttggtgaaaagaaaatgtgtgtatagagatggtacagattgatagttatgttaggacgcatcagaaagaagacactaaagatttagttacaatcgcagtcattgaactagccatccacatgactcagggagaaaataaggttgtacaaatactactttcccactatgcaacttttgaatgaaaaaaataccaagcatgagattcacactgccttttaaggtttttttttcctcttaatatatccgatgtattaacccatgctctggaatattttccagaatctgagttcaatagttgcatcaatccagccataaatgtactctaaattgcaaattcccttgttgaacacttaggttatctccaatattttgcaaatattaacaacactgcaacgaacatctttgtatattaatattaggggtttaaatgttttcaaggtatgaggttattattaattttaaagtataaaaaagaaaactgtccttgcaacatatagatcatttatgtcaacattttacttaactaacagtagagagaaatatacataaaaaataagccaccctccatttgcccccacatcaagtccaaaagtaatcactatttggccgggtgcactggctcacgcctgtaatcccagcagtttgggaggccaaggtgagtgcatcacttgaggccaggagtttgagaccagcctggccaacatggtgaaaccctgtctctactaaaaatacaaaaattagcatggtgtggtggctcaagcctgtaatcccagctactccactggctgaagcatgaaaatcacttgaacccaggagggagaggttgcagtgagccaagatggtgccacttcactctagcctgagcgacagagcaagactctgtctcaaaaaaaaaaaaaaagtgatcactattaataccttcttgtgtatcataaataaaagttatacctgtgcaaatgcatccttttttcacttgtaccaagtggatccattctgttctgcatcttgcttttaatttttaatgatattaatacacattgaagatcttttcataccagcacatgcaaatctacctcatttttaaaatagttgcatgggccggccgcagtggctcaggcctgtaatcccagcactttgattgggaggccaaggtgggctgatcacctgaggtcaggagttcaagaccaacctggccaacatggtgaaaccccatctctactaaaaatacaagaaattagctgggtgtggtggcaggcgcctgtgattccagctactcgggaggctggggcaggagaatcgcttgaacctgggaggtggaggttgcagtgggccaagctcacaccactgcactccagcctgggagacagaatgagaatccatctcaaaaataatcataataataataattgcacaatcttagaatgtatgattgtattattagtatttaaataatcctttatggtgagacatttagttgccagtttatttgtttcctctgctgtttcaaacaaggctttaatgaagatcttgtattcatgtatcttggccatctttggaatacaaacatatatatatgatatatatttatcacattagttttccttttcttttttttgagacagggtcttgctctgtcacccaggttggagcacagtggcactctcacagttcactgcagccttgacctctcaggctcaagtgatcctcccatctcagacccctacagagctgagactataggcacgcaccaccatgcccagataatttttgaattttttgtagaaatggggtctcattatgttgcccgggcttgtctcaaactactgtactcgagaaattctcccgctttagcctcccaaagtagttgggattacaggcataagccaccatacctggcctatatgtcacatttctaactgtgcaacagttaagtcagagtatgtgatatcttaattttgccacataatttcctcacaaagcttgccaaatttaccttcctgctaacagagttatggaagtgccaagactgggtatcattgaacttttaaaaaaagtcaatctgatgggttaaaaaaaaaaaagaggggcacaaatatctttaaggataagactttaccttttacatacaccagaatttacattttcaaggtgccttctctttaagtaggcttatcaaccccattacagggggaggaaagacagaagtgagacagggtaaaacgtgatgagattcagaaccatggtttgagaggcagtgtggtttgctagctaagaacagaccccaactcccctcgtctggaacctccctttctagttgattcatgaagacaattgagctagtcacatcaccttctctctgtccattatagacaggcccatatccgaaataggttcaagactgtctacagggtctacaaacaccgaagggacctagaaattcattagttcaatcaactgactttacttagcacacctaatgtaccaggaaatttgttctcctaggccttacttccccaaatgagagttaaacccttcatttggtgacctgtggaaaggcttaactatgcacttcaaagggcatcaaagaggacaccccagcagccagtcagcattatgggaatttccccagtttgctttgtgatagtgtggtatagtggaaagcacacaagatggggagacagaggacttggactttatcagctactcttgtcatatgaagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatgcattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggtgagtctcatgcctcaatctcccaagtagctgagactacaggtgcatgccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggagtatctacttaaactagattttaagtataatatagtttaagcccttcatttgacgggtataaagtcagaggtccagagagtagaagggatgccgctttcaccctgtggtattaaatgagataatgaatgtgaaagtgctttgaaaactacaaagttatacacaaatgtaaagaagtttgatattcttattttgtttattatgttttttgtttatgcacaattattaattcttgctcaaaagtgactcctgatccccaaatctagcctggctttatcctttttttctcgtgtttataccgttcatatctgaagaagctcaattagggaggccttaaattaaaaagcttacaatgccaactggtagtgtcttttagaatctgtggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattccttttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttgtgtgtgtgtagttttagtagagacagggtttcagcatattggccaggctggtctcaaactcttgacctcgtgatccacctgcctcggcctccaaaagtgctgggattacaggcatgagccaccgcccccggcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttccttttaacaggcatgaaggatatgtaccaagcagttatctggtggaaaaatctccaaataatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatgtgggcgtgtcagatgagcacagaagttggctctaacaggctccatttgatgaaatctgggacaatttgagtatcaaaataaataatgactattaaaataagtaatagactacaaaccattgaataatataagaatctgtaataaatagatagactgatagataaataaagaagtaaataaataaaaaggaaagggttttttcttatagtagaatgccaactaatgaatgataaagtttaaaaatcatcattttgtaacccagagtatcaactgattcaggcaagaatcctcaatgaatgtcaccactagcaagttaaagtttgatgagctgtggcatatttacatagtctcaaagtatctcctcacaaatcacttgtaattacaaagtggaggtaactagcaggcccgtctgaaacagtcaatccaaatgcacataaataatggagcaaaaaggtatcttgtgtctccttatgtgatgcactgagaagggcacacatcacttctgtgatattcctgctcaaaaaatgcacaacataaatttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtgtgatggcacacgcctgtagtcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcatgacttcggtaattgtactgtggttagataagtgtatactctgtgtcttaggaaatagacacagaagtacttaggaataaaagtcaattctcaaatagttcagaagaaaagtcaatctatgtctatctaaagagaatagtaaagcaaatgtataaaatatcagcaattggctcatctgggttatgtgtatatgatggttcttttacactattttacagcttttctgtaagtttgaaattatttaaaaattttaaaaaattaattactcactaaatataagataccaggcctaaagaataaagctaatgaggacacctattaacgcattagggttcttaattcaaatgtggtcgtgttatttgttgctgaaattctagtagattctttagtgaagaaccgtcattttctggagtctctcaaccttgtttgttttgataaagtatgtgtgagtagcccttccctcagtgaacagaagggtcatcagttctaagaatttttgagctgaaataaaacatatagggtatatgcttaaataaaataaaaaatctttataggcaatacctttgaagaaaaaacaataagcatttatttcaaatgaccactaggctatgtagttttgtttgttcaactttgcttttaatcagaatctctttgtttatgatcaaaggagcaaactcaaaattccaacaggataagcaataggaaatggtgaggtctggagcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcatgggttggtaaattgaatggattcaggtctcctgccttggtttgcagccatgaccttgggcaagttacctcaccctatttgagttctgatcccttctccataaaatgaatgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagcctatattttcccaatcctcgattagataatctctaagagcccatgttggtgtcatgtactgttctgtcttataatgttcaaaacctctaacgaatccatgaattcctttagtcatggctactctcaagtagccaaacaagtttgttaagtggtattccttccctacccagaacttctctcctcctgcatttattaattttcaaaactgattattaaccgatgatcagtctgcctcctcttacctaaaaagcagccagagaggttaggatgtggctaaatattgttaacaacataaaaaaaaaacttcatccctaaaaatcatttatattcttctttaccattttatagttgtttttcaccagacaacaaaattataaaaataatgcaattacttggcagaatgtctggaagagcagtcttaaagaggaaaatactacagttgttttaaaaggatatttgctaaactttcaaactggtattacaattttatagctgcactagcaccctcctccttataacgaactgtctactgacttatgaaacgaagaggaaaattaatgttttctaaaactttattttagaaaatttccaatgtatacaaaagtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaatatgtcattgacatatgacttttccttgctttcaggtggtacaataagagtatcagccgagacaaagctgaaaaacttcttttggacacagtaagtctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgttggattaacgatagttttcatgtctggtgaaaatattctgggaatttacaggactagcaaaccacaggataagaaacctgggcttggcattgacgtggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagccatgcagtgtgcatagcaggaccgattttactcagggatgtcaagattaagggcgaaagggaagagaaaagtagaaaagatggtatggtggggcaggtactgggctctagttcctgttatgtcaccaactcattgggtgactttggggacctctcttcttccttctgggcctcggtttctcagtgagtagaagggcagaattggattaagtcagggatcacagttacccagccctcatcctgccactttctgctccttgtcctgtgaccaacacagctgatctcagtccatggcattgggactttattgggaaacaagacaaatgcagaaaaaagagcaagggaataatctaaaataaactaaggtaaactccagaggagttgggaaagattccatgaagaaaaagaagttgagctgagtccttactgaactctggtctctccttggctctacatcaactcagcacttaattatttcctgtgggttccccaaaaaaacacacattagaattgctgggaaatgttcaaaaatacagattcccaggtcccaccccagatccacagaatcagagtctctagtgttagttcccgggaatctgtactttctcaagttaaatttacaatgcaaatgtagccaactcaaacctggcgctgccaggctgtgttattggataacaaagtagaacttgattaatatgaactaattgagtggagtgcaaaattagctaaaactctgaattacactgtgtttaaacaagtatagttttgttatattaatcacacatcagttaatgacgtctatggagcacttcaaacagcccacattaatgacttctaaaagatgattcctgtattacagcagttcttgtgaggtgctaagtgctaagtacattttgcttgctctggcagttgaaacattcctccttactgatacatatatatatatatatatatatatatatatatttttttttttttttttttttttttttttttttttgagacagagtctccctctgtcacccaggctagcatgtagtggcatgatctcggcttactgcaacctccgctgcctgggttcgagtgattctcctgcctcagcctcctaagtagctgggattacaggcatgtgccatcacacctaactcatttttgtatttttactagagacggggtgtcgccctgttggccagactggtctcaaaactcctgacctcaggtgatccgcctgccttggcctcccagagtgctgggattacaggcatgagccaccacgcccagcctccttactaatattttgagctactttaccaaattctcttctcctccttaggtaaatatgagggcaaacatcaatgggtccctgtcagactcagcccagattctggatagaattgaatgacattttcttgctatttttcactttttttgtgtgctgtttttgaaacaatagctgtattatttctaggtgtatttagagtctttttatctaataagtataggacctttaagagatgaattcctgcatagtattccatggcgtatatgtgccacattttctttgtccagtctatcattgatgggaatttgggttggtaaaaggatgagttcatgtcctttgcagggacatggataaagctggaaaacatcattctcagcaaactaacacaggaatagaaaaccaaacactgcatgttctcactcataagtgggagatgaacaacaagaacacatggacacatcacacaccaggaacatggatacatcacacaccagggtctgtcagtgggtggggggctaggggagagataggattaggagaaatacctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggctgtatttcagagacactcttaaagtataatgcagcataacaagactatgaattatcagtccatctgttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctcatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaatccttttaaacccagagattctggaattcaaacaaatagcatgggccactgtctgtgtgtgtacacagatatgtgcccacaggcaaaccatcattttagttgtgggatagaaggatttgtgttgttgtagtttctatatactttgttccttatactccaagtgtatgccctccgcacaaggatcttgtctaactctgacctttacttagggccctcattgtgactaagttaagtgaatcataatatttggcttaacaaatgttaccagtgcaagtttacagcggggtaggaacagagtgttagataggaagtacttaaaatagacttcagattttttaatttccaccaagaatgaataaaatggtatgtccatttattagtgcttatttcatcagtgctggcaaaactgtcagggtggcgaaagttacattctcagggcactcccttcttcccacctctctcatgaaaccaggagcttaatgttctttttccttccgccctgcagccaaattctcattctggaaagggcctaagaaatatattatcattaagagaatccttatacactgttggtaggaatgttcattagttcagcccctgtggaaagcagtttggtgatttctcaaaaaactaaaaataaaattattattcaacccagcaatcctattacagggtatatacccaaaggataataaattattctacctaaaagacacctgcactattcataatagcaaagacatggaatcaacctaggtgcctatcaacagtggactggataaagaaaatttggcacatgtacaccatggggtaacatgcgccctgaaaaagaacaaaattgtgcattctgcagcaacatagatgcacctggaggaattatcctaagtgaattaacacaaaaatggaaaaccaaacaccacatgttctcacttataagtgagagctaaacagacatcaagatagtaacaatagacagtggggactccaaaagttggaaggaatggagagtggcaaggatagaaaaactacctattgggtaatatgttcactatctagcaaatgggttcaatagaaacccaaatctcagcaacacgcaatatgtccatgtaacaaacctgcacacatactccctgaatctaaaaaatttttaaaagttatatattcccattaagacactgatgaagttttcaggacagttttgtgcctttgtagggaaatggagaagcagcttctaacattctttgaaaggaggcatcctggagtagtagaccaaggctgggctttgctcacataccagagttcaaatccgaattctgtcactttctagttgtgggtcgtgggaatgccacttaagctctctggcactcagtgtcattggcggttaaggataccaatatccagatggcaatattgtggtaagagttggaaaatatctgtaaagagtctgatacatggggagctctaaaagggcagagcttatgtctctgtctccattcatggttcatgtcagcatgagaacagtctgggatccatgtaggagaccaagaaatatctacggaaggacaggagtaaatgaaacggtagccattcttactgaaatctgctctatgccaagtgggcctacagtatttcctccttctgtgggcaagaaagtggagctggaggcataagcctggtttcctgagatcactaactttccattctttctaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaaaagacaacaaagttagacagtgcaagaggtagaggctcactagaaatggtctgttttccctctttactccgagaaaaccaaagccatggagatcaaggatagaacttaagagacttagaaagtgacagagctgggagtggatgccaggtcctctttcaattagcatctccaattttagagttctaaagacataaaatacttggcactgtattggatgagtatataatttaatacatagaataacagaagagatatttctatctggaagcaaaaatatatgaactccagttctggctctgctcataaaactacctaccattaactgagtctttattatgtgccagaaaatatgcagaccatttccaatcctaagaagccctgaaggcaggtattactatgctcatttcacacagaagaaaccgaggttcaggagctgatggtgcctccctatggccgtgggtctgaaggggccaagccacatccaggctccagccaactggactgcaagatccttcctgcttttctgcccctctgtacctgtttcttctctgtaaaacaatgcctaagaacctatctaggtctcaaattcccttctaattagaacatttgttagaactaagctgtttgacaatgaccaaagtgcagtcagaattaagagaagagacaaataatttttaaggtgtcttcggaaaatttttttggaagactgaggatgtgagcaggacgtggagcaagggcaggtggcaaagaggaagggcccgatccagggataggagggaacacagtgtacatcacagaggggccgtgcctctaccatggctgggagacagtaaggaggtgacctgcaaccccacaggtatgacggagaagggatgaaacaaagtctgtgtcgaggctccccacaactacccccagcttcagggattcactaggaggccttccaggacaaagacttattgagatttaatacagcaaagtgatacaaagcaaaatcagcaacgggaaaagacacatgggacaaaatctagaggaaacaaaacacaagcttccaagagtcctctcccactggagccaaacaggacgtgcttaattccgccagcaacaagttgtaaccacacgttagcagtctaccaggggagctcattagagactcagtacccaaggcttttattggaggctgtttccacagacagcccctgcctagcacatgccaaagttccagatacccaaaaggaaaacaagcgttcaccataaaacacatgtttctagcagacggtttaggtacagctcgccacccttatcagttagggaaagagccctcccgaaatccaagttcccaaacaccagccaagggttaaccatgcaagcaggtctttctaaggagggtagtcaggcctgttatgttcatcctctgcagcttatttgacttatgaagtcaaataagggtgaaggggtcagagaggctttctcaatgtatgctgacaatcagttaaattcatagaataggcaaggcaaacacatagcaaatatttccattccctcattttgtggcaatggaagaaccatcaccaatccatcacagcattgctgtccactgggtccagacacaacctcagagtcctttttaacacagtactgcagcacccaggcccaatctgtcaagacagacttataagttgaacaatatctgccaccttgtgagaggttataagacaaagataataagaacttaatactcgtagacttttttgtgtctcaacattgcttcttaataatcattacatttgtgtttcatttgtttaagtgagaacaatccctgtataaagcattatcacatcaaggaaacaaatgacaatcctaagcgatactatgtggctgaaaagtatgtgttcgattccatccctcttctcatcaactatcaccaacataatggaggaggtaagctctagagcaggggtggacccgggccgcccagcaggaggtgagcagcaggtgagcaagcattactgcctgagctctgccttctgtcagatcagcgtcattagattctcataagagtgcaagccctattgtgaacagcacttgtgggatctaggttgtgtgctccttataagaatcaaatgcctgatgatctgagatggaacagtttcatcctgaaagcaaccccctgccacatccctccatggataaactgtcttccacaaagccgatccctggtgccaaaaaggttggggactgctgctctagaggacaaagccagagggcacctgggttagacttttttgaattgctatcaaggaatacctgaggctgggtaatttataaagaaaagaggtttaattggtccatggttgtataggaagcatggtgccggcatcttcttggcttttagggagccctcaggaagctttcagtcatggcagaaggcaaaaggggagcaggagtatcacatggcaggagcaggagcgaggagggagaagatgccacagacatttaaacaaccaggtcttgcatgaactcagagtgataactcatttattatcacaaggacagtgacagcaccaaggcatttgtgatggatcccacctaatgacccaaacaccacctcccatcccaccaggccccacctccaacatagggcttttcttttcttttctttcttttcctttcttttcttttctttcttttttttttttttgagacagagtttcgctctgttgcccaggctggagtgcagtggctcaatcttggctcactgcaacctccacctcccaggttcaagcaattctcctgcctcagcctcctgattagctgggattacaggcatgtgccaccacatcccgctaattttggtattttttgtagagacagggtttcaccgcattggccaggctggtcttgaactcctgacctcaggtaatctgcccgcctcagcctcccatactgctgggattacaggtgtaagccacagtgcccagccagggattacatttcaacatgagatttggaggggacaaacatccaaactatatcagcacccacacaggagacttaatgaaaactggcaaaagctcgccctggcttctttttgactataaataataaataaatatacaaatagaaaaatatgacaaatatttaattatattatatatcttctattagcaagctatcttgtggaaataatggaattttaccacttgcccatctgtgcttatgatgttttcaaggaggatatgatatcaataattaggctttgggatttgttttccagaataaaattagcttttgcgtctgatgatgattattattttttttagtgatttaagttagatggttgctagagcaaagccctaaccactgcttcttggcttttcaatcaacccaggcctggtgactcgactccggtatccagtttgttttgggaggcagaaagccccagttacagcagggctgagatacggtgagcagtacaatcaggaatgtaaactcatgtccctaaaggtctggggcaaattctgaataaactggccatgagcctacctgttcctcagactacaaatcaccattaaaacaagtgtattatatatctagagatgatggcactaatgaatatttacattgtgtgtaagagaagtacatatacaagcacatttctctaggtcaaaccagtggccattggttttagtgaagagttcattaatgaagtgtttattaagcacctactttgtacagagcaccctactaaatgctattagaaaaatattagaaaaccatgccttagcactgtgtttccacctatcttctagaacttttatatcatctagttggttgagtagcagactattgccagaactgcaagttgagagcatctagaagtgtttctctgcataagagagtgttaaaattctttggaatacctttaggcgtggcatgatctccagtgccgcagcccctactatgttttcttgccctacggaattgcttcactcacttgggattacctgcctggactctgaaggcatttggctttgcatcccttggtcccaactgtgtgctgcctgtggagaaggctggtctaattttcatttcttatctcctagcttggtggttctcaaatttcagtgtgcatcaaagtcttctagaatgcttattaaaaatgttgactcctggctcctatccaaacactcaccaaaacacaatccttgatagggtcctggagtctacttttttttctggcatgatctccctctgtcacccaggctggagatgcagtggcgtaatcatggctcactgctgccttgacctcctgggctcaagcgatcctcccacctcagcctcccaagtagctactatgcctggctaatttttaaaaattttttgtagagacagggtctcactatgttgccctggctggtcttaaactcctgggctcaggcaatcctcctgcctcagcctcccaaagtgttgggattacaggcatgagccactgtgcccagctgagtctacattttaaacaagcatgctaggtgattttgatacaagtggtcagagggcaatactttgagaaccactgccacgcatgggcttctttatccctaaccagcaccgtgtccggcacacagtaggtgctcaatactgcctgctgttgagtctctgcctcaaagcagtggaaatctggctgtttaggtaccagaccaagcactggggaaagagtgcctctttagcctccttatgaaaataagggtattctaataaatgtagaatcttgatgtgtccgtgctggatgggatttcagatattacctggtcagcctactcattttgttggtgaggaaattgagcctcggaatctcgtatttgtttgttaaacatttcttgagagcctcccatgtgccagacactgtgctagcttgtgcctctgcacaaattctctttaaatctttctctttaactgcccctctgccccagtaaggcctaatagggttatgtgtatatagcaggtgctcttaatagatgaatgaatgaaagaatgatcagctcaatgaaatttacttagtgtgaaaaatgacatagaaaaatgggacattgcaagaaccctttctttaatattttgattaatatggtttctttaatatcttcattaatgccactctccttctttccatgttaccttcccacacatattttcatagttttctagcatatcctatgttattatgtgggaaaaagataatttatttgccatctttgaattatattaacaataggctaaaattctagttagggctttatagtcccctggtatcccaataccttatatctactgcttgctgaccccagagaactctctctctctcttccagggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgtgagtgctcagaacaaggatatgcagaaactctggggggaacatcggttcagtgttcttgaaatgccattcaaacgccagggggtactatctccctgcgcaaactcccagcagtggcttcctattgcacagagaatacaatcaaactcttcacagtggtctccaaggcccaccataatctgatcatgcccacctcccccttctcagctcctacccatctctcctccagtccatgacatgccagccacactggcctctgctcatcttcacacacacagctgactccttgccatttttcaggtctcagctccaatgacatgtttttgttttggggagggaatgaatattattttcatccaaaccataaattagacaaaatgaccattggctattttggtaccataatattttcggcatttttgggagactgagtttaggccatctcaccccttgtctttttcctccaggaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggtatgagcatgcagggtgaacacccacaggtccagggtaaagggacagttctcactgaaatgactgggaacgcattaataaataatacattacagataatctcctttcctttctcaacttctcccttccttcacctactttgggtggtcctagtggaaagggcttcatgaggacttacttctgggctctgatcccagcccaaactctttcacctcctgcatttcagtttatattcttccaaaatggagataactgccactccttcttaacctctctgtgactcaatttcctcctggtaaattgaggaaactgagtttgtctgaaggtattattcaagggtctaccagaatcacactggggaagcccttaagctactctcagaatctctggtggctgggactcaggaatattcattttaacacattccccgtatgatttgtatgcacattaaaatttgagatatgcagctgggtgcggtggctcatgcctgtactcccagcactttgggaggccgaggtgggcgaatcacgaggtcaggagttcgagaccaccctggccaacatggtgaaaccccatctctactgaaaattcaaaaaattagctgagcttactggcgggcacctgtaaccctagctacttgggaggctgaggcaggagaatcacttgaacccaggaggcagaggttgcagtgagctgagatcaagccactacactccagcctgggtgacacagtaagactccatctaaaaaaaaaaaaaaaaaaaaaattgagacacactggagtgttatctccaatggctttttcaatgcaacagtctataatactaattaggggtcaggtactctccctattgaagaacagttttaagaggattaacaacatcaaaacattcttaatttagtcaactgggagatgctttcttcctgttatccctgatgttaacatttcctatcacatcaggttgcattagagcctatctttggttagacaacaccaaggatttctaattagaactcaagaatgaagataaacttactcatcttgatagtggatcttacacattcaactttccagttaacttccagcggcatttgtgaggcttaattaacatttgtaaagctccatgatgcccttgtatgacagcactgcagtaaagcaaaggactgtgattataggagactccttaactactgatgactcatcaacagttttcctctccgcctttgtttgcctgtctcctctccaggctgccagaaattgtttggtgggagaaaaccaagtcatcaaggtgtctgactttgggatgacaaggtaaaagagggatgtggtgccggtgaagtctcaggaatgggactgaggcccccggaacattctgaccttctccctccactctcttcccaggttcgttctggatgatcagtacaccagttccacaggcaccaaattcccggtgaagtgggcatccccagaggttttctctttcagtcgctatagcagcaagtccgatgtgtggtcatttggtgagtgtcatgctgggccccactgccccatgatctgggcttcaggccagctgtttcctttatcaaatgcagacaaccctacccacactgaaccctgtatcatatcatgagggtgtcccactggagggttgtgtaagaaaggccccgaaaactatgaaagggccttcatcattttgtttgtttttagagatactggacatggtggtgggagttaattaaaagtggaaacaagagttctggtgccagctgctgtgaagtcaaaagctggagaagtcaggagattcaaatatgagccccttgaaggcagggaccatgttttgtccaacactacatttccatacttatctctcaataagtattaatatttattcattcattcaacaacaattaactgatcatctattctatgccaagggctaatctaggtgctgaggatgcagtggttcatagaacagaaaagacttctgttcttttggaactaaatttgagatgggaggggagacagaaaatcacaaaagatcataataacagtcataaacaataataataataaacaagctaagggatagaagataaagccaggcaatcataagtaggtgctatgaataaaataaaacagtaatggggcagagtgactaggatagagagagggtctgctttgaatagtgtggtgtgggaaggcctttctcagaaggtaattcttcagcagagacttgaatgataggagggagctgtcaccatttgaagagccagggaacagtgtccctgacagagggaccagcaagtgcaaaaacttggtgcatccaaagaacaaggggtactgacttattgggagaacaacaggcaatgaagctggtaggccatcataaggaattagaatttctaaaaagtgcaaatggccatgaagggatgaatgatgttggtattgcaggatgtgccaaatgttcttgctggatttgccatgtcacctgaagtcatagtttgtgcatactaaagtgtgcaaaaaaatataccagacaacctctttgatttggattacaagaattatactgtggacagaaactacttgaagattgatttttgccattcggtatgaaggaagggtttgacaagggcttactagtagtagaaaccaggggggagtttggctaggtaaatcttttaggagaagaatgagtgttaaaaatcttctgcagcattttagtctatccatctctaggagccaagtggtttgttcattatgagtcctacctatttcttaaaacagtaccctattaaccaacccttgcagctactttgttaaccaggtttaagttacagaatggacttgaaagaaattgtactaacagcatttttggatgactcccctctccccagtgtgtataactaggaaggttggggctgatgtgcagtcatctcactatgggtgatgaaactgatcacactgcaccaagcaagcaagggccccacaatgagacatttggagcaatggccactttagcacattcaccttctgactctgaatggggtttattcagccaaagggtgtcagcctgggaatttcctggggcatattaccattacagggttgggctgaaattagtccctgtctaggatatattatctgaagagagtccagaaatgaggttgatggatggatgcagaattgagagatcaatggaaaaaagtgtgaaaaaactgggggtaccagcctaagcaacagaaacctggatgagctgaaaactccatgcctgcatcagcccattggactttgtcctacgttttaagtttctttgccctaattagcagtgtgctattcagaacaagtcaacctctttgtactttgctcaatttttttatctatacatttctcatctgtgtattaaagcaatcattctgaaaccatgtttcagcatcggcacattttcaaaaaaattttcactaaaaattatggtgtcttggggtgataagcattcttatttagggtcaggttctgaatttccaactcctgaggcacctctgagtaacatctagagattctgatccactgggtttgggctagggcccaggaatctgccatttgaacaagactctgagatgatttttattcaggtgttttggggatcatgctttgggaatgtctactctaagattctctggaacaacctttgaaaagctctgaattagctgatttgcaagcagccttcttgctctgacaacctgtgaatatatcagcacatgataaagacaaagctaggtgtcacatttctaccaagggcagaagaggaaaagaaagggattaaatcagaggtcaaaaatagacaagcaaaagatgtgttttgcttggtctacatggcattttttaaattcaagaagttcaactcttaatttttgacgtcttttttaaaaaaatcagaaaatgtgccaattctgatccctcattttcatgtgccatactttggttggagtcaaatcatagctgtctccttaagacagaactgtttatctcattttccacaatcctccccaatcccaatagtgtcacacctcctgcactccattcatttacatcctgcatcttggcatttgagtctacaactcttagttgtagcatttgagtttggtacaacaaagggtccatcttgaaaatccttctccactacaaaggttgggaaatttcagttctttaaaaataggacaggcctaataagcctcaggtagacttgatgcacttctggaggtagcacatgaatcctaatgcaaggagtctgtaatttctagaggcaggttggtttgtttgctgtctgtgggctttgtcattcactgtgctgtgctcaccatttcttgtaggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagaggtcagtggaggaagtgcttccccatgcattgtcgtatacaatttgaggacctccctccttccctagagaaaggaaccctctcagaaggatgaggcaggagggataactaatatagattagcaacaacatgactttgaggatctgttaacgggatagatcccccatccctaaaggagctgaaggcgaccttaaatattatttggtttgctacataatgtcacaagctataagcatagcttcagagaggaggatggggtgtggcctatgccagcttccttctcgattttctgagaagagaaaaaaagtctgtaacatcataaaaccattaaaagcacaggaagttagttctataacttggggaacaaagttcacttgcactatgaaaatattaaaatggcttaatttgagttcattttattcattctgcatttaaaatggggagccaattcctctgtacccgcccaggtggctcatttaccccaaccttggattgcaggccatggcttgagccccatcactatgagtcttagtctttgctgtctttgctgagttagaaaatcatacatttcagccaaagtggaaagttgctgaaacagagaattaataaaaattctgatcattgtacgacaacaaggtggaatacaaaaaatttggaacactaggattttgtctcagctttaccatttatttgccattaatctttgacaattctctgaacttcctttttcttactgttaagagaattaaataatgcttggtctgtgagttcatagagcttttataatcagaaacaaagaaacaatagagacataaaggagggcataaaacaaatcttatccacttcataaggattagctacaataataataatgatggctgacattcagttggcactttttccctcttttaaccatcatttattgatttttttaaattaatagtctttattttttaacaaagagtacagagttctcatatgcccacctcacctgaacagtttccctgttcactaacatttggcatgagtgtgatacatttgttacaattagtgaacctctattcatacattaactaaagttcatagtttacattaaggttcagtctttgtgctgtagagttctgtaggttttcacaaattcatgtatccatcattatagtatcagacagaatagttttactgcactaaaaatctcctgtgcttcacccatttatccctctcctcatccccaaaccactggcaactactgatcttttcactgtcttcatagttttgcctttctcagaatgccatatattggcatcatacagcatgtaggcttttcggactggtttctttcatttagtaatatgctttaaggtccctccatgtcttttcgtggcttaatagctcatttctttttgttgccaaataatattccattgtatggatatatcatagtttatttatttacctaccaaaggaaatcttggttgttttcagtttttgtgtttgtttgtttgggtttgtggggttttgtttttttttttgagatggggtcttactctgttacccaggctggagtgcagtggtgcaatctcagctcactgcaacctctgcctcccagtctcaagcgatcctcctacctcagcctcccaagtagctgggaccacagacatgtgccactaggcccagctaattttttgtatttttggtagaaacagggttttgccatgctgcccaggtgagttcaggcaatcaatccacctcaggcctcccgtagtgctgggattataagtgtgagtgctcaggcagactggtttccttcacttagtaatatgcctttaaggtccctccatgtctttttggcttgatagctcatttctttttattgctaaataatattccattgtatggatatgccacagtttgtttatctatttacctgccaaaggaaatcttgcttgctttcagttttaaacaattatgaatacagctgctataaatgtttatgtgcagatttttgtatataaattttcaactcaattgggtaaatgcctaagagtatgcttgctgaatcatatggtaagactatgtttaactttttaagaaactgccagaatgtcttccaaagtagctgtattattttacattcccaccagcaatgagagttccttattagcattcattgttttggatttcagtggttctaatagatgtgtagtcatattacattgttgttttaacttgcattttcctaatgacatatgatgttaagaacattttcatatgcttatttgccacctgtatatcttcttggtaatatctattcagatcttttgcccatttctcaatcaggttgtttgtttacttattgttgagttttaagagttctttgtatattttggatacaagtcctttatcagatatgtgttttgcaaaattttctcctagtctgtggcatgtcttctcattctcttgacagtgtctttcacagagaagacttttcaaatattttaacaaagctcaacatcaacttatttattcatgaattgtgcttttgatttacatctaaaaactcattgccaagcccaatgtcacccaaattttctcctatgttactttttattttatggaagttttataattttgcattttacatttaggtctatgatccactttgagttaattttcctgaaaggtgtcaggtctgtgactagagtcattgttttacatatggatgtccaattattacagccctgtttgttgaaaagactataccctttctcctctgttcctttgttaaatgttagtttactatatttatatggatctatatctgggctgatccattaatctgtttgtttattctttcactagcaccatcctctcccattactgtagctttagagtaagtcctaaagtcaggtagggtcagtcttctagctttgttgttcttcttcattattgtattggctctctgggtcttttgcctctccgtataaatgttacagtcagtttgtcaatatctaaaaaaaataacttgctgaatttttattaggattatattgaatctataagtcaagttgggaagaactaatattttaacactatagtgtcttcctgtccatgaacatggaatatctgtccatttatttagatcttctttgctttcttttattagaatttttaattttttctcatttagatcatgtagatattttctgagatttatacccagatatttcattttttggtgttctttagcattaatttcttgatatatttttatatgtgatttattgaattctcaaaacaatttcatgaggtagatactattattatctccattttacaaatgacaaaactgaggttcaaagaggttaaataacctgctgaatgtcacacagctaattagtggtaaaactgagattaaacactagtcccttggattccagaatacctgctgttaacaactaggacaatgtatatggaatacagtcaacatggaagcacatacaaaaatccacaggggatgctgctattaaattctggtttgttttggatttacctatgacgcataagtacaaggaacttacagagttcttttttccctctccagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaataaatatggtgcatagggcctcggttccatatttatttaaatcgcaaactctcagaacttttccttaagtaaaaatggttacattgtttcattttccacagacaattaaagattacatatcattgaacaacattcattcaacaagtaaatatcaaacgttcctatggttcatgcacacagttcagtgtatgcatcctcatgaaaacaaagatggaaaagtcatagtctttacttctaaaaaattcctagtctgattgaaaaggaaaacatatgaagaaataaaattataatagaacaattagggcaacaacaaaaaactgtggtcaaagaagagaagagcccagaataagtgatggaatctatcagggaaaggatgacatcaagggaaacttcttagagccctgctactcaaagtgtggtccctggaccagcagcaatagcatcaccatgttgtgaaaaattcagattctcaggcttcttcctcacctaccgagcaagaattgtcattttaacaagatctgcaggtaatcgtatacacattaaagtttaagaagcactgtcgcgaggatatactgtctaagccagttttgaagataaatttatgagttataaggtaagtaagtgggcagaagtaagagacatactttccaggtagagagagaacaggaagtattgggaagctattgtcagttcactattgctggagcatgcgcgcatgcgcgtgcgcgctgtgtgtgtgtgtgtgtgtgtgtgtgtgtgtgtgtgtgtgtgtgtgtgtctattttctcagcaagggtaaggatgatagaagaggtgggtaaattgaaactgaatctataaatctatgaaagaactatactttaaaagaccaagaagttggaatttcaccctataggtagaaaagatgtcattgcacaggaagagaaggtcaaatttgcgatgtgtttaagaatatattctggcagcagcatagtgaatggatttgagaaaggcaaagccaatggaaaagaaactaatttggagattatctttgccttgttcacagtaccatattatttttcctaatcattcactgtcatctgttgtgtgggtgacatatggaaattgtaatttggagtacgtcattcactttagatagcaataaaatagctttccttcttaaaaccccagtaatataaaggctgggtggttatagttttggtgtgctgagcactctgtgcctttcagtccaccaaatgcccagctccattgcaggagccaggtcatgcgccagtcaaccactgagcatggaagagaaagcccaaggcttccatgcagtccttcctagaactcacctctgtgcttgaatcccactgccaaatcatccacatgagaaagtcaaaagcagattggaggaacagatctgcttctcagaggatttttcctgcagaccctgctcttctcagaatctcccaacacctaaggccacccttttgaggaaaagacagaaatacctcattcagcaagacagggagtatgtgcatcatcaggtgcagaaagagctgcagattcccaattagagggcttgggaaggtggcctggtcaggaacagagggctaggggtggaagctgcatttgaacagtaagcacatggttttactttagaatagatattaatttgcgtgggctttaatggggaaggtgctgaaattttggtgcactgaggctcacttcccagagccaccccttggtaccagcactaggggtgtgtgtatggttgtgtaagagtgtgtctgcaatgactttgagattctccccaaggtacaatgtatagttggcttgtagtataacagagtcatacagacaatgagtggtagacggagttttagagttcatttacttatttcataaatggttaccattcatctactatgactctttgttaggtacatgatctaaaaagatgactaagatatctcatcagttagggaccaagcacgtcacaatcaaattagtataattcgaggagagctttttgacaaaaggactatttaaaactgtgtggttcagtttaggagaaccttagaaagtggtacagaggaaaaccacagcggggcactcatgctatggtttgaatgtttgtgttcctccaaaattcctattgaaacgatctccagtgcaatagtattaagtggtggggcctttaggagatgatcaggccgtgagggctctgcccttatgaatgagattactgcccttatgaaaaggtttgaggaggtagtccctttttgccctttacccttctgccatatgagaacacagcaacaaggtgtcatctatggagcggagagcaaaccctgaccagatactgaatctgctggcgccatggtcttgagcttcccagtccccagaactgtgagaaataaatttctgtggtttataaattacccagtctaaggtattttgttatagcagcttgagtagcttgaaacaagtagttatcaccccctaggcctgaagggataacaagggagagtggtcatttaaatatggaaggagaatattggagagtgctgccttaaaggagaagacctttagtaagggacagaggaaacccaaggcaacatcacagggaggaagccaggggcatcaatactctgcctcactctccttcctttctcccatcaactgggtcttctattggtcaaatcccactgaacgcagaggacaagggagccctagtagggtagtccatagaggtcagtctccaggaccagagtgcagggtgagagagtggagtggatctggggagacaaagagaagatacctagtacagacaccaatccttcctataagagggctcagcctagtgaaaaagctcaacacataaaccaatgcaatcgattctcattgcttgtagattctgtattggtaaatttgtctactggataaaatttgtttataaccctaaaatcaatcctggaggcttttcctgcagtcattcatgacatgccaaagtgtggagcagtaaaaattttgcgttgctccatatacacattcccaactgaggtcaaacagagtggcgttcagctctcatgctgcaaacaagtggcttttctcagtctatttagtgacacattttctgcatttctgtactttttttctggtgattttgctgtttaaaatggcccccagccaggcacagtggctcacaactataatcccagcactttgaggggctaaggtgggtggatcacctgaggtcaggaatttgagaccagcctggccaacatatagtgaaaccctgtctctacttaaaaaatacaaaaattagttgggtgtagtggtgcatgcctgtagtcgcagctatttgggaagctgaggcaggagaatcgcttgaccctgggaggcggatgttgcagtgagacaagatcccgccactgtgctccagcctgggcgacagggcaagacttcatataaataaataaataaataaataaataaataaataaataaataaaacggcccccaaatgtagtgctgacatgctgtctagtgttcctaactgcaagaaagctgttagttcaataagtttaatgagggatgagttatagtactgttgactgtgagttcaatgttaataaatcaataatatatataaataagggttttttttaacagaaacatgcataaaacaaggttatgtattgattagttgacaaaagcgtggtgagcaggggcttgtaggaacctaaccctttatttcccctagaagcaatggttcagtatttgttaacttagtgttcacagcaactttatagaacataattactgaataataagaaccaactataattgcaaagagctgttgtaggttatgcgatgtagctatagtcacagcacagcaagagcacagagaattaagtaaacacatctaagggatcaggaagggcctcacaggggaagtgaagtttgagatgtgcattgaagggtaaataagagttcccaaaaaggagagggtctagaaggacatttcaggtggagaaatcagcaggcataaaaatgcatcttattccaacttcttctcctgcattattttcatgttacgtctaggacccttgaggcccaaaccaagtgctggccacaatcacgagagacaactgaaggagtcaagcacagttgaccttgaacaacatggaggttagcgatctcaaccccttgcactgtcgaaaatccacgtataattttttaatgctccaaaaacttaactgctaatagcctactgttgactgtatgccttactgataatgcaaactgttgattaacacaattttgcatcttatatttattatatactgtattcttataacaaacaaaatagctacagaaaagaaaatgttatttagaatatcaaatggaagagaaaatatatttagtattcattaaatggaggtggatcatcataaaggtcttcatcctcatcgtcttcacattgaaaaggttgaggagaaggaggaaaaggagagttggtcttgctatctcaaggctaatagaagcagaagaggtggaagcggaggcaggagaggcaggtacactcaatgtaactttacagaaatacatcgtaatttctgtctgaatttttgccttctcatttctctaaaaatgtttctgtataatacaaatccttctttcactatttgccttagtttcagtgcccacatcatagaagggtcatgtcataaaagaagtcgaaagtcatcttgagtaaccaaaaccctttgccagattgtctaacatcaatttgtgttctgatattgcctcttctacatcttcctcattgtctggcactggttcagtagcactcatctccatcaagttgtcatcttctgttaatccctctggagtggcatctattagctcttgatttctccaagatccatatgttgagacgcttcacacacacccctcacccacctttttgccatatgctcaatctctttcatgattttcttgattgactctgctgtaaatcctgtgaagttatgcacaacatctgaacacagttttctccagcagaaacttgttgttttgagattgatgactttaatagcttttcctgtaacaatgtggcatcttcaacagtgtaatccttccagactttcttgatgttctatcagggttctctttcatagcattgacaatcttttccaaagagtaccatatataatgggcattaaaggtccttatgacccccttatctagaggctggattagagatgtgtttgggggcaagtagaccactttgatgccttcagtgttgaactcatggggttctagataaccgaggggcatccttcaatatcaaaagaaccttgaaaggcagacctttagtggcaaggtacttcccgacttcagggacaaaacatcaatggaactgatccagaaagagttctcgttgtccaggccttcttgttgtacaaccaaaagactggcagctggtgtttaacattttccttcaaggcttgggggttttcagctttataggtaagggcagtcctgatgataagcttaactgcattgcacaaaacagcagagttagcctatcctttcctgtcttaaatcctggtgctcgcttcttttccttactaagcaatgttctttgtggcttttttttccccccagaatagggtactttcatccaaattaaaaacctgttcaggcaattagttatcctttctcctccatgattttgttaatggcatctgataacttgtctgctatctcttggtcagcagaagctgcttctcctgttatcgtgacattttttaagccaaacctctttctaaaattatcaaaccatctttgctggcattaaattcttcagctttagatccttcacctttcttttgctttaaattgtcatataatgacttcactttttcctgacttatattagagtctatgggtacgtctttcttatagcaatctttatagcaacgcacccacctaaaacctgcattttcaatatgagctaaaatggtatttaacaaaaagtgcaaggttttcatacctgctgggagccgcagctacggcttcatgaattttctttccttctttctctctttctctttctttctttctttttacagtggtccttatgctaaattcattcatcttaaaatgatggacaactgcagctgcagacctcaatctatggtacatatcaagaaaattcagcttttttcttgtaatgttatgacttttctctgctttttgggaacactttcagcatcactagtgtcacttcatgtgggttccatggtgttattcaaggtttgctgtattacactaaacatgatgaaaaatgtttcatcatgagagatgaattgctcactcagagatgattagcatcacacagcacttgaagtggatactggcaacacttgagttcaccacaatagcaacaagagatggccacaggccaggcgtggtggcacacacctgtaatcctggcactttgggaggccgagacgggaggatcacctgagatcaggagttcgagaccagcctggctaacatggtgaaactacatctttactaaaaatacaaaaattagccaggtgtaggggcacatgcccataatcccagctactcgggaggctgaggcaggagaatcacttgaacctgggaggcggaggttgcagtgagccaagatcatgccactgcactccagcctgggcgacagagtgagactctgtctcaaaaagaaaatcataataataatcccatttttgagcatttattatgtaccagactctgcttagtgtgttacattatcatttcatataaccttcacaagaatctaagggatatacttttttgttttgttttgttttgctttgttttgatacagtgttttgctctgttgcccaggctggaatgcagccgcaccatctttgctcactgcaacctccacctcctgggctcaagcaattctcttgcctataaaatgaggcaattttgagcaagtggtcaggttctatctacagaatggccaatgtaaattctgtaactgaccatcaagtttatcttttcctgccacccacataaatacttagaaccaaatgtgttagcaagctcatagcaggtagagctgtgattgatttttgttttgtttacattttggtcttatgtacattcgattctccatctcatctctctactcttttccttctttttaaaaaatttcttgctgatttttaattttttaacataatgtattcctgtaacttacatttaatatgtttttagaataaggtagcatattagtaaacaaatggacttagcttggaagagggaaagtgaggctgtatgagattgtggtaaaaagcatgggtttgacttcactaccttgggcaaattattaaaccttaattgcctcaattataaaaatgggaaaaatgattgtattttccttatagaaaaattacgaaaaattaaatgaggtaatgtacttggtaaatgttagccattattattattatcattatttatgttttcccttcatgcccattccagatacttcattactggtgtctataaagcagggtctcctgatagttttaaaatacatatatatatatatattttttttttttttgagacagagttttgctcttgttgcccaggctggagtgcaacagtgtgatctcggctcactacaacttccacctcccgggttcaagcaattctgcctcaccctcctgagtagctgggattacaggcgctcgccaccatgcccagctaattttttgtatttttagtagaaactgggtttcactatgttggccaggctggtctcgaactcctgacctcaggcaatccacctgcctcggcctcccaaagtgctgggattataacttgaagcttttctaaaacacaaggtaatgttgccacatggacaacatgtgggccacagctttgcaagtaccaaagcaattcttattgatatcctctaccatttcattgctgatgcacagcttggggttggatgtgaaggaaatctgaaggcagtagacagacagctatacatttcagtggcaaagtttaaaaatgtcacctatgggtgttcattccatccatttttactgaactcctgttaagtaccaggctccaaggatgcaatgggaaagcaagacagacatatccctgctcccttagattttatggtctcatggtggaatacagggaagtgtgttgacaattataatgcagactaatacgtggggtgatagagggagcccaggcagctaaggacacatagacaactaatctcaagctaacccagacatgtaggaatcttggaggaagcgacatctagaggaataccaggaagatgaacagaacttcatcaggtaaactgggaaaaagtgtggaatgtggagggagggaatggggggacagaaactgccattgaagaagccttgcatgtacgaatgtcgagcacaacagagaacacagcaagtttgaggaactaaaagctgttccttttagctgaagcacagcaagcttgttcacatggagagatagctgccagctcttaaagaccctctccggccactggagagtttgggcttcatcggggggcagtggggagctagggaagtgccttaagcctgggagggacgtgccctttaactcatgtaattttccacattcagagggaagttggagagcatccaacttacttcacttaacaggtgaggaaacaggggtgaggctccttgcctaagatcattcttctgttagttgcaaaactagaaccaaaaggcaagcctctggatttccaacacagtggcttcaaaagaccatactgctctcctttatacacaaatagaactcagaggtcggagttatttttgcctaagatctaaccaaatatatatgtaatagtcttttctgtttttaggcaacttgttcctgaaggtgaaaagacagggaaggaacaacagggagaaatacgtcttccaaaaaactataccatctgcaataatatgccccttagaatgaaaatctgatttattgggattctcattgttaagtatttgtaatcactgaacttgaaatcccaaggatcacggtggaaaatgaaacattttttaaaaaggaaacctcagttctgtttttaaacccatcctccacaaacacccccacagcttttcacactgaaccagggaagaaatgtatgtgtgtgtatatatatatatatataagtcatttttttccgaaatagcaatttgaattggaattagcgatttaagatcaaaccacaaggaattatggattctgagcacgtgggaaataaggtgagatcagtaaaggaaagcaaaggcttccacaagtcctttgctggagcttgaataacggggctcctccacaaattgcccttattaggaacagctgagtgattaagtataaatttgtgggccttaggaaaccactccttatatctacatacactccacaatgtctcaaatgttttcaaattatttaccctgtaaggtataaagggcaactgttattccctgtgttgcagatacggtgacctctgtggagcagagtggtgaagtgacctgctcaggtgtctcaaggttagaatttggtgcagcctgacttcagcctggtctgaaggcctaccaggctggatttcaatgagaattgtttctttctctttttcttttctctctttctttctcttctttctttccttctcttctttctctctctttctttttctttcttcctttctctctctctctctccccccgtctctctctttcattcttttttttttttttttgagacagagtctcactctgtcacccagtctggagtgcggcggcaggatcatagctcactgtagcctcaatctcccaggctcaagcaatcctccc

SEQ ID NO: 1268 - DNA, 420959 bp, Homo sapiens
atttgagatcatggcataatatcccagtgaaaggatccaaaagacagttggaaacataacactaattgttagaaaattgttcaagggttagaaaatatggctttggaagttgtctgcatagagatgaaagttctaggggtggcaatggttcccaagggagaaaaatgtagtgacatcagagaggaagacacattcaacacttagttgtctttcctcatttcactgtttccatgcaactttccaaggaataatgtaacttgtggtagaattgagtatgtatttattagctactaaaactgcaagtctaactttgatagatatagaactgttcatcaagtgtgatcatatgaagaagaggaggaaggagtgttaaataggaaaactaaaaaccttgctaaatccacaaatttatttaggaaaaaaatgcagtactttgtgctgaaatcatttactacgagatagccaagtaaattttcattttgacatgacttagaatttcaattctctaaatacataagtatgacaggatatagcaataggtagtccaagtatttaataatgttaatgcttatagaacctgatataactatacattttcaacataaaagaggccccaagatatattatctaatgtgccttattatttaaataatcaaagaaagcatcacatctcagttgctcattatgttgttgagcattatcagaaaaaaatgttctaataaacagcattttggggggttttgggggttttctttgagagtatgacaaaagaaactccttatcatgagcagttaccctctgtaagtctaagtatctttttattttgtttcgttttgttttcttttaagaggggcttactatacttgacacctaaagaataatactttgtattttgtaattttttgtatattgtaaaatgcatcttttttaaaatagaaggtttaattttctttaatcttatgttttattgtatgcattttaaacaattgaatataatctccatattatcttcacacttacatcatcattctttggacataggacttctacatctcagtttcatcatcatttttctaacagtacaattttaatgtccctcttcctattttcctctttaattgtttgtattactcctttccaactccttctaatgtggctacgttcttctggtaataaagtgtagagcgtcaactgtaattttccaggtcaaatcttaacagagtcatttaaatgtcagcagccacgtttttcaaatggagatgccaggagtattttatagctctgaaagccaaacaataatattgtctatgggcactcaaatttcacgcttcagggaataaactggagagtttgtaaagagacagaaaagtgtttcttccttcttcggcattagctatttaactaattcaatatatccactctgctttttcattaattttttttgcattagtttctagttctataactattggtaattgccataagcaatacagaacattacataagccaataacctggcactgtattgaaagtcttatgcctgggaagtctcttgagcttgtagttcttaataggtaaatttcattttaggtattacatagaaacacattcttctccagacaattatttcatgatatcctatatggtacccttcagatttttgtgcaaaatgctgaaccccagagatttttcataggaatacaattattagaaatatttttaattaatgcaacttagagtatgtgatgagattacactagatttcttttgcgtcaactgttatcaaatggagttgtcatgactactgcattcagtaattttaaaacaatataaaagattgacacatttttctctgggtaccatagatgggaacctcacctgatagtagtgatgtacacctctggttatcatatcaaggtctaattttggtgttgagaataagtacagaaagaaggaacaagagaaattctctaatgcaagtgagatttcagcccccaatccaattagcattaaccacaacaggaatgtgtttttttatttttgttgctgttctcaggagaggttagttttctattacactcactttcttatgtggtggaaaggaatatgaaaagatgtgtcatagctaacttaaatctcatgaagagttgcttctttaatgaaaccaatatcacccacaaagtgccagatgaattgatcgattgctggggcagtttgggaacttatttgaaagtaggggcagcaagtcaaattagattgttttgtgctaattagactcatttagcaagattaaatttccatgtttgattctccttttccatatctgattatctctgtaagcactgtgattagctaaaccaaatatgaaatataacaaattctaaaatctggttggccttgtttagctatgcctagagtagaagtggtggtggagaggaatggtcatttacaagtcttgctttaaatttttttcatttctgtttttttaaatttcagtcaaaatcacttgctctgttctaaaatatatacctgtgtttgttgaaacaagtcttttattgactagaaatagatgattaaacagaaccaaacatttaaaatgccctttgataatattttacatcaaatcatatatatgtaacatatgaagtcaaatattgaatatgagtgccataatttgtatatgtattcaagtccataaagtggcaatttgttagtagtaattaagcaacctgtagggtggcattattgaaaaaaaaattattttgtctttgtagtggtattttaagtacaatgtgcttataattgagttcatataccttctcatatgagtttatcaattttcacatctatttatctttaatactaattgttcttcaataatcattgtgttaagttcttgatataattttattgaatatacaatgttagaatgcttataaaacactctgactttttatacttgttaccaaaatacattttatttagaaaaaaactttaaaacataactttaattagttctgggaaatcatgattgtcaagctatagatcctaggaatgaccaatatttctatttgatactgcaaataaggttttgaaggtacaagagtaccaactacaaggaagaccaaaaaatgtagcaacattactttttcatcattcttagaattaatgacaccttcgaaagtatgtttcagctgaatgtattatcagctcatgctttattcccagaagggaacaaaagcgctattgggactagttaccacaatttaaactcaattgattttttgagtcttgtgtccacatggaaatttttcagaaaagactgagggtagctaatttaatcctgctttttatggcttttgacaggcaaggtccttgcctggccagtagggatatattctgtcattatatccactttttgtttataatgatgtgaagtctggagctgggaataatgcccttgtatttgcaaagcacctctttcacttgtaactggttacacctcctctactgttgatgattccatttcctcttgttcaaagcataggaagtgctttaaatttgcttttactgtctttctttcttcttttgagacatagtcttgctttgtcgcgcaggctggagtgcagtggtgtgatctcggctcactgcaacctctgcctcctgggttcaagcgattctcctgcctcagcctcccaagtagctgggactacaggcacctgccaccacgcctggctaatttttgtatttttactagagacggggtttcactatgttggccaggctggtcttgaactcctgacctcgtgatcaccccacctcagcctcccaaagtactgggattacaggtgtgagccaccatgctcggccctaaatttgttatttctaagggccccagagctttttgctccactgtgctggtggtacgttcaaaatcttgaagtgtttagcactactgggtggattatgatccacataggtatcttacctgtgtaagcctgaaacccttcatcatagtccaaggcaatatgccttgtgccccaagtgcccaggcatctcagatcaaatttacagacaaaagtcattagactactagtgagccctgtgggtggatcagcaccagtctgcctgctgggaaaacaaaagatacatgacctacctccatcaccctttacaaccaacaatctttatgtagattgtgtttggcaacactcacatttatacctaaaaataaaaatataataattattgtatataataatatacaataattacataagtataatcatataaatacatttatataaatatatattaatacaaatctattagcaatatattatattatgttaatatattattatattatattaatacaatatagcattatttttatatttatatcaatataatttttatataattatataatatatttatattaagataaatttattaataatataaatgaagatttatattgataaaatataatctatataatattttatataatagtttcccacatgaactctagacaatgtaatgagagagcagaaagatgttatccatgaggggtgaagtaggcataatatagcctaaaattttaaggtcatatggccttaggtcaaattccaattcatttaagtatgatcctgagtcaaaaattctctctagttcagttacctcctttattaactgggagaacaacaatattatctactttaaataactattttatggctgaaattagccaatacctataaagaatttagaccagtgactgacatgtagtaaggccttttatttatctttgactatacagcacaattacataagagagatgggacttgaatctgactaggaatccaatccttgttccactacgtcttggaataatgtggctaaatttcagattctacgtggcatgtttttaacatttccagttcactggccccagaaaccccttaccctaagcttcatggattcctaagaacaaacgaggctgcttagacactaatgatatctgcaaattggtctaagtgtggattcaaacataatacctatagtcatgctattacatggcagaaatacgtgtttaaacatctggcatttttcagaaagttcatactcagaataagaactgttaaaaaaatacaaatacagtcagtctggagcttatctcttactttaaatcatcaaaggacagccaaatctcaactaactatgaaagaatcaatgagatagtacttacctcctcaaggaagaacacacagacagctcatttatttttcaaaccttcacaacaatgtgctagtgtaggatttcagtggctaagattctgtgagttgctcaaacttgctcaagctttcctatatttttatttagaagaagaaaagaaggcatattacatttaacaatatgacaaattctgtgtacccttcagtggtcactttcttgtatgacaataagtaccatagtaatatttgcccttataaaaaaataaatttaaaaagtacagtcccattctgtgtatatacgtggtttatgattaagaatgaaagtagtgtcttcatggttctgatagttgaagattaatatctacccttttttgtataaccagtttataccaaataaaacaaaacctgcctctcaactcagagataactcttttagcttgttaatatacatccttctagaatatacacacatacccactcacaacacatttacatatatgtttatgtttctccctttaatgggattcacgttattttttaatttttttttttactttaatagctttagaagtataagtggtttttggttacacggatgaattgtatagtggtgaagtctaagattttagtacacccatcaccggagtactgcactttgtacccaatgagtagttttctattccttacttccttcttacccttcccccttctgagtctccaatgtccattattccattctgtatgcctttgtgtacccatagcttagctcccacttataagtgagaacatacagtattttgctttccattactgagttacttcacttagaaaaatggcctccagctccacccaaattactgcaaaagacaatatttcattcttttttatggctgagtagtattccatgttatatttatagcacatttgctttatccactgattggtttatgggcacttaggttggctccatatctttgcaattgtgaattgtgctgtgataaacatgttgttgcaggtgtatctttttttttattggttttgctcagatacttcattcagccaaaaaataccaagaatctattatgtttggtattgtgtacaaatacatatatatttttatacaccagcatatgatacatgaggaaacacattcttcctctacattgtatctaatgatacgcataaggctatttcaggttaaatttatactacagttatttattttaccaagcattatgaagaaagcattttgacatcccaaacagatatttctctcctttactgtaatataatttagtcataactcaaggtaattctgagaaattgaaatacaagcaaaaggaacagttccgtaaatatcaataaacaaaagacttaaagggagcaatgtgaaaacatgtctgacttttcagctagatcatttaaattttttctttggcaaacaactgaacaaaaccccaaattacccaaatttactaaggaagtggagccacatgatgataatcaacacaagagtctctgcagccatccggaattcaagctgtgcatacggagaactctgctattccaaacaacttgtataccaggggtgattctctataatccatttgagctatgagtcatttaggaagcaaaattagacttattttccccccaaagattgtttttacttgtcattgcatgctcatatacagggctcagagctgatggataacttactcctagtaccctgcttcccagaaatggagatagcagcattgtgttttacccaatggataatttactctcttgactaatgaccacttagatagtaggcaaaaggattcagatttctaaaatctaatggaaatttaaggtaaaaacttaaacaaatatttgtcaaattattaaattcttagcgaggcgatcactaatgttgatacagagctactaaagaaagatttttggcacccctaaatttataaaaagtcatgttaagtttaggcacactcaaaattaatttgaggaattctagcctaaaactattttgtaaatttcattcaattaacaaatattgagggactgataaaaactacaaaataaatctttgttagatgaataggtatctctcacatgtgtggctttgggttagacgtaaagaatgcaaaccataaagggacatggaattgtttctggaggaacccagaatttaaaatgttaagaaatgtacacagtaaatacatggtataggaagtggaaggtgatatatgtcttaaaaagattgctgggacattgtgcgacggacaccaaaagggagaagtcatggaagaggcagagtttgaagtgactcttccaggactgtaatgctttggacgtaagacctggagaagggtatcccagatactcgcatgcaatggcacagaggtaggcagatgctgtctggtaggaaatgggacaccagggaatatttgtgagtagggaaatgatatggtcagggttttgcgtgaggaaaagcaattggcagaaagtatttaaactgtgtgggagggtggaaaggatgggcgggagggaatggactgcctgcaggtccctggaaatgcagagctggagcttgggaccaggccagagttggggataagagtttgggaatctgggtgtcctcttcctagtgttcataattgagaaaccccaagaagagcaaagggcagggcagtttcttgctggagggtgacaacatcagaagggccaacctccatgctaaatatcccgcccaacatctgacacctcaaaacaacaacaacaaccaaaacaaaacaaaaacccaccacaaaaccaaaaaccctcagtacaaagtaaggccacctccccatagcgaggtgggaagtcaaggtgcagagaattagagaggatagcgcattccagggcatatcagggctaaaactaaggcaaggatgacatggagtatatttaaaacagtgtacttggttccaacaatgatagactggattaagaaaatgtggcacatatacaccatggaatactatgcagccataaaaaatgatgagttcatgtcctttgtagggatatggatgaaactggaaatcatcattctcagcaaactatcgcaaggacagaaaaccaaacaccgcatgttctcactcctaggtgggaattgaacaatgagaacacatggacacaggaaggggaatatcacacaccggggactgttgtggggtggggggaggggggagggatagcattaggagatatacctaatgctaaatgacgagttaatgggtgcagcacaccaacatggcacatgtatacatatgtaacaaacccacatgtaccctaaaacttaaaagtataataataataaaatttaaaaaaacactcaataaacagaagatacaaggaaaaaataaataaataaataaataaataaatataaataaaacagtgtacttggaacttcctcaacagccatccttcttggtctatagaaactcaggagtcccagctttaaatagacttgtcacggcctgcgttcgtttctaaaaggtgttttaagctactttgttttcctgaaagcccctgtaaccgtgccagctgtctctatttcgtgcctgtgaaggagcactggggtcagaaatatgtaaggctcagtgttattattcaagttcattgtctttaccgagccctggaagtgggtacaggtctaagtgttcaccctgcggcctcgccaaggggtaacttggcatagttttccagctggtaagttgataggcaaaggaaagaaagaagggtatgaagagcgcccccgtgagaagcaagggttaaggttgccacggacccggctttaccctcaaacccaggaaagccgggtcacttggggctagggacggcccccgagcgagcggggctgcaggtgccgcgaggaaagtcagatcttatctgcgctcctagttatctccgcagctctttctccaggaaaataatcctggcaccaccactcaggagccatctgtcttcgccccagttccccggggtcgagcagtcagcccagggtcagggtcctgctgtgggcgggcgggaggacagccctgcagttggaagcagaagggccgagggaatcccgcgaagccgccggagcgcgtcgcggcggggcctcccggggctttcccggccccgggtgcgcggcagccgcgggggctgcgtccctctagtccagtgcagccgggtgggagctgcagagcgaagcaggtgggtgtggagccaggcccggggcagcaggagtggctggcgcgcggaagctgagggaggcaccccgccgaggtgtgggcggtgcctgcccgcgccccagccgcgccctgggcaccagagcgctgtccccggccgagcgcacagctccggcgccgcgaggcagagccccggcgtccccggcggtgcgctgccggctcgcgcagcccagccatcccgccccgccgcccaccttgacagccgggagcgctgaggaggaagagggggagggggaggaggaagagaaggcggcggccgctccagcccgcgggtgcgcggagcgcgggaggaggcggagcgggaggctggggtggccgcagccctgtgtgcgcgccgggccggctagctgcggggcgggggagcggcgccccagagcgccccgcctagcctcccgcgcgcagcctctaccctgctccgccacagacacacacccaccaagcacccaccgccctccgccctccgccctccgcccccgcggccgccgccgccgctgcgcctcgggcagccccagcgagcggcaactcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagccggggagaccctcctctctgtggaggggagggggatttccagcgacaggtcattggcgaaggggatcgtcgcggggagaggctccccggagggagcggggaatcccacagccctttgtggtgcccgagcccgtgccgcctgctgagcggggtctgtgggagctaggtaagtggcgggggcattgctgctccccgaagggggtcttcctttaagaatgaatcatcgcggcagcctagccagacttgagttgctaaaggaattggaaactgccatatggcgcccagtggacttacacacaaagctgacttagccctgagagggtttttaatgtcaggctccttcccggtggggaaggcgctcaagtattagcccctgaaaagcttcccagcagcctgactgggaagggatggggatgttatttctaggagccgagctcttgttgccttccgtccatttgttggtaaatgccacactcacatgcacacacttgtgggactggatttagggagtgtgatgtctctgatgtatgaacgatcctcagaacacagagacatgcgtgcattttattcttcaagcggtgcgcggtctccgttctgtagcacgattcctgagagggagaacgggtctctaaggaaagagcttcatggctgtttccaacacactctgctaggggacttgggaatacgtttgccctgaatagcaccaaaagacatcgaccatttgcctcatcatttgctcccgatgcttaatgatcctcttcaaaatagtatgccgccatccattttctcgagttgtgagcatttatgcgtattcattcataaaaactgtcagtgtgcaatatgcacaaacatgccatttatgcaacatttatgactgcacatgtgtttcaacaataagtaataatgcatacaagattacattgaaaaaaatttagtatgcacatacactgggttaattccgcgcaggttcaacattccttctaatcaagttgtgtagtaatgtcaagattttaagtatcgtatcacattttcatttttgcattgattaatttttttattttgttgggaatctgattttttgaaactgagggaaaggaagagtaagcattttattgttattgttaaatgtgtagtatagtgtgggtcggaagtctcttggtttatttaccaataaacagcaatcaatatattacatttcataggacaagcgagagatagatttcggtcaaaaatcttgtcttacctgtcagtgctgaataacttacaggaaagattttgtaaaagagggtaacattctaaagttacatatcaagaaaataaagttttgttttatctatttcactctttaggggcatgtgtgtgtgtgtgtcaataaatataaagttgtccaaagcttaacgtaatacatgaataaaacccatctagactagacatctaggctagagagttctttgttcttaaattaactcaaacagtttagtaatttggcacattacacatgtgtatgcgcatttaattgccgtttgaggtggtgtttttaatttaagggcatggataaagtgcttacttgtgtgattgcatggactctgaaaatactgaaggtccaacgtagaaataactttcttccccactgaaggaaaagtatccttatcacctagaagagttaatatgcttccacaaagtaaataccataatcccctccctcttgccttaaggtttagaacaattgtttatcacaaatagaattctgtataatgtacccttcttccttttctggcactactcagacttttggagaaagaacttggcagttctgtttgttttcttgctcctttaaccttcacctttccctctccatgttagtgttctcaaatctccctcatacacaaacccacacgtatcgactccagaaaaatcactctcctgcctgccactttgagagttctcatctcacatcttttctattgcctctcttttcttttcttctgtttttccaaatagaatcaatccatgcatccgttgaaactattttgcatttcactgttctccaagtccaacaattcaactttccaagcatacatatttactgaatattcagaggagttagtagaaattattactttatccattcccttctgtttggcttttaaaacttcatagtttaggcaatagggcaacttcctgcctttttaacactcactatgataataaaagtgagattgctagaataacgaaatggcaggatatggtttcggtcacgtttctcaacttaagagtgtgtctgtccacgtgttttatatacctgcctgcatgtctacaaatgtgcaagtctgcagagcatcttcgttaaacgttgaaaaatattttttcttgaatgcgtatctggcattcttatatggtagagagatcagtatatgtgtataacatattgtgaaagtagacccaaatctaggaaacctataagatatatttcattctgccctaatgcatttttttcttcataaagaactaattagttcctttaaaacttgctatctcttaaagactaattccaaaggaagattcttaacgttgataggaaatctcatgcatattttaaggaaaatatataaaggtaagatattctgcttatttcaaaatgtaattgtttaagatttgtttatattcttcagattgattttgcataaaatcgagatttctattattttcacagaagcttcagacagatggacaatacaaaggcattatgtgtgatttcttttttagcccagagttttgttattgttgttgttgttgtttgttttttttaaggctagagattatggccttgttactccccaagtgatagaataaactttatagagcagagcagcattagattttttagtcacattctacaagtatctttatagcctagatctgtgggccattctgtttcattgcttatttcctccttgtgcttcttaaatatgtattcccaccaactctttactgcaagtacgggttgtgaggcagaaagccatgtgtgtgagacaagtaatcccttgacttgtgtaagccaaaccctcttatattatcttaaaaagtgcgtattcctataggttgaattttaactatctttgctatctgatttgatgtcccatagccactcattgactcattcattaattcatttattacttactaaatatatatatataaggagaagagtgcttgaatagaatataacaaatgtaaaaaatatagaagctaggccctgctcccaagaatattttagggggaaaaaaacttgaaaaactaattgaaaaatcagttatagttcaaaatgaaagatctcttttatacagaaatgcacttaataattttatacttagcaaattaattaagacacatccatgaagaggatcatgaaaattttcacaaactatgcatttggcagttgttataaaacaataaaaataatagtaataataatttcattaaaatatttaattttaaatgtagagtattatgattataagtaatactatttattttattgacgtatataaaataaagttattattatagcacttacttgaggcacatactgttttaagcattttacaaatattattttcattcttacaaccaccctatggtgtagctgtcagaaatgccctttattatatagatatgaaaactaatgttcagagacttttcttaacttgtctaaagtcatataggaaataaatggtaaagtcaagcttgaacctaggtgctctggcttcacttaaccactatgatattcagaagtgttaaaaacgagcccaggcagaacaagaaaaaatgcttgcagttcctagatttatttggaactgtatcttctcactcaccaaaggatgccctgcttattagtacaggaggatgcttgaaaaaggccaaaagtaagagaaaacccccatattttcaacatgaatttgaaataagaaggtagtttagatttttataaggtaggtgggattttatcagaatgctaacacattagaaactactagctttacatcgaccacagaaaatgaggctggctgatgcagatgatctcattggtcagtttattttcattttcaggttctttaaaaacaagtttgtgaattattttgaacatagtattacaaatttgtttaatttagctacttttagaattatttgttttttaaaaattattagttctgaaatataattttttatgcatgtccccatttttttccctgtgaaacataacatgaatatttcaatagaaattaaaatatggttacttaacagatttacatactagtatagtctctagaatgcatttattttattaagtgcagagttactatgataacattatgaaaacataaattgagattttcatcaagaaaagtttatatatttgaagaaaagttttttctaaatagctacaacttctgtttatgtgaacaatgtcatccagattaaatttgaaagctaaaatgattaaatattgcctgcaggaagccatagaatcaaatatttagacatatcctcatgattgacattttaatttttcacacaattattaggtcttacaggttcaatcacattgtatagccaaccttgaacctacaattggcttattagataaaatttcattttaaaaatttgggtattttagaacttgtaaacatttccttataaaaatagtactttaaatgatgtttaggtcctcagaccaatccaccaaagcccttttaataactaatatacctgaagtacagtactgttagtattaaaaaaacccacagccaacttaaaaattaaaaattaaaaattatgtatggcaatactcctggggaatcatttgatttacataatgtttattggcttcctttgtgtgagactcacttgagatacagaggtgaatgcagtactgcctaggcccacaaggaggagagaaaatggagagggtatttgtacacaagtaactgacatctggcagaatgaaggaagcgatataagagtgatagaggcaaagcactggataattgattcagagttctaccatgaaatccagggactgcaatcccttcagggttctcatttggtagttcatcctaaaggtatctactcagcttctgtgtgccaagtcctaagccagttattagagacataaatatgcataagacactatgcactcacagcctacatttgtagagaaataaatcacaaccaaatattataaatgctattgatagagtgggatggcaattcaacggagtagttgtatgacagaagcatcccaacagtaagaaaatacagttgctttgaatttctaaatatatttagagccacaacactctactcagtcggatccaataccccctttttataagcagtactttgtaatgtcccctttactttcctgaaataatatgtatagataataaatcatatctacacatataacattttaaaaagcaatataaattccctatctgtaatagaaagagtaaataagaagaaagcaacttaagataaaatagtaggcttatcaatatgtgcatgctcagatataactacactaaaagatgtactaaaatagatgcttgctacttaaaatgcataagtttggataagaagataagttcagataagattagaagataaacttggataagatgataatattcaattgaatattggtaacacttttatatatttggcactttgaaataagagcaaaataaatatattcattgagtgtgacagcagcaattgcaaacagatgtgggtgtactggattaatgaatcaattaacaggagcagcatgatagctggtgacataacttcccaaaatcgtgagcaaatcttggtgatagcaccttctatcattcctagaaaattcctgtgtaaaaacatgctatgaacaataggactagggtctagtcacagataacagtaagcaagttttttatttacatatatgtctggtgagatgtgtaaaagttatggaggaagcaggatttcctgcattcttgggccttgcccttcaaacacttgacaactttaggaaactcactcaaaaggatcatattcctctcattcaggagcactgattatggctatattctcccattgaagaaagccaatccaattctactgtgtgggtggctattttgaaaaagctgagcactctatgtttttagtatgaaggtaagtttagcggctgactaaatacaaataaatagcaacaaaatcaaactatgtagtttgctaaacattagggacatcctattagtgggcacaatttgatgatttaattatcactgtgaagagtatcattttctacgtgggatagtcagacaggacttcacagatgaagtgacatctaagttcatttttaaaagatgagtaagcattccccaagtggaaaaggaggtagatggagagcattctaggcagaaggaacagcatttgcaaagcaatgtcataaaaaagggcttggctggtgactgaaggtcagcattggcagttgtggggaagtgatgggagacgaggctgaagaaggttgaggattagatgtgaaaggtgtttatgccatcctacatcatttggattttatcctgaaaggcaggttgttgggggagagagggtcaatggaaaatttttaaaaagtggtgtaatccactttatttttggcaacaatctctgagctaatgtgaataggatcaactttaacaggagaaaagattgatactttggagactagttaggagtctttcaaggaatacaactaagataatgtctaagacttgctttaaacaggaatggcgaagaaggggaggaggatttgaattcctgacggcaaacacttgcaatctaagggtctccaagtcttccacctcccaatacaggtcataatagtaggtattaccctccttttttgcttttcaatggtgattgtattagttgaggtaactttaacttctaaacttccatatttcagtggttaatagagtggacatttaatttttgcttatatgagagtccaatgtatgcattcagtgcagtgatttggggacccaaatcttgctcttgatactagaaacatgaagctctctgcatccagctgacattgtggaagagaatgaacatagagaaggcacacccaagtagtgacacacctggcttccattcacattctgttgatgagatagtcacattgctctgtcagtatgcaaagagggctggagtatgcaacctctgggtgggaggctactttccagtcatatttctgtatcatggaaagggaagcatagattttgctaaacaaaaattctactatattctgctctctggctacagataggaaaacctcaactccagaaaacaacctgaatctcacctagtcactgtatccatctcaaagtccaggttctatggctgatgctgagtgcccgccaccatttagtctggatatggcccctcattgtctagaaacttttgtactaaaaggcaagttatcagcctccaatatacaggcatacctcatttttatggtgctttgttttattgtgcttaacagatgctgcgattttcacaaattgaaggtttgtggcaaccctgcatcacgcaagtctgtcagtgccgtttttccaacagtgtgctcacttcttgtctctgtgtcacattttggtaattctcccaatatttcaaatgttattgttatataggttatgctgatccatgatcagtgatatttggggcaccacgagttgtgcccatataagatggtaaacttaatggatgaatgttgtgtgggtcccaacttctccactgactggctattcccacatctctctccctctgcttgggcctccctgttccctgagacacaacaatattgaaaataggccaattaataaccctacaatgacctttaagtatccaagtgaaaggaagaatcacatgtctgtcactttaaatcaaaagctagaaaggattaagcttagtgaggaaggtatattgaaagccaagataggctgagagttagtcctcttgttccagttagccaagttgtgaatgcaaaggaaaagttattgaaggaaattaaaaatgttactccaatgaatacatgaatgataataaaggaaaaagagtctgattgctgatatggagaaagttttagtggtctggatagatcaaattagtcacaacattcccttcaaccaaagcctaatccagaacaagaccttaactctcttcaattccatgaaggctgagagaagtgagtttttctgtgagttcttggatattggtaaaggccccctgttctggcaatagggcacattccttctttagaccctggtttgctatcttagaagaaattctttgttctttgttctctgttcttctgtttcttcaaacagaagaaaagttcaaagctagcagaggttggttcacaggtttaaaaaaaaataagccatctccgtgatacaaaagtgcaaggtgggccgggcgcagtggctcacgcctgtaatcccaacactttgggaggccgaggcaggtggatcacaaggtcaggagttcaagaccagcccggccaacttgatgaaaccccgtgtctactaaaaaaatacaaaaaaattagccaggcatggtggcaggtgcctgtaatcccagctacttgggaggctgaggcagagaattgcttgaacctgagaggtggaggttgcagtgagccgagattgcaccactgcactccagcctgggtggcagagcaagactctgtgtcaaaaaaaaaaaaaaagtgcaaggtgaagaaacaagtgttaaatatggaagctgcagcaagttacccacaatatttagctaagatcattgatgaaggtggctacaattaacaatagatttttaaaatttctttagagacagggtctcactctgtcacccagtctagagtgtagtggcatgatcacagctcactgcagccttgaactcctgggctcatgggatcctcccccttcagccttccaagtacttgggactacaggcatgcaccacaacacctggataatttttttattgaaaatttctttaattaaaaaaagacatggtctcactgtgttacccacaacagatttttaatggagattaaacaggcttctgttgaaaggtgacgccatttaggcctttccatagctagagagaagaagtcaatgcctggcttcaaagcttcaaaggacaggcttactctcttggtaggggctaatctagctggtgaccttaagttgaattcattgcttactttctattctgagaatcctagggtccttaagaatgatgctaaatttactctgcctatgctttagaaatggaacaatgaagcctgaatgaacaatgcatttgtttacagcatggtttactgatattttaagcccaccattagaacctactgcttatgaaaaaattcttttcaaaatattactgctttttgacaatgtttcccatcacccaagagctctgagggagatgtacatggagattaatgttttcatgcctgctaacacagtatccactctgcagctcatggatcaaggaataattttgactttcaagcctattatttcataaataccttttataaggctatacctgccatatatagtgattcctctgatagatctggacaaagttaattaaaaaccttctggaaaggattcaccattctagatgccattaagaacgtttgtgattgatgggaggaagtcaaaatatcaacattaacaggaatttggcagaagttgattctaacctccatggatgactttgagggatttaaaacttcattgaagaaaataactgcacatatggtggagagaaggagaattagaagtggagtcagaagatatacatgaattgctgtgacctcataatcaaacttgagcagagaaggagttgcttcttatgaacgagcaaagaaagtgatttcttcagatgaaatttactcttgattgaagacactgtgaacattgttgaaatcacaacaaaggatttggaatattacaccaacttagttgataaaacagaaacaagatttgagatgattgactcgaatttgaacaaagtgctagtgtgggtaaaatgctatcaaatagcattgcatgctactgagaaatcttttgtgaaaggaagacacaactgtgcaaacttcattgttgtctcattttaagaaattgccacagccacccaaatcgtcagcagctaccactgagatcagtcagcagccataaacatcaaggcaagaccatccattagcaaatagattacaattccctgaaggctctgaggattgttagcttttttccccaatagagcattttaattaaggtatgaacatttttaatcgaaataatataaaatactacagtattttataaacattacctttacatgcactgggaaaccaaatatttctgtaacttgccttattgaggtatttgcttttttgccgtggtctggaactaaacctgtaatatctctgaggtatgcttgtataatgatggatgaagtttggaatgattgcctttaaaatttccatttggaaaaatgaacaatgggagacataaaccagtcattgacgcataacatggaagaagtcctgttggatattgttaaaggccccctgtcctggcaatagggcacattccttctttggaccctggtttgctatcttggaagaaattctttgttctttgttctgtgtagtccaggccaccttctgggaggttcttcattgtccattactctccatgaccacatgcaaaatgggtgttgggaagtatacccttcctggaacttatagggccttataggcctgcttcttcccaatccaagcctagatacctagaggtggttttaaagtcattgggtttttttttcttttttcttttttgttaggcctggctcttaatttctttgacaatacaatttcctcaaaattttcataagttacttacgtatttgctttctgtcagttacactactagctacagtgaaagttctttcctattcgtaatttttgaagctgtttcattcctttgttcatgtcttatacacccatgtcttaagtggttatgttgggttcatctcaaaaataggcttgggtggttaggtcacttcattaatgagatatttactgcaaggctgagtcactttgtcgaactgggaggttataagggacttgtgttactcaaagcctttttcattgttatttctcacccttatcctccctgaagagtgggctgttgcagcttcctgaggtcttctgtttcaatcgttttttaatactttgctacaggcagtgaggagcaaccaccacacaataacattctggctctttgcaatctttttttctgaagttatagacctgccttctaagttagcacagttgtgccagggcatggcagggtccaggcatttcgtcttctatatccctttccttgcttggggcaatgccacataattagatttttgtaaaggcagcactcccacgccccctaacatcaaggtgtcaatgttaggataatgctagctcatcctgtaacaaacaccagaatgttagcgatttggcataacaaaagtatatttctcattcacataacaatcaaatgaagagtgcgagagcacagaaaaggcacgaccagttcttaaacatcttgactcaggtgtgacaacaacacttctgcttatattccactgatgaaaactagtcagataccactctatctagatgcctagatgagggggctgggagtaggggctgtgaaatgtaatatttggctcaacaggaacttctcagtggcaattatataaggtgaactataaatttaaataaacaactagccatccctgctgtcgtcatatttcttcaaaataaattaggggagaaaagtgtttgaattgcatccactcactggttaatccatgctgtgccacatccttcaccacacgcctgtgttctctttggctcctctcagacctctgggatgtcttcctctgggacacatctcccttccttctctaatcaatcagtattatagtgccctcatatataaaagactctggctgagtgcattgggataaaggatggtaattatagcatagacaagaaactaattctaattaaatgttagatgtcactgctcctaaaaatgcatttaccattcctcatcacaggagttttctcattggtccatgtctcactggggcccaggtaccagccattttctggacacctcaccagccatttgctaggtctctctcttcctctggacacttcctcccatctcttcatccagaattttcccactatcctttctcaagatgacaatggatgattccaaaagacagaggtagttcattatgctgaactatttaactcttgtttgcctctgacttgcccaagggcacttgccagtaatagccaaatagcccattatgtttttttctgaaatgagaaagcaattctttccccaggaggacttactgcttcttatactctaactggctggaaattgtagccagctttttacaggtgcacattcagctaatatttattaaacacttttcaggtgtaaagtactctgctaggtcatgaggttatgcaaacttagtccttaccctttcgaggcttatggtctgcctgaaaacaaacatagaacccctagatcccttgcagtgctaattgcagtgagtttgccccaggtccaaacaattgataattctttgggttgtggagtattttgaaagggatggggagtagcagcatgcaggctgtggtgtgctaaattggggaagttgagacattatgctgtcattatttcccagagataaattctgtgctctgcttctggtcacctagttattttttgcagactccaggtcttaagctatgtggttctttttacactccctgctcctattttctgacagtcaggaaaagccagtcctaaaaggagatcagtcaggtatgggaaagtggcatctggagagaatagagcaaatgacagatggcaatcccagtagacaggaagttagactttcttcctagggaatgtcctggccaaatatggtaggcagtgtctgggagcaggcgatatttggagattcagacaggcagggctgacagagacaggcagggatagaatggtccagccccataggctcagaatgctgctgctggaggggacatagagtttaggaagaagcctcttttaagtagctagcaggggcctacacagttaagacatctccattctcaggaagacagggtgatgttcacttcattaatgaagggatccaggcacaatggacaggaccatttcttacgccatcaccaaagcaccaaccccaccttcatgatgttccactatagcttactaactggactcagcttcttttcttgtcctctcaattaattttgcccttttttgttgttgttgttgtttgtttattttttacaaaaagcaaatctgattgtgtcactcatttacctaaaacccttaaatgatttcccacttttcttaggataaggtcctaaaccttcaacttgggggctaccatattcctccttcatttcccaaagcatcactagtagaaagctgttgtacatgacgggctctggtcagtctggccccttgtcgccagcatcgtctcaggccccactcatcctttgttttctgttacaatttctggctttattttagttcatctgaagtgccctgggctttcttgctagaaggccgtctcgcatagttacttgggatgctctctcttcccactttcacctaatacattcttactcatgtctctgaactcaggtcaaaaatcacttgctcaaagaagtcttcttggctcccagagcaggggcggtgactcatcatgccgtcttctagcaccctgattcgttatggcacttaccccaaatctaactttaaaatttcaggcatttactcatttaatatcagctttctcacactaatatcagcatcctttgcaagaatataaactcagtgaaggcagggactgctgctttcatgcacttctttatccacagcacctctcacaactccatgcacatagcagatgcttattatttgtttgttgaataaatgagtaaaggaatggatggagctggggcccaagtcaagttctaggtcataaaatggaaccgggagcccagttcccaagaactgctgttcagggtagggcaggataggaccagagcaagtctgcctgatgatgaagcgccaaaccatgaccgtgcactatttacactcatgaactctatattcttcttgacaaggaccaagatggtcctaaaacccaagaggaagtagagtttgtaattggagtcccagggtataccactgctgagaatgggagtagaggtagaaggtggtagaaacacaatcaaggcaaaacatgttcttccaacagaattttttctgccattcttattaagaacagaacttatttcttatttaagaacagaactcagcctcataacttcacaggaaagttgtctagaccagtgcttcccaatagaacttgatgtgatgatggaaatgttctatattggtgctctccaatacagtagtcactagccacatgagctattgaatatttgaaacataacttgagagactgagaagttgaattttaaatttatgtgatttatgttgaaatagccacatgtgactagtggctaccatgctagatagtatataggtctagactattattagcatgaactaccttaagaaactaagtttcaaaagcagtgtggtttaaattttagacatattcatttacaaccagtgttggcctccagtttactgtataaacatgtaagcaatctttggtgcccagtaccagtttgactttgatgagtgtctcctaggtacatcctattgaagggatttgaatgaactatctcttgtttctgtccactggcactgttctttattgagggcatttctgtctttaggcaggttgtacaaaatgtgaagtattgtacacatgtagaacactttctctgtaagtatctatgtcatatgactgtctcacatccacttttcccaggcaggattttttttttgtaccctcccctcttctttgtttctctccttcctctcttactgtttccttttttgacgtctaaaatgacaaagatacaacactgtgtcctttaacaagttccttttcttttgcacgttcatttcttttcctttgtgcttatttctataagctgttttatgagttcagatccttaacaacaaaaaaatttaaaaaaaacacacagaccaaaatacagttcaaatcattagcaacaacaacaaaatctcagaaatgatgatagctcttggcttgctgtttcatacattttggatattgatcagatataataatttcaatatcaatatatgaagaatttaacgtaagccattgcacttggtttttcccagttttcacctagataacatggtagttgcttttaatcctttgaaattgcccatttgtctgactcttgagttctttgccctgctttccacaaataaaaaaactttccaatgaggaaataccagaataagaatgtggtgtttagaaggcaaaaatctgaaatatcataataaagtacaaagaaagagtctatctttactcctttttccctagtctgaatagcttagaacaaatgtgtctcagggctttcatgctaaatgttcccagttcataaaatcgtgattattaatcaggttatcattaaatattaacttacttttgagataaatgtcattttaaatttggaatcctacttttttttctaaatctaaggagagcattttcattaggctttatggaaagagtgcacatagaaagcttagaagctattaagaagctacttcttaaacttggcttctggtttcattccagcccagccaaataatttccagcataataaacacaatttgtaaacatctatatgaagctaaagtagaatattatggtaatcatttttgtcatttttttaaatctggggagctattttattgcaggcattttataacatttggaatacagtgcttcatgggtagtagatgctcaataaatatttgttgaatgaattagcaaattaataaaacctcaaagagtttttaaaattacaaatgggggctaagactattgtgtccataaatgcatactatattccacaaagccccatgaattaaaatatccgtgtcatttgctggtactttatattagtttctcttcttttacagcaatacatttaaatcagggagacagtttcaactaggtgctagttaaatacatattcaagtccataatgttatctgggcctacaaaacgcatgctagaacacaaaaccaaaagttcctgtaatattctttgcggtgatcctgtgggtttcttgagagcaaagggctactttacccaattttgcatcatctcccatgctcgatatatagtgacagtcaagtaacattgttttggaaagaggagacagaatgagaggaataatggatctaaatccgtatttcttatttatattttatggtctttttccattctgaccattattggaatagtagaaattatagacttatgttgtagccaggaatcattaataataaggttcaactcaccagtatttataggtttcactgggtatgagatagtcagattactcttgcttcacattttttctcttccattgtttaaattgtatatttatttttggtgctctgcggtagcaaagtctaatacaaagaactaggttcagaagcaggagctttagctactggccctgatgctgaaaaggccctgggaagattgtttaaatctaccagtgtttttcacctagttagagtggaccccttctaactataaattttgtattttcaacatttaaaaaatattcttggcatctattttgaccataaatcttgaatactaagactattagcattacttctgaaagtcacatactaaaacttatgtttagttttaaaaattcagagctgccaaaacagttgccaattctaccatctctatccataagagaattgtaacgtgatagtagatgttatacatgtcattcaggccaaggggtagacaaaatattacaggaattatttatgttcactcttaccttcaatatcatgctactaggattgctcaatattgatcccatatttctgcttatttattataggcatccagaatccttcaattcaaggaaaattcccagtgtcttataaggtcaagaacatggtctttggattaagataatgctgggttggaatcttggaggcagcacctcctagttgtgttgtgagcaagaaacttacctttctgagcctcagtttcttaacctataaataaaagataataatacccatcccaaggagggatgagaaataatgagaattctcaccatgcgaattaactgcaataagcacagtggctacatataataatcacttaatatttggtaggtgatgaaaatgataatcattaacaaaattcacaaagcaaatgagatcataactttggctctctttcagatacaactctaagaatatccctactttctaggaaatgtaaattttacttatgggcattttgatcttaagctgaaataaaatccaaattgtaaaaccgaatccatcacaatagcttattttacaccgacatgttcttttattataatcctgactacatgcagcttgcaaagctgaaaaacagtgctttaaatatcaccatctctgaatccagaaaaactagttctttccttgaagaaaaaaaaaatgaaaaaaacccataacaatattaaagaagaattttttttttggcatttcattttggttttaatttgaatgtttttaaagatttaaaaagattaaagcctctttgtaggcttattggccatttggattttctttttattttattttattttattttattatactttaagttttagggtacatgtatgtgcacaatgtgcaggttagttacatatgtatacatgtgtcatgctggtgtgctgcacccattaactcgtcatttagcattaggttttttaaaggaaaatagaatccataatttcacaacccttaaccacactactcctttcaatgagaataatatccttcgtttgtttttgaatattttctctctttgtccatagtaacattgtctgttatatactgttgcaaccataattattatgattttccacactgtttttctcattatttatttcaagactgcatcatctggtacaagtcacgtgaactcagggcttcagttggtccatctgtgggtccctaatttttacatttttattttagaaaatgttgatggaaatcgataagttcatgttcctcaccaaatgctttgatattttcttatcaaattttgctgaattatatttctagcagtaaatttaacatcctaagattcatagatgctagtaggtcatcttgcccatctgccttacttttttaccattaattatttattattgttgtagcttcctagtgttttacacaacagagacacatggtaggttgagagagggggcaggggagagggaaagaatatttataaagtgccatacacagatggatggttaaaaaatgctgtttaatgatcctcactaatgataaggatggatggaaaacattattcccaaggaatgtggagatggtggtgtctatagttcagggaaactcttcccttttctatctaataatgaatagaaataatatctaataatgaatagaaaaaaatcaagcatacaatcgattttgacaaagtccaatttttaaattaattccataataccattgatttgttagaaacttgtttttcatgcttgaatctagaacacagtgttttgagtatgagtagtcagggaaagaacaaaaagggacctccagttgatgctatgccgagtgtcccaaggtgaattttggaagcggtctgctttgaggctgatggtatggtatcttagtcctttgggactattactacaggatatcttagacgaggtaacttatgaacagcagaaatttatttctcacagttctggaggataggaagttcaagatcaaggtgctggcagatttagtgtctggtgagggcctcttccttaaagatcatgtcttcttgctgtgtcaaggacacaggcagctgtctggggcctgttctatagacactaatcccattcatgagggccctgctctcatgacctaatcactcccaaaaggtcccacctcttaataccatcaacttgggaagcaggatttcaacataggaattctgatgggatgcaagcattcagaccatagtacatggccacctgtgtattgtgattagaatacatcaggaaagactctcacctttcccctcacatgattttcccatcccaattactgcccagcatgtatttccattattgtaggattattcctttgaggcttcacatggaaatacattctattattcggaaagagaagagacaattgttaacaggtataagcttatattttgaagaaaaaaatggactcactaactttgatgcattcttttcttttacttttctttattttttaattggtgaaaatgccatcatattgaagagaccctcaccagacatgaaatatctttcctaggacatgaaatatctttcctaggagtgagtgagtataagctgagaaatggaaaattcacttgtacaacattttaaacttaagaaatttaccaaagtcaactttttcctattcctcatcagtccagtggaagatgtagatgagtagtaatcacacagaaatctcacagaaccataaaattgcagtgacagaaagcacttgaggtccatcttgtcaatatccacagactaggagcttctcttgtgcatacctgacaggtgatcacctgggtcttcatgaacactgccacacagtgggcctggtagttttttgaggtagcactgtccattgttgggcaacaataattactagagagttttatatatgtacaagttgttctctacctagttccaggaaatccagctcttacttttaacacaggccttgttaaagttggtaaataaaggtcatcagaacttctaaataaattggaggctatccataataactggtattatgctaaccaaaatatctaacaaaacaaacaagatactagtgctttgaaatttattacttattcattcattttttgggggtagtccacaacatgtgttaagcattcatattaggtgacacactagctaggtacaaaagatgcagatatggatacagagatgtttgtcaattttaaataactcacgtcaagtagatgtttccaggtttaagccctcatggcaacttgtactttgctgttgttgcttttattagaattgtagttagttgcttgcatgcttgtagaatatctgtctacctccatgagaatgtaagctgcaccatgtcagagactgtgcctcaagcagtgtaggggttcatacatatttgctgcatgataagaaaggattctaattgaatagttataatgagaaaagcactataatagataaaacaaacttctaacccactgaagcaggaaagattaattctttccgggaaggtacttatccttgatcttgaataatgagtaaaagtttattaggtggaaaatgcggaaaagaatatttcatacgtggaagtcatattgaatttggggaatggcaggtaacacgaggtagtgggaatgagaggaaactgaattttaaataaataaggaaggacttaattaaacccgattatttacttttttagttaactaatatttattgcacgtcacttggggcacaatgatgaataagatcagatgtgatccctgccctccaggaacttagaatctagtgaagaagatggatatttatcaaataatcaaagtaatcatcccaacaaatatataattgatgttgtgacaaatgctactacagatgaaaggtacctggttctaaagttcttacaataagaggattattggatcgtcagggaggtcaggggacaataatatgtgatccttgagttgatatctgaaggtgaagaggggaaagaaaagaagtacaaattccctgttccctgtggcagagggagaatagcacattaaagaaatgaaagaaggatctacaacagagagagagagagggctggggggagcagcaagggacatgtagaagcacagaagtaagtgaaatatagaccttgaagtctttgtatagtgttgtgtctttttctttctttattttattttgttttattttattttattttattatttatttttttggagatggagtcccattctgttccccaggatggagtgcagtgatgtgatctgggctcattgcaacctctgctacctggttcaagtgattctcctgcctcagcctcctgagtagctgggattacaggtgcgcgctactacacccggctaatttttgtatttttagtagagacagggtttcaccgtgtttcccaggctgatcttgaactcttgagctcaggcaatccacctgcctcagcctcccaaagtgctgggattacaggtgtgagccaccgcacccggccagtgttgtgtcttaatcctgagagccaggaagccgtgagagcatcttctacaagagatggccctgacctgctggggtttgggctgtagtgtgcagaactgactggagagatccagggcagaaggaggttgttatcatcaaaaccagtgctagggaagcagagataaggaaagagcagttctaggaagtgcacctctctttgcaagaacacaattaatttgcctgactgcggccattaccctttactgaaacaaacaatatgtaggagataactcatctcaacttcgtgtagtttggattagtattttgacatggggatagattaagaaaagttttttaaaactctgactagcaggtgaaaagcaaataatagtgaggtggaatttaatggaaagagacttgtgtatagacaactagagatctgggttctagttcaagctcagcaactatcaactgaggtcagacaagtcatgcgacctcagttttaaaagatgtaaataaagaaattggaccagatcatatctaaactcccttctgccacattctgtgattttagtctcaaaacatggaggtatataaagcatgacataatacttaagtcatagagacttctcagtatttgagcttttaatacaggcacattacatataatgtgtttgattatggagaaataggaacagaatgataatttaaagtgtatttttactatgagacagagcccaactgagaaatagtccttgtacatgaatattactactaaacatttcagaccaatcattacatgatctaaaagttaatttttactggaagagacctaacaaattgttcaaatcctatccaaatttcatgaacatttccatatttggtttcatagaggctaagtctatcttatgccaaacatccaaatggaatgtaaaacttatgtcattcacccaaatagtggattgtgtcattcacgtggaatcaggtagtgactgaagttcgtgatttatttttcagggtattactgggtggcctattgtttcccattcctttcagtagtaccagtagattctctgttggttgccttccttatttttttcatcacctttcatctttatcgccttcattacactgtgagtctgggaagacttgcaaaaggaaagatttagaaggacacaccttggacgccagtgtaaagggcacttttaccgtcataatagaaaacccactagctgaatagctgaatgtagatataaaaatttgagcccttttctgtgtgcattttgaagcacactaaaaatttccagccatcactataccttgtagtctataaaaggtccaagatgctttataattcaatattatatttttcagaataaagaaaggttttttttctggtcagctatgttttataaaaggccatttttctaaagacaaatctggtgttttattctgtaattttagtgaacatatatgtttagggcctagttctttaaataattatcctgatgaagaaaaattatattacggggtctaaacaaaatagtttatttataaatttggagacagctatgatattgaaagatgctcatattacatatcctatttattacttgtcttgtccccttcttattgcaacacaatgcttcctttgaccactgaaaggaaagcttttaggatttcatctgagtgtatctaaaaaaagcatcggttatatcaaggataaaagttctaatttttttttttttttgacacagagtcttgctctgtcactaggctggagtgcagtggcacaatctcggctcattgcaacctctgcctcccaggttctggcaattctcctgcctcagcctcctgagtagctgggactacaggtgtgcgccaccactcccagataatttttgtattttttgtagagatggggtttcaccactttggccaggatggtctcgatctcttgacctcataatctgcccaccttggcctcccaaaaaagttctattttttttttaaactaaggagtatatagttgtgctaaatttgaggaacaaaatgatattagcagcctttgattgcagaaaagaaatgtcaccttccactttctaaggacaaggacagcatttcagttatttctagaactttatgtgttaaaaaataataagcagtatgaaatttattaaatatttctgaccaggttctaaagtaatgcaggttgcaggtttgttgaatttcttagaatagctgaaaatttccaggatcttacttttatatatatatatatatatatatatatatatatatatctatatctatatatatatgtatatatatatatggatatatatatatatggatatatatatacatatatatatatatgaatgatagtttttaacttgctataatgttattggtttttattagtaaattttggaggtgctttcaaaaattgcagccaacaatagaattaaaaaatatacattgatttaatcttcagctaacagttacaatgcctttctcttcagatatctactgcaaatcatcttgtggttctttgaaacatagtttctacagaaacttactacttaatgctatacatgaaaatttaagaaaatgccttagagctatatatggagtgatacagacttaaaggtctcagagatgtttgtttgcagtgcctgctcagcatgttctagcaacacaaaaatgaaatgttaaacatcacttacaactttagaaaggtttgctttttatcttcacaggatcgcacatgtgacttaccctgcctggctccatgaaggaagtgtcaagtgtatgacataatgctagtatttttgagactacagtaaaccccactccccctccaaacctggagcctcaagctgtaattaggatgccatgatgagaaagttgtgttttgtcagttttggccctgagcgggtggcagcataatgccacgctgctgtagaagcagggtgcagccgtgcaaaactcaaatgtttgttgttgtttattgtttacagagctgcttttttttctctagaagactaatgaagggatggtgagtacatttgcactggctgactgattgtagcaagcttaactttcaattgattgaatgaggtgaaataaatcaacaaactgccaagagaaaatattcactaagattttgcccttgacatgaaaacatgtgttctgaggtctcaaacaaaagtgccttctgtttatactgacaatttatgtttataaattattcacagttgcataatatctacacaatttaagcattgaattattgcattttatattatacttatatacagaattgaactacatgattaattttatggggtaaaaaatcattatgatagacataaattcacttatgaaagtatatgtgagaaaatgtaacatcatatacactttaattacggaaattaaaaacataaattttgtgaacactctagggtcgtaaaacacaatacccttacccacagggaactggcagattcattgctagaagtaaaattaatatggcagaaaaggacataaatttaaaatgaaaagttaaaggatagaaaatcaactaaacactaaataaaataaatgaaacattcatgatgttctgaaggtagtttgtttcaagccatgataaatattaaagtaaaggttcttgaaatgaaatatgaaaaccaccttcctcaagaaactagacatggaaaatgtttcattgactgtgaggcagcatgataagtttatttctatctaaagtaaggatgatgattagagggcatagggaggtaaaaggggcagaatcacagtgaaaggaaaaaattaagtgtcataggaaataaaagaattttaggcatggacatgctaccacttaatgggtgaagaaattaaagttcaattagcaattgagggcaatgtggaactgaggtgttctgagcctcagacagagccccttttatgatcccatatgacctccaattctgtttagatgtttttatctcctggaaggtattttcagcctaggaggcctctgtattaagattggctacagaaaacttaatgaagtatgtacaagtctgaaaaaatagtttggttttgtgcttgtttaagtggctgtgaggatagaaagatctagggatcaggacaggaaaggagggaaagcaaaggaagaaaggtagcatgtggcgttaacagacatgggggaaggtaagagaaacccacagaagaagagatagaagggaaaatggcaagcaggcaagcagaaaggctcagtgagtttcaaaggcactgttgatcagggctgatgctctgcagcttgcatttattatgggcttattctgaaggcttgattaacttttggaacactattcacagctcttcaactgctcaggaacttatgcctttgagcctgcactctttatcaggtaacaagcagaacattctgcccagggagaataaaaaatcttttaaccatggtaacaataataagagcagatcatttttaagtcttaagaaaatcaaatcaacagggaattttctcacccttattttctctatccctgctatgaagaaagggcagtgaatttcagtttgtcttttattgcgggacttgtaatcaacactggatctcttataatagaaagttcttgatcagtgaagaagatattttgaaagttaagtcttatgacctctcttctcttgagacacacaccctacaaaaaggaaaattcactatacacaatgcacatgaaattatttaagacaaatagtgaccttaccagtgactatgatatagcatttccttttttaatgactttttcaaaatagcaagtcacaccatgcctttgccacaaacaaatgagatatttgtgtcattctggagttagttctcttcctggaaaacctcttatctgatattataatcagttaaaaaatgatttatcttcttcatgttagtataaaacatggtgttcaaaaagagtacatttattttatttttatttgtattcaaattcaaaatgcatcagctcacagtttatttatgtggacaattcaatgattgattgttgagatgacagtgtacctacaactaagttatttagtggagactccacattcagattcatcactggaattgccccatctctaatattttcggctgtttttgcctcatcctgatagtgttgctcaatttttaacatatatatatagttcatcatcacctgaatataaagttaggacatgaacatcagtggcgccaaagacagatgctatgaggtgcctgttatgtgtgggttgagggctcagtagagaaaagtttggacccacaatcccaggcctgcctttataattcaatgggaaagacagaacatatatgtaaagagaaaacttaaaagctagaatttatttaatagacactaatatagctttaatcttagttttctttcagtgcttggaaaccaaactttagggagaaatatgaatattcttactctattcagatatacctccttgtaatgagcatttcacataaacaatctcatctaatcatcataatactgtacatgaaatagatactattatctttattttgtagattagaaaattcaagcccagagaatttaagttgcttagtcaatcattatagagcttcttatttttgtaaagataagcatttttgtcatgtgtgatgaaaatgtgtgtgtatatatatatatatgcttaaaatattcctgtaactctgtagttgaaaaaactcctgctgcaagtatatttattggccacatttaaagtacttcttatatagtccatctacatttttcattaccttgacttatattcattcaagagaatctttcgcctccagaacaataaataaatttaacttgcaggatggagaagccagaggcatgcagaaattggtgtgtatcctagaagagagttctaattataaggacctcttaaatctaatagtttttccctttagtataagctgttgactgtgtgaaacatgatgttttacattaaaggtggtattttggatgaattgcttgaagctctatgattttctgcaaaaacattataggggaagataactaagaagatgcttgctgctgcagatcagaataacagatcaataagagggactacaagagcagtaatgctttaaagaattagcacacaggagaaaagagccatgaagcagaatacacacacacacacacaacacacacacacacaacacacacacacattctgatgtatattatatacacataacatataaacacagatgcattttaaataattgatcccaataactccatttttgcattttctggccacatatattactttggtcagctctcttgtggaaaataattaaagaatggattaactgtttaatatttattaaactcctacactgtataagcactgtgcttggtgataggaatgtaataatagagaagatgttctttgtcctcaagagttcccagcatactatgggaaaggtatgttgcaatggtatggtggaagtttcatgatcccagagtgggaatattatggagagctttctctagaaggtgaggtttgagctgagtcttgaaaagcaagtactagttagtcagaaggaaacaagaaaaatgtttctagaacacagtatggaaaggccaggagcttaaaagggaatgttgtgtgcagtctgggattgctggaatataatgatgagggaaagatgaaaagtgaaggtggagaggaggctggacctactaggactaactaggctttaaagtgctggtaggacttcaaaaataaaattccaataatgatgacattttgcagagtttaaagcatgtgagtggcaaggtcaaatttgtatcttagcagagcattctaatagctatgtggagaatggtttttaggtggacaaaacccgagtttgggatccaatttaaggctgtattagaagtgtaggcaagggctgggcacggtggctcatgcctgtaatcccagcactttgggaggccaaggccagcggattgcttaagcttgggaatttcagaccagcctgggaaatatagtgagaccctgtctctaaaaaaaaaaaaaaatacaaaaattagccaggcatggtggtgcaagcctgtagtcctagcttcttggaaagctgaggtgagaggatcacttgagcccaggaggcagaagttgcagtgagctgagattgtgcagtgagctgagattgtgcctgggctacagagtgagactctatttcaaaaaaaaaaaaaaagaaagaaaggaaaagaagtctaggcaagtaagtgatgctgagagttcgaaccagcattgtggtaatgggaaccttggtaacagtgttggaggccttaagcaatggttaggagctataattggtaagacttggtgcttatttggatgtggatggatggatcaggatttcacagagttttagtgagggtgaccgggtatggggtggggaaggccgtaaatctgagacggagaatgatcaggaactggttgggcagactggcaccttggtcagtttagcttaagatgtctgtggtttatctagaaggagttgatcagggtgaggtgcagcggctcaccctgtaatcccagtactttggaacgctgaggcaggtggattgcttgcacctgggaggtcaagaccagcctgggcaacatggagaaaccccatctctacaaaaaatataagaattagccaggtgtggtggcacgtcccaggtacctgggaggctgaggtgggaggatcatctgagcccaagagatcaaggctgcagtgagctgtgatggtgccactgcattccagcctgtgtcacagagagagacctgtctcaaaaaaaagagttgatcaagcacatggatcttttagtctgcagcttgagaaagaggtctctcatgacatgtttgggagttgccagcctataggtatatatcactgaatacacaacctcttctgtgtagtacactgtgttgtcttttccccctttcctatatcctaaagcaaagacacatatctccaaaagtatgtagacattaatattgtaccttctggttgtattcagtcgttaatattgtaccttctggttgttacaacagaatgatcccatagaacagaaacactctaggaaaatgcaagtaaccaagtgattgttgctttcttccagctttgtcagtggaaatgcctgccccagagggatattgcttcagttgacctcattttttaaggaccctggctctgcggctttgtccagttcaaaatggcagaaaaggctcccccgggcttaaacaggaagacttcaaggtcgacactttcccttcctccagagcctgtggacattatccggagcaaaacatgctccaggagagttaagatcaatgtggggggcctcaaccacgaagtcctgtggagaacgctggacaggctgcccaggacgcgcctggggaagcttcgagactgcaacacacacgagagcctcctggaagtgtgcgacgactataatctgaacgagaacgagtatttctttgatcggcatccaggagccttcacttccattttaaatttctaccggaccgggaaactccatatgatggaagaaatgtgtgcactttcgtttggccaagaacttgattactgggggattgatgagatctacttggagtcctgctgccaggccagatatcatcaaaaaaaagaacaaatgaacgaagaactgaggcgagaggcagagactatgcgagagcgagaaggagaagagtttgataatacctgctgccctgataaaaggaagaaactgtgggacttgctggagaaacctaactcatcagtggctgcaaaggtatgaaacccatagtattgcttgcctgtgtgtggtcagaaaagatgctacctacgttctagagagtataagtttttttactgttttggtaacacagaacaaagtgtggctacacagacagtgaaaaaatcctttccaaaatcttatttagtccaatatagtcattcatcctggttaatgacataaaatggcattaccctttcataaatattattgtctgtagaaaggggcctgggcaacagaggatgaaagagagtcctggttttcctggcgctgtatcaggttggtgacttggaggttgaggagaaagccctagctcagacccatcaggcactgagtcttgtggaagacgagggcctgagctccatcttgaacaaagggaaggtactgtcactggaaggagaggaggtacctcttagcctggctatgtagaggttcaaggaaagagaggagagcatggccccaggtagctcagagggcaagtgccacacacatgaggaagggactgttttattaagctgtgtaaaaaatgagtcaatgtccagaatgcatccacgtacctccccttttgaggcctcctttaacagtgcatgtttctgactgttaattttttttttttttacaattgaggtattaccatgtatcagagttcataaaatatttgcttaaaatgaaggtaaattcatattttcccattgtgactgcatatatctaaatctcacagtaaattttttgtcactaattccagtatgtaattcaactgcgtgattctgtttgtctaattttatctagagcttccaaggttagctcaaaccaattttcactccatatatttagttctgtattgcagtatgaatgataagtaaaaattcaaaaagccatctttagctgcaggagtatagtattgacattttgtgcgtaatggatgaaaatggagtacggaatggagaagggaagagtgtgtcatcacatgaattcttttgatttactgtttttttctaaaatcttctctcgtgaacagtaatgatttcagaatttataatagaacatatgagatttttgactggaaattaagattctacatgataatctatagcacataaataatcagctaatgcaaatgatcataaaactgctttttgtttgattttctttctggttgacttctaaaggcattttactttccagccaggacatgcacctaagtgaaataaaatgatatctgttgtgtataacaaagaaatgcatatttcgtgggaaatagaagactttaggtttttttgtagttttggataagttgtttactttcattttacttgtaaaaaaaaaatgtgccgcatttgtgggttttgattgagaaaggctactgctctttccaatatcaagtgtttaggtacatactcgagttactacaaaaaatatggagtgaattttgaaaatgaatgagacagattctggatttaagtgagtattgtgggtgttaaatgaattctttcaagcctttaggcaactaaggaataaatcattgttccatcaaaatttccagagaaagttagccaactgtataaaaataaagcaattaagtcaaagaaagtttgaaaggttactgtggtttatttgttcataatgacattattaacctatatctaaagttaagtattgttacagaaaaaatttaagatatatgtatattttcctgaagaatttctcacaaggatagaataaggtcaacaacctgatttcctacacaagggagttcatttaatctataaattttagaagaaatagccatttcttaatctctaagagggtaactatgaccatggctcattacaatagacctttacatatgtatccaacatattatttaaatttgcttcaaattatgtctgtatgtatagacaagaaatctgcctacaaactctacccagcagccaaagacattggttttggaaaattttatgtagttataaatggtatatttgtttccacattgttaatcaagctaagtaaatcttcactataagttgattctttactaaatttccatacaggatttatgtttatttatatgtctacattttcctctctgtttgaatagtgaaatattatggaaagtatttacatttgattatatagtagtttagtgaaattattgttcatttgtctgaggtttagagccttttaaaatggctctgtgtgatgtcttatataaaccactaccttttcctgtactcttcacgagtcctataacttgttttttttttctttctggagtaattcttggtgagagaagtggtaattcaggtatgtgtggatagtattttcacaacttaagaaaaagtagtaatattacagctgcagtagggtgatattctagccctcactatttactttattgtatgggtacatcaggctattttctatgttgtgaagcccttgtgtaggaatgcttggaaccttcgtgtttgtcctcacttgctgaggaggtaagatagctttaaagcagaatatctgtggaccttgcctttccagtttttgcttattcagtatggtaatttagttgaacatatgctgtatgtgtgccacacacattaaagtagatacttagacactccattctttccagaatttaaaaatattcttaaaatattctcttatctttaactgggatttcatattattgaaaatattcttgtgtttttctcttttggtttttatataacttaatagattcctgtaatgaagaaagtataaaagctattaagattatttgccagatccctagtatggaaggaaaaacttgaccctctctgtcaggtgttgcataacaggctaaaatatctattctttgatacgaaataaaatactcaataatcagttaagtaataattgttcagcccatgctatatgcatcccctatgatataaaaaattattacaaggtcaactgacctattatttttgtctttgggtatttctctgacaatagcaagtcaactcctatggaacatgttccctggtgtcacataaggagccacttctcttacttggatgttctggtgtattaataactgaaaaaaagccaaaacagcatttaacaatgtggtatatctgaaatattacatttaacaaattaacatttttgcacatatatagaaaaccatgaaatataatcgtactattcaaaatataatgacagggctaatagaaatacttatttcttagttctctgggatatggtgtgatttggcaatgggacacaggtttttatctgtatgatggactctgtcatttttgactcttgtcagtgtatcttggtgactgtacatgtcctcatatagaaataatttacacagtttaaatttgagatggtttgtgaatgtgtggctcagctgaatgggcccagggcatgactggaacaactccctgggttaccatgacaggaattgctggttttagtgtgcctttcataggatcgtgcaaggggaagaaaagggctcaacttgctgccagtttcctgggcaaaaattggaatttgacttgatcctgtacctcttccaggccagggcaatttagtcagtctctggactggaaacatttttctctcttttccttggcctcttcccaaagaaactgcagttgctagttccctgtaaatattgcatatagtgacttcagtctaagaggtgtttaaaagcatatttgagaaatgggtcttgtggcaggcaatattctcagccttcgggatgaaacaacaatcaggaagtagcacagcccacctgagatctgaaagaaactagactcatcagtaccacacagggcccacactttggatgtcttaagaaggtcaagaacaaaggaaatcagctgggtttctggcaaatccagctacctgggttcatggctgagtcctctgagggaagcttcactctaagagcataagtggatgtgtgtgccgggcagtgccagacaacaggctgatctcaggtgtcaggtcaggaagctagaacataagcagcccttattggataagaacagcaggaggcaaaatctgcggaaacacatttctattcatctgaaccaaacagtgagagcacccagcagctttttcaggaaagcatacaggtcaagtggggcatggtttaggatctgcttcccactcctcaatttcctcattaatctgtagccaccacttcctccctccctttcccccactcctctccccgctcctcctctctctctcaggctctctctgcgtctctctctctctctcacacagacacacacagacacacacacacacaggcatatcttgtgcccctcgggaactggttttattttagcttaagaaaaggggggaatgattgactagagaaagatttcaacactttttttcatcaatagctccctaaggagaaaaattaagttaaattgaaaaatggagttcagagggccacaaatgatggtactacgtaagtttttttattccttctcactagcaccagttttctccccttgaaaatgcatgggacggagggaaggagatgaccgcgtttcctgcctgcatcttactccctgcatatatccacaggtccattgtcgttggcatggtgcagcgcggcacctgaagggccaggagaccttagccatccttggatcaagtcgggagctgctggtggcagatgggcagtctgtgcttggaaattcagctctccacagagccaggggtccaaattatgagtttcttagatgctggtacctgtttggttgccctgttgataactccttgagaactagtcccctattccaactaaattagagtgtaggcctttcaagccacagaaatagtaaaaataaaataaaacaaaaactcctgtgtacttatcaaggaagaaaaaatacataacattctcattctatttatagtatatggatcagttattctaatgctttgaatgaaaaatgaaggaaggcattggaacagaatcataaatgattttctttcagttcgagaacagaactttcacatgttatgcttgtaaggagatccagccaagtgaacagcttgggctgtataacactctttgtttagctttctgatgaccatcttagtggtaagaaaatataacaataggcattaaaaccacaaatgagccaaaaacatgaagtgatgcagtgtgaacaacacagaaacccctctacactgaggcccttctgtgtaccgtgcagtgctgtcctctacattgaggcccctctgtgtgccgtgcagtgctatcctctacattgaggcccctctgtgtaccacgcagtgctatcctctacattgaggcccctctgtgtaccgtgcagtgctcttctctacattgaggcccctctgtgtactgtgcagtgctatcctctacattgaggcccctctgtgtaccatgcagtgctctcctctacattgaggcccctctgtgtaccgtgcagtgctctcctctacattgaggcacctctgtgtactacgcagtactctcattcttatctgcagtgggctaattagcatgccagtcacactgtttctgtattggtggtttaccattttcctttctttccctttcctctctgcatcccatctatacagattaagcagtttgtattcttccaacaacatagcataagagttcagagatgttaacaggagatgatagagtttaaaagaacttggccaatctgcagaggtttagcttgaagatttgctttttcctttcttaaaatgtatcatccatgaagactaacaggtcataaacctgaaagaaataaggcataagaaaataaaacagttaaaatagaaaacaccattgggttttggtttaaatgtctcaaatattctgttttttagctgcagcgatcctatttctagatccatgcttctctgctttcccggaaaggctgccctgaaaactcatcactctgttcagttggccatgtttgatcatgggagagaagggcaagaaaagaagaggaagtcataaaaagctcatacccccacatcccattgtgacctagggtgccataggttatggagatagtcctggctaatgccttttgtcccagtctaattattaatagcatctctttttactcttcaaagtgtcccagtttgcacaatgaactaagtcatcaccttgcaagtgaatatttttgaaaaagtaaattacccaagaatcatgcactttttggttcctctttgcttcttggttgcatctgaagagggccagtcttaatttccaagcagtttttccatctctttagaaaaatcattagttttcattaatattaaaaaacatcagattcttttcaagctttattttttaaacctcaataaatacattaattatcattttcaacgttgaaaaaggagttctttctatattacttagtgttatcacaaaatagagtacatcaacagtatttacatattctggctttgaaaatttatatacactgctttgattattagtgggtttgttttctttgtttcaagtgagaaagtttgtaaaataaatgatctactcttttaggtaagcgtaagtgttatgaaggaaggttgcaatatttaacactgtccactttggaagactctagaagggtttgaataatgtttttgattaggtgttcttatctgagttttatctatcattaaaaggaagaagacaaacaaatactttccaaatgctaagagtttataggaaatttcccatggggcatatacctggacttcaggtagccacctcatattgtttacttttaagcatttatgttctgtagtggaacttcaatctgaaagttcatctgataaatacatgaaattgctttgattcctcaaggagatggtcgctcattgtcttatccatgtttatttatattgttactatttagcttctcccccacccccgccccagcatgttacagagaatctcataaggattggtacattgatatatatggtatatattgatatattaatactcatactattgattagcattgtgattgtgatatggtatagaaacagcagttagttatactgggactaaacatgagaagatgctattttgaatgccactgatattttcctttttcttatccacttttatattttatagacatatttggcatataatatgaaacaaaatattctcttcccagagaacctataggattgtttgttaaggaatgttgaattagtcagttttattgaatattacatatcacatataaaatattgaatattttattgaatgctaaatattgcataaattgagtcatggaaactaaacagctttgggcactttattaatttttaattcctctacatttctagtttgttccacaaaagaggcagtccactagaaatacatacactaattattcaagtaaaatttaaaataatttagagcaaaaaatagaactagaagaaatgtattttaaatcatcacagtaactctagagaatgctttgttttccacaaaatgtttcaaattattttaattaacaaatgacaatcctataatttttttaaagagtttgaaattcataaacaaaatatgttcataatttttaaaacttgcctttctggccctacctgacattgctaactgatcccaagtaagagccattcctaacagagagactctgtctgtttacccatttgaattgatcattcggataaaggaaggtgttttcctttatcataattaacaaaattgatttgaaaagaattgtgatcaaaacatggtataggaaaaaacaaaacagctgctaaagtacaattcatgaaataaccatagattacaatagttatttttgttttgagcattgacttagcattggtggtttgattctatttgagaataaccccagagttccatggcattcggtaatctgtaatgccctgaggcataaatctgcattatgtataatgtaagcttggtgtgtaggagctagtgactttgagagtgagcgagcttagctggtcacccaatgctgtccactttacccaatttgtttctttctcctcattgttatttgcactagctctcgttatatgttactgtatttataagggagattatgtggcatagtagagatttataaagctctcaggacacatccctcattgaaaatattctatctcagtattctaagaggtggtagaagcttttcaagataacagtaagcttgggaattatttttgcccactaacagcctgtttggtcattaaaatcctttctccctctgcagcaggacagagaaagatgaaggtgaccccaagccacaccagcaagctgttccacatagtatgtgggcactagaggcaagttgcacttactgtatctatcagcaacatccagttcttaacctcctttcccagtgtcccctggaccgtagttgatgatcactttagagtttataagcaaaacattgaaggacttgaagagactgagacttctctgcaattgctatgtcaggcttaacacaaacataatgaagctagaataaaacagctatttatggatgaatgaggaacagagacatgtagtaactggcacagaggcaggaaatagaaaaatggaagaggaagacatttgctttcatctctccaaagtttttccaggagatactaggaactaacatcagaactatatcagactttgcacccatatagtatttatttttggctgtgcatatatctaggtttaagttaactccttaactaatgcataaaatgaatgtatttttccacttaaatcatctcctttaatgtctttacaaagttttaagtaaaagaattcctctggatattactaaggacaggtacctgaacccaactgatgtttgttgtcaagtttctgtgtctacggtggctgaagccagtagcagcagccctcactgagtagtacccagacaaagtctgttgtatgtgcccatgtgtatgtgtgtgtgtatgtgtgtgtgtgtgtgagaaagagatagagagagagagatgttacttatatatactaccacctcttcattagagtatgttctattgtaaagaacccacctgcagaaaaagcaatgaacttcagcatgtatttggcaatttagaatagatgcaactttgtcatccaaataagacagtcagcccattcagaatacaaacttttgtgataacctgatagggcatgaaaattcataggaagtgctctcatggtccaagaatagaaggaagaaatatttttattagtctcccaagattttgtttcaggatgctagaggtcattgccaccctagatttcacgctttaacttctctctcattgggtcactcgtgatgcaaccccaagtgttggatgccactttaaatagctacttcaagcctacgccacagcagtgccaaggacagccaagtcaacccggtgcagctccagatgggtttgcttggttgcagcatccgtcactgcaaccaacctcaggatatttgcacaggagaggaagaaccctagccttcaagtcatcgttttagctttaatcaatatactatctagagctcaatttggaatactgaagggcagttgtcctatctgctgtcatctaagttaagttcttaaccaaatggattcttcaaatatagattttttaaaacactcacattttagtttgtatcttagaattgcatttgtatctggcaacattttgtataggaccatctaacttgtacattcatgtcagagcatgtagttttattcaggatttggttgaattaaaaaataaatcaatgacactctgaagaacagcaacagagtcatgctgtgataaattagatgtatttcattaatacaatggaaatttactttgggaaactagcagaggccctacataatatccctgtggtgaacaacctgttctatttcagtgcattttttagtttagaggcagaaaaacgttagtaggtaatcttactttctaaaaggtgataatttgccatactacagatggaatgaactatgtatgcagtgaaaatatgaaatagtaggccagaatctaggataacatgaatttgccatttcatatttgctatgtaaaaaagctaacacactttattatatttcttaaaagaattctgcaggtgtgaaaattattgtgttatataagtaaagtaattgcattatgagtaatattaaaattcaaagcaaaaaaaatcggttttaagccctggtctttatttttcagactctaactcatgagccattataaatattttaaattacatggaatatttaccaagtgctagtcacacacaccttttaaaaatagttttatatacagattagcctgaggaaactttaaggcagtaaactgttttgataggcagattttaacaatataccaagtgtatttatgaacttaaagaaataaatattataattgaaaaaaaactgttttggattctttgtttacccatcttggttgagttgtttggcaaatgccaaagctttgatgagcttttctcccccgttgcactttgatgcatacatttaaaaataagtgagcctgcagatcagatgacaggcctttgctgtttatctgacctggctgtggtggggtgggtggcctcatggtgtactttctgtgcagaagaggttctctaaggcaccatattgccaccaatgggaacttggaaaatatccagatgtcattttcattgcagcacggcccaaataaggaaatgtctttctttcttccttcagccatgattttatttctgcctgaggaggttctgttaatctctacatacctgcttcttagctcctttcccactgcctgctccgctcagagccccactgagcccctcgagagccctcctcacctaggactgtttgggttatactttactgaacaactgttgattttctactgaatttctttggctccaatcagacttcatatttatttttcatctggttgtaaatcttttcatgagttgatgtctacttaaattttcacaaaattgaatattgtaagagtccgaattgaagaagctagctcaccctccaaatggatttcatttggactttaatctataaagaaggtgtgtgtttttctttatcctaaagcatcggaggctaagacaagtagaattttctcttgtcaactctttaaaatcagcatctacataatacttttcctctccctttgagagaagctgattcttcacccaccctctgccctcccttaatccgtgaactcgggctgtgcaagttaagctggttttactttccgctttctcgtaatagcgtcactatccccagagccttctatttgagcagaaatttaactctggggaaagagactgttaattgatacctaatacagtaacagatgctttcacaaggctgtattagcttctgttttcaaagtcctctgtgaggtatggatacaacttcctagtatcatcagagtgttcttgcaacccttactctatcttcttattctgagaccaattcttttctaacaatactgcttccttcccagcctgggggaaaaaaaggaacttgttccctgcagtccagggtcatgaagtgaaaagcactttctcacatcccctcagtaattaatatgactttctcaaaacagcaggaggggagagatttatatttatattgagtgtctgctatgtgccatacactaagcttgttgattttttgatgttgactccacaactttttctgtaaagggccagagagtcactattttctgctccatgggccataaggtttctgttgcaactactcagctctgctgctgtggtgagaaagcaaccacgggcactatggaaaccaatggaagtagctgggttcctataaagcttgacagcaggtgaatttagcccacaggccatagtttgccaaccactactttatatcaatcctatgagaacacatcattaattgtattacagagattagagagttgaaacccagaaatatcaaatgtgtgtcgagtgccccacactaatgccatattgatattcatacccagtctagccacagcctggctttctcacagttgtatttctagttgtatttttcattcctttcctatcattgtccaatagtctcatcacttcttgatattcactgaaggctttggtttatcacttaaaatcatcttataccgtacccacttgctatcccacaggacaacagtgaatcataaattccaccctaaatatttcacattttgaactctgttagcatatggataaaactagtctgtctttgggatcttgaatcctatttacaaccatggagcccccttccatttcccactaaatctacattttgtccctactgcaagttctcttacctttacttatcctattccttttctgctgagttaggaccactggatgcactgctatgatctagaccttgatcatctcatgcttggactattgttgtaagtcatgaactgggcattttcatttcattcctggcctcccccctcaattctaatccattctccatttagccaacagaattaaaatatgtctttcttgtgggcctctcctgaattaaaaactgcaatgattccccactgcctgcgatctagtccaaactccttagcattgcatttatgatccctcacaaccctcctatataaccatatgccttaccacttctcaaacacagtgccccaggtgttgcagactaccaaccattcctgaagacagggctctggtctagacaggttgttcactgaactcaacagagtatttccacatggctatatccatccagaaggaacatcatttttttctagtttgctcaaatgtgcctcatatacgagctgcagccacacctgcacgtacctggcacagtcacacacctatggccaccactacttccttctctgtccttctttctgtctcagctcatatgtcacgctcctgtgaggtctgcctgattctctctctaacctgttttcccctagttctctcttcatccttgtaatctcatgattttgactgtgctgtgttcaactgctcagctaggttgcagcacttgaagaatccgaactgtttcttatcttcaattactgatacctagcatagctcctgacacataaagaacactgactgtgcctccaaatgacacaggagggcaggaataacagcaaaactaaatgtttcacagtattcctatttctctgtgaggactaaatagcatagatagaggttgggtatctgattctagcgattagacctgagtaatgctgggtttgttttcaacagtttaagaaagccggatgtcttcctggttttaaatggttgtacgttttcgatataggctgagaaccacagatgtgggttttacatttttacattgtataaactctccatctaaaatagcagtgtaggctgctctgtatgctacagggtttatgcaaagaaaggaatcaggtgcttctgacaggcaggtttgcagatgctttgctttgctttgctagggttgctcatttggttatcggaactgtgggctctgggaactcttgtcataggtaaagtgtagcctttgtgtggaggagagcttgatctgacccccaggggataggcagcccttctaccactgatggcagatggatagatcatttatttaggttcaaccatccaccctttacaggtcctaggccccaagtggagtttgtgaagcaggttcaagtgcattggttaccaactcgtctgagtctaatgagacacaacacccccacatataagttacatgaagcagacttattacttacagataggcagcaagggacaatagaaacctagaagtcagggcaagctgcatcccccaaggctcaggaaagctgcccagggcagatggaatcttatctgcatgtgccctacttgcactgcagcagagggaccgcagaaggcatcctgttcagggctttaaggaactaaagcattggaaggcatcccatttctacgggagattggaatagagccctggctgttctggccagtccctgtctcagatgttgcacttccagcacattctacagttattctagagagctacaagcaagaaagaggggagtctgtgttggtacaaggccacctggggagctgtccctcagagctatcccagtactcaggagaagttacaaatgtggataagtccagagtttgaatcaagatagacctccaagataatgtctttttgtgaggatttgaagatagtctgaaacaaataagttctttttaaaacttgtacgattttagagacaagatcttgctcttttcctcaggctacagtgcagtgatgccatcatagctcaccgtaacctcaaactcctgggctcaagcaattctcctgcctcagcctcctgagtagctgggactatagatgagcaccaccacacccaactaatttttaaaaaattattttttttgtagagacgaggtcttgggatgttgccagcctggtctcaaactcctggcctcaagcaagcctgccatgtaggcttcccaaaatgctgggattacaggcatgagccaccatgcccggctttgaaaaaatacattcttaatgatgtaatgtgaaaaggggaaatcaagaatctttatttttactacaaaacgtaaaagaataataatggtatcagcttaggggaactgactttcattgtaatccaaaaaaaaaaatttttggaaactcctaagttcaggatttagataaatattaggcattcctttttctttcaaaaatgctttttatcagcatgctacttggtgataaagaatgttcaattcaaatattattctggtatttcagaccttactgatgggattctctaatttagcttttcagaaagagccttaatcagtcccttttaaattctgacttgtttcaatttaataattcataaaattattgtttgaagagttattttgtgcattagaaatctttaagccttatatacatcttctaagaattttaatgagataattgctaagagtaaaattgtatccacttgtttaaaccttccacatgatatctgtttttgagtttttagtagattgcattataaattaattctttcaaaattctgtggcaaaaaaaaaacaaaaaaaaacctgtcacattattttcagttctgctgttaattatttgtgcactgaagtggaaacacacttcaacctgtagggctgtgtagcctcttagcagggcttttgccttttttccctgaaagatcatgggaagcctgggcgagttctgagcagtagtgatctgactcacatggcaccaggctcccctcagctcctgcattgaaaatagaaaattgaaaagatgaacccagagacttttgtaataattctggagagagactgaatcccattaaatggtaaaactatatagaatgagtgcatttatttattcaatgaaaaatcatctaaaatatttttacatttcatgtctttcatcttaaaactggggtttatgggtacattgtcctagatacccattttttttaattatgaggaaaaaaatgctatctttcataatttagatttcaacagttacaacaatagaatatcaaaaaaaaaaaaaaaaacaaacaaaacccaaacccaaaaccaaaaatacctctttttaaagttaaaccagtttaagaatgccagtggtggtaggtttgttttcagcaatcctcataattatcgttgtttagtgctgtcaaaacaaaacaaaacaaaacaaaaaaaaacagaaaaaaaccgtttagaggaaaagaacatttagacaaaagtaaaaccaggcacagacagatctagataccttttttaagggcatttaaagaggattttttaaaaaagtcaatcagagacaacatatagacacacatataaactggcaaagccagacaaagataaatatgagggagtccatgaaagcggggagagttaaagtctcggaaatgccctggaccctgtttggctctggaacctgggagtgaggctcagagctgacactcctaatggccttttctcacctctgctcctcagggctggttccatttaaatgaaggatgcagtcctttttgtttttgtttgattatggaacagagaaaaaaactattaaaaaaaaactcttaccttttactacttccgtaactataaatagcagtcatgatttataggaagtgaaaaatatatattttttaaatttagaccaagattcacccaatgataacataaaccactctcacctgcccacccgtgcccttgcaggaacatggactatgtatcaggaaaaccacagcaaatatctttgtaattttgatttagtaaacaggtaaaatattatttctattgaatgaaaaaggcatggtcttatacatttataatgcttaaaatcatggaaaaccctttggtatttgctttgtggttatttgctcttaacaaaaactaccatctggagcccagatttggagttgctaaagataaagaaaaaaaaaatcagaaacccttgctcctttctctctccccatctctcccatctctcttggctccctagtccagattatcacaaagaggttgaagtcgtttggaggaggcctctggagcctcaccttgctgaatatggctctggaactctgccagggatgtacccacctctcgtgccataggctgctcgtctctaaggtagggtggtcatgatttctgtcccatggagtcttgctgaagactgaatgatttaatacttgtgacatggcttagcataatacctggcaaatagggagcactaaataaggggtttttttttgttgttattgttagtttctgtccctggccaagtggcagactatagacaagagatgcaataagttttgtacacaattcccaactaacacagaggaattgccaggaattccctaggaattcttcataatatataagttgatacaattttcttttaagaaactcccatgcatttatttgtttcttcttgactgcattttctgtgaatatatgttcatttcctcagttagagcttaaaccccttgaaggcttgttttattttcttgttttatcttctctctctttctgatgcttaaattagtgtttagaatgtgttgcaaagcattaatcacatgatcaataaatgcttagtttttcaatgttttctttatttctttttctagagacagggtctctctatgttactcaggctggtcttgaactcctggcctcaagtgatcctcctgcttcagcctcccaaagtgttgggattacaggcatgagccgtgatgcccaacggatgttttctttaaagacagaagttatatcaatgatggaaaaaagagaaaaacctaagatttttcatatgagtgattatgacaaaatatgattgttttgtaacagagatctattggtgtttttctgagcagatttggaaaataccttatttcggccaaataatggcaactgacatttgtttgaatttgtcatttgatattttaaaaatctaaattttcaaaagaaaaaggaaactggcagtttgaaagacagtagtttgaaacatttaaaagggtatggtatttctgtctagtcagatcacttccaaaaattaattgctatttcttatgttctctttcactctaagtagactcttattaatccaccagcattcctaaaaaatgacatggtgatgtttttccgtgtggagaagaaaaaatgtccacactgtcagatgccttaggcttaccagaatgaattcctacagcatttccattccctacctcttactgcagaaaagaaaaacttttataaaattagccacttggaaatctgtgaggctggttaccagtgtcaaacccattaccgtgtgtcaactccactttgaacaactgtctttgaggaatgaaaagattccatttgtagccactttttatggttgaggttttagagttccaggtggtagttaaattagaatttctctattgtatacaaaagccctaagatgattggattagttcaccaaaaagacaacaaaatttataaattgaaatcatttttgaaacaaatgtgttcaacgttttgtaattcctgcacttagtcacagagggggagaaaagaaaaatctctcaatagaaaagaactaaggaaattgaaaagcctgatagcctgatagtgcagaaggacatgatgtctgggaaacagacaagcattaattgtctaccataatacttttcatgttatcgtatttcagttgcacaataatcccctgagttgggtgctctcattcttacttttgaggatgaaaaactaaagcttagagagattaagtaacaaaaccaggggcattttcaacttgaaattctgtttagagtaattccatcagccatgctgtccagacattgtaaacaaccctcgaaaaaagaaggcaaactatagtcaacaatccaaccacatcacattttttaaaagctgcctccagtcctaggacctgggtcacttccagggtcatttattcaatttcctagccatcaggaagtaaactctacagaatgaataacatatgatcctctcgaaggttgctaggtattctcaaacttggtgttggcctcttttaattttttattaaaatacggcctattgatagcaaagatgaatcttaaattttctgtttgactttatactacagtgtattactgtcgagaaagaaacagttcttgagatttttttcctggaatttactcagtatgtatagactggatagtgcagaaataacaaatcctgactttgtgaacttgatgaaacaggtcatcaaagcgtggctgcttcaggaccttgtttttgtttcctggcttttcaccctgaataacaatccacttgtcagcctatccacctcccgagactgaaagcttcttgaagacagggagtatagctcttagctgatgatttccagctccttgcacagtgacagcatggtaggttctctgtggatggtggctcagtgaaagaagcagcgaatgactttgttacatctaaatacacttatgtagtcttagtccaaatattgaaaatgtagggccagctgcagtggctcacacctttaatcccagcactttgggaggccaaggcaggagcatcaatcttttgagcccaggagtttgagagcagcctggacaacatggtgaaatgtgggctgtataagaaaaatacaaaaattagctgggtatggtgtcctgtgcctgcagtccagctactcaggagactgaggtgggagaattgcttaagctggggaggttgaggctatactgagagtcatcatgatcacaccactgcactccagcctgggccaaagagttagaccctgtctcaatgggaaaaaaaaggaaagaaaaggaaatgtaaactccataacaggatgaaactttattttaagtcactttttatttgttaaagttgttaaggttattacatctagattacatgaagaaaatagggttaaatatttctttataattgggcatgtgtccatgagctgcagccagagttaactttataaaatgattcattgaaaatctgaaagagaatggatttaaatgtccatttgctttcaagaaaaaatggttaatgttatgctccttgtgcactgtttttgtggaacacatttactgaaaagccattctcctgatttttggactagaacagaactggctctggaaacatggtcacatctcttaaacctgaaagttctgtcttcctcataaatttttacagtggcacattttagagtttttgatttttattttctaagttttcttccagtctgaggattctgagtctctctgggtttcttttctttttttttttttttttgagacagagttttgcacttgttgcccaggctggagtgcaatggcgtgatcttggctcaccgcatcctccccatcccaggttcaaatgattctcctgcctcagcctctcgaatagctgggattacagtcatgcaccaccacgccggctaattttgtatttttagtagagacggggtttttccatgttggtcaggctgacctcaggtgatccgccgacctcaggtgatccgccaaccccaggtgatccgcccacctcggcctcccaaagtgctgagattacaggcttaagccaccacgcctgccagctttcttgtacttttctcatcccattttacaggtgagggaacagaggcacagacaaattaagaaacatggcctgtcaggcatgatggcctatgtctgtattcccagtgctttgagaggcgaaggcaggaagattgcatgaggccaggagtttgataccagcctggacaacataatgagaccctgtctctacaataaaaaataaataaaaaaaaaattaaaaattagccaggctgtagtcctagctactctggaggctgaggtgggagaattgcttgagcccaggagttcaaggctgctgtgaactatgatggcaccactacactccagcctgggtgacagagccagacaccatctcaaaaacaagaacaacaacaaagcaacaaaaaaagaaacatgccctgagtcacatagctggtcagtggcttagctagggattgaactcatagtctgataccagattttctgggctgaatcactgtgcacactgctccactcaggcagcagtacaaaaacttggaggaaaacataccaacaaggagaggacaggcaaccctagaaaggacagggagctcagctgaataggcagtccagagcccacaccaacagtttatttcttatagaccaaaacagtataaggtgaccctgaatgtgtgagtgtaggttccttcttctgcagatcatatagaatgaatgatggcaaataaatgcattaatttaattcacttagaagatttatttgtaattttggactatgtgtcgtctattgtctgttttgcgtcaaagtttgtagtatagagaaaagtctaaaaaaagaaaaaaagaaaaaaaaagagaaaagtgtatatttatcttttcagcatatgctctcctgttagttcagtatgtgagttagaacagtgcctctcaataggagtggcacctctctataaggaagcagtgtgtgtgtagggggattgtctcatgactgtggcactatcagtgcttggtagtggagactgggatactctacttcctgccatgcttacagccatcctacggaaggaggagctgatagacttcaaaagcatgtctaattatctaaacctagaacctaattctgttgacatatttttaaactgagttttagtaaacactgaatttttcaggaatacaacaaaagtgtaaatctaagactgattgtactttcttttgctctgaattttatagggatgttcagtctttctgagaaattgcgtatcagttgcaacactgctcatgttgtctgaatcactaataacatacatctgcagatgctgctttcatggtgattatacaactaagggcaggcatgtgaccactttattctggtggtctagcctgagcatttacattctggaaatacagattactttactataacttattttccttttatcgcttttatattatagctcattaggctcttataatgatttttacagtgtatgtgtagattatccacaaatttcactgacgtatagtaaaagaggccacacaaaatgatgcttttcaaaggaggtgttacaagtgataaaattcagaattcctgggttcaactccatttggagctgtagacacccagagtcattttactcttcaaaattttaaagcaattttaaccataagtaatttaatgacctaagaattacttcctttttaggtatcatgtggtacagcaaggatatatatgtataccatctacctgctttgtaattgctttgaattttaccaaatccaaaaacaaaataagaatggaggtgtcttcctgagattgttctcctcatttccctgctgcctttttttttctttttagctcctctctgaaagaacattggaatcaaaaaggagctaataccattgagcaaaagggcaaagttacttcttttaaaagaaaagctcatttttcaccatggtaaccagcatatcatatgacatacgtgccacatggcccgtgaaaagtgaatcctttcataaatgtatttctatcagagcataatgagctttcatatgagtatagcaaggactagaataaggtgacaccttaggttgatttgggtcaaatcattcctgtgatgtcttgtaacaatttatttgcagtttgcaagaggtaacactagcatttcattttttaaaatgcttaatgaaagtgaaccataggctatgaacacaagatgaatgcattctattgagtcttagaaatggcacgttcccttttcctgtgtcacaaacaagcaaaaaatctgggattcattcgatttctcaggatgtgtatttgtagctccttacgtactccagttaaaacaaaaacaaaagttaaaaacacagctaagcatagtattaccatagccactgctttcttttaattatagtagctaaaacctttggttctgatttaaatttgacatttaacaaaggactaatgaagtaaaggaagaggaaatcctttgataagtatgcgtcacaccttgggagaggtaaaaatgaaaatatttcactcaacttttaaaaatcctttacccttttcacttggagacaccttttgttcagtcagctcttttttgttaactcctttgaaaatctcttgtaactgtagtacctcctaagtgtactttcccaatgctaagacactttatattcagttgatctagtttcttaggcattcggaggtttaataggtcccttaaggcgctgcgtagcttcaaatccgatgactcaaataagcacagatttctatagtcagacactgatctgcttctttcagggcatccaataggatattaattgttttggagcttaaagatttctttacaaatatgtaaatcagcctaatataccttaatagtctgggactgagctggaaactgatgcatgcataaaagaaggtggacttctttcacaagtcatagaaaattaaacctgctatctactatgggagtgaaattttattctagtaatcctaatggcaaaaccatagaatttcatgatgtgtttaggtatcagtgtagaaaaagtcaagagttatatatttctatttctggatccattccttattctccttaaattttcctgttcactagacttgaattctcaagcttttaaggagaggattcaagaaagataagattcctatacataatagagaaaattcactgaagggtaatcagaccagattaccaatggattgaagatattgtcatatctcattcaactttggatcctgtgtacgtagcatgggtcctagtagacattcaatggatgtttagcaaatttagattattttggctattattttatgcaaagtttttcatttataatgttagccttttgaattataagaatagtatcactgagactaatcttacataagtttacataactaaaaactagataatctcttgaaatgaatatttagctacataaagtatacatgcaaaacttaaatcataagaaatttacattttggcttaggagattcacattattattgaattatgctatgtccatctgctcaagtactggatatatttaggctcttgtgagccaaattgaaagattcaatggattattcatctgcttcatgctttgatacatagaaacatagaaagagagagtcatcttctctgtttcatgataaggaaattgtgaaatctgtacttgggttaagaatgactttgtgattttcctctacactctaaaagagagaaaatggagttaaatatagtagagtaagtgcttgcattaatactaaatttaagaatggcttttctttttcctaacctaatacctcaaacaatacatcagtatatatctgcatgtcataggggttagctgaaaactattaagacttggggttaaaaaacagaaaaatgatttaaggggttagaattatcaactctgtgtgtgtgtgtgtgtgtgtgtgtaaatggttcatttctgcatgtaaagtctacctaaaattatgttgtctttggggctgctcacaagtatattttttatgtgaggcatggccacatgatatacattggctagtgaaatatgaatattgtagtggatgccactgctggaaacacacttcaagagtcaatgtgcaatttacacatttcctttttcttgtcttggtgaatatgaatgtgtacgttgagatggatctgccttcagccaggctttctcagtgactttggtaggtgaacaccctgaaggtccatgctagacatatgtagtgagaatcagagacttttgtgcactaagcttctgaaatttgggggtttttgttatagcagcataacctaacctaatgtaacataccttggcaaaaccaaaaatatccatacaggttatttttgttttgtttccctgaaagaaaatgcaagttggtctggtgtaagcatttataagagaatctaagggaataaaaataaataaaagactttttgaatttgagctactttgaaatttgtagacttttattttaggcttcttttataaagttgtcctaagagcagacaacatataaaaggaaatttgctttgattacattgagtatttggcatgcctgatagtcagtggttgtaatgtaaattagaagataatgagtactatatttagtattcatgattgtttgtctacatcctttaaagtttgtgtaatatttacgttttagaaagatgtactgagccctaaatatttgtgtggagagaagtattttaaagtataaaaaactataaaagacttattcaaagacttttattaaattcttcaagtccttaaggtacactgaattttgttttgggagctgtagacatattatgatgtgttagattatctctttggttatggaaaaggcaaaagaaactggctctgtggtctttagcaactaaagagaaaagtgacaattcagtgagagaaaagactagcttttacggaatgtgtcactactgaggtcggtattgagaaaagtagtgtatctagttttctctcttatctctgctttaattcctgggcaactctagggagagagtttagaactgatgtgagatccagactgggctctgacctgtttctcattttgtgatcctttaggaggctgtgtcagatataggaccacagggagtaagggccacttcaggggctgagtgaatttccaataaccccttcttgacctgagccataacctgctgccatggctgaattgattttgtggtgatcaattgttaaggccattttttatggcatttaaaatgatagaatctgctgggttatggttaatgacttaaatattgaacgaaccagagtctgccaaatgactttgctctgtttattgggcttataggaagaacatttgatttttttttcagatggaaagaaaaagaaaatttctgtgtagaatgtcagttaatacaaacttttcactaagtttctgtgaggattgtttcacttaactcaacagtaattaattgagcagatattatgctagataccgtaagggtagaaagataagtgaaactagcctccatctcaaggaatttagagtctacctgaggaaatgataatttagttatatacctcatcttagtattgcagatgactcagctctattgatatatatgatagccttcaaaggatttgaaactggcaataagaagataaaacaagttccttattattaagaagttgttttcaatttccaaaaagttaaaaatttacctctaccacaagaagcaaagcaatttgcacccccctcatcctcctcaatccctgccactgagcattattcaaatggtccacccccttctctggtccagttatgcttatatcactaagatataagtcaaatatatagtcaggtagaagaattgttaaactgctttagcttgtgatgaatagtcttggagatttggttgggaatgtgtggagtcagggttggggagttgacatttcacatatattttgatgtttagagaaacaaggaagcagagtactttattttggtagctgtagccttggcttttgttttggtaatgaccaaaatttctagatgaacgtgtcagtggaaaagctataaaaatttcagcaagctctatgctcataacacagcagcgcttttccatacctgagaatcattgactcagcagatccaactcagtaaacatgcatagtaaaagagtacagatgcccctcatccctgccctacatgttacttataaaagagtttccttggccaactgacttactctctttttaaaacagtataataaaccattttaaagcatttgaataagtagttttaaatattatagcagattcaaagcaccaaattagattaggaaaaacttccttagtgtatacacattagccaaaggtgatggttaaaaaacaccaagccaacagaggagacagaaaacaagaattcgtacaagaacaaaaggctcagcaacctgggaccatttagggtaagaggattgttcttcatagtttgaaagttcctgagggtcttgctattttacagatcagccttgcagtgtgatcctgtcacacaatggagaacaatcaacatcttgccattagcaacaagtcctaactccctaacagagcccttcctgtgcacctccccacccccaagcttctacctgcccaccatcatttcccactctgttccagcccttgaactcactcatgaggccctcaagtgcatcatgtgtctcttgcctctgggtctttctgattgctaattcctgaaatccttgctaatttctttttttcttttttctttctttttttttttttttaagacagagtctcactttgtcacccaggctgaagtgcagtggcgtgatcttggctcactgcaacctctgcctcccaggtttaagcgattcttctgcctcagcctcctgaggagctgggactacaggcatgtgccaccacgcccagctaatttttgtatttttagtagagacggagtttcaccatattgaccaggctggtctcgaactcctgacctcgtgatccgcccacgtcggcctcccaaagtgctgggattacaggcatgagccatggcacctggctgtccttgctaatttctaaacatacttgaattctcacctcatatgtccctagctctgagaagccttcacagagtaaggtggtcctggtcatgtgttcccataacaccctgtattcccgtatttggcccagcctacattatattgcaattgcttatttaatggtctcaagcaggattggtgagctcgtggaccaaatccagctctcgcttatttctgaaaataaagttttagtggcacataatcatgcttgtttctatggcttttttcacggtacagtggcagagttcactagttgagacagacagtgtatgtcacacaaaaccaagacctatctggacttttccagaaaaagcttcctgactcctggtctcaagaacaagcaatatgtctaccatgttcaccaccgaatctaataaaattaagataattagtcagcatctattatgtcctaagcaatgtcctaggtgttcatgtaaccttcacagcagccctaggaagaaggcattattatacccaatttgtagttgagaaactgaaaggaaggtgagtaaatgatttcttaaatgtcaccaagcttaaatggcttacctggaatttgacctcatatttcctttgcagtaaggtactctgatgtcaagagactaggtaatatgtcatcagcaaagagcagcctctggcagtagaatgcaatattcaaatactggctctgccgagtactacttttctgaccttatccagggagtcattgaattgctctgtgcctaattttccacagctataagttgtttaccctctctggccttttgtctccacatatgataaatgcgatgattttagtctcttactgggatgctgtgaagtttaaatgagatattatgcatataatgtttgaagcacttgacacgtatgaaacaatgaagacatgcccatcattgttacataaggctgcctcaaaatccttactaatagcttcagaattttcaagaaattgcattctatttataacttacattttacctaatttcaaagaggattttcagtgataatttgtctagtgttctatatactctataaaggtaaggaagtgattcaagatatagccatattaaaacaacacaaagtattacatcttattttctgtgatgggctaaaaaatcatcttccatcattgttgccatgaactttggctactttttggggttttccaaatatcacatgcatgatgccaaatgtgatgcctgaatcagcatgtggtttacctcctaaggattttctgctggtttattttctgctgatgttattgcctctgctattggcccaaacattgcagaagcactgggaaacagccaaccagcatgcttgcttgcttgcttgcttgctttttttttttttttttttttttttttttttttttttttttgagatggactctcattctgtcaccaggctggagtgcagtggcacgatctcggctcactgcaacattcgcctcctgggttcaagcaattcctctgcctcagcctcctgagtagctgggactacaggcgcacgccaccacactcagctaattttctgtattttagtagagacattagtagagacggggtttcaccgtgttggccaggttggtcttgatctccctacctcgtgatctgcccacctcggccttccaaagtgctgggattacaggcgtgagccaccacgcctggcccatgttttcccttttataaatgacaggatcaacccactgcataaaggaatatgaaagtctggagtctacagcttttggttttgtgttgttcttgtttctttgttgttttcagatgaagcatctgcatgttatcaggaaccataagaaagtttcatgaacattttttaaaagtaaaaatatggctactcactggaaataccattcaccataccattatagaaattgattttacagtcttgcttcaaatctatcccaacttcttgaaagttaaacttagcagagaggtagagcattttattcatcaaatcactgttagaagaagaattaactttattgggtaggtgagtacagtttagccataatgatgtagttaagtttgtttgtactggtcccatatgggaatattaatttgtcctggatccagggttctagaattcatccctaactttatcagccaggaagtcccaacccaaaaatgctaaaaaagaaattaaacaagtgctaatgaggttgcagagaaaaaggaatgcttgtatactgatggtaggagtgtaaattagttcaaccattgtggaaaacagtgtagtaattcctcaaagacctaagaacagaaataccattcgacccagcaatcccattacttgatatatacccaaaggaatataaatcattctaccataaagacacatgcatacatgtgttcactgcagcattattcatgatagcaaagacatggaatcaacctaaatgtccaccaatggtagactggataaagaaaatgtggtatgtcaaagcctggcagagacacaacaaaaaaagagaattttagaccaatatccttgatgaacattgatgcaaaaatcctcaataaaatactggcaaaccgaatccagcagcacatcaaaaagcttatccaccatgatcaagtggacttcatcactcagatgcaaggctggttcaacatatgaaaatcaataaacgtaatccagcatataaacagaaccaaagacaaaaaccacatgattatctcaatagatgcagaaaaggcctttgaaaaaattcaacaacgcttcatgctaaaaactctcaataaattaggtattgatgggacatatctcaaaataataagagctatctatgacagacctacagccaatatcatactgaatggacaaaaactggaagcattccctttgaaaactggcacaagacaagaatgccctctctcaccactcctattcaacatagtgttggaagttctggccagggcactcaggcaggagaaggaaataaagggcattcaattaggaaaagaggaagtcaaattgtccctgtttgcagatgacatgattgtatatctagaaaatcccagcatctcagcccaaaatctccttaagctgataagcaacttcagcaaagtcttaagatacaaaatcaatgtgcaaaaatcacaagcattcttatacaccaataagagacagagagccaaatcatgagtgaactcccattcacaattgcttcaaagagaatacaatacctaggaatccaacttacaagggatgtgaaagacctcttcaaggagaactgcaaaccacaactcaatgaaataaaagaggatacaaacaaatggaagaacattccatgttcatgggtaggaagaatcaatatcgtgaaaatggccatactgcccaaggtaatttatagattcaatgccgtccccatcaaactaccaatgactttcttcacagaattagaaaaaaactactttaaagttcatacggaaccaaaaaagagcccgcatcgccaagtcaatcctaagccaaaagaacaaagctggaggcatcatgctacctgacttcaaactatactacaaggctacagtaaccaaaacagcatggtactgctaccaaaacagagatatagaccaatggaacagaacagagccctccgaaataatgccgcatatctacaactatctgatctttgacaaacctgacaaaaacaagcaattgggaaaggattccctgtttaataaaaggtgctgggaaaactgactagccatatatagaaagctgaaactggatcccttccttacaccttatacaaaaattaattcaagatggataaaagacttaaatgttagacctaaaaccataaaaaccctagaagaaaacctaggcaataccattcaggacataggcatgggcaaggacttcatgactaaaacagcaaaagcaatggcaacaaaagccattgacaaatgggatctaattaaactaaagagcttctgcacagcaaaagaaactaccatcagagtgaacaggcaacctacaggatgggagaaaatttttgcaacctcctcatcagacaaagggctaatatccagaatctacaaagaactcaaacaaatttacaataaaaaaacaaacaaccccatcaaaaagtgggcaaaggatatgaacagacacttctcaaaagaagacatttatgtagccaaaaaacacatgaaaaaaggctcatcatcactggccatcagagaaatgcaaatcaaaaccacaatgagataccatctcacaccagttagaatggcgatcattaaaaaagaaacaacagatgctggagaggatgtggagaaataggaacacttttacactgttggtggaactgtaaactagttcaaccattgtggaagtcagtgtggtgattcctcaaggatctagaactagaaataccatttgacccagccatcccattatggggtatacacccaaaggattataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaacaaacactgcatgttctcactcataggtgggaattgaacaatgagaacacatggacacaggaaggggaacatcacacactggggcctgttgtggggtgcggggagaggggagggatagcattaggagatatacctaatgctaaatgacgagttaatgggtgcagcacactaacatggcacatgtatacatatgtaacaaacctgtacgttgtgtacatgtaccctaaaacttaaagtataataataataaaatttaaaaaaaaaagaaaatgtggtatgtatacaccatggaataccatacagccataaaaaaggatgagatcatgtcctttgcgggaacatggatggagctggagactattatccttagcaaactaacagatgaacagaaaatcaaatatcacacgttctcacttgtaagtggaagctaaattatgagaacacatggatgcatagaggggaacaacaaatactagggcctaccagtagggtggagggtgggaggagggagaggatcagaaaaaataactaataggtactaggcttaatacctggataatgaaatagtcagtacaataaacccccatgacacgagtttgcttgtataacaaacctgcacatgtgcctctgaacttgaaataaaagtcaaaaaaaaaaaaagaaattaaaatggtaagttctactcacaaccatttctgtattttggtcttaagactgtattgctacctgtaaaaaaaagggtatcagcaaacttgttcattattttttatatgttttagttggcaaattaagagcatttcatttaatattctcttaattaaccccagttttaactctcagtaggaattgacatacttgactttcaccatttgtgtttataacatcggccttatatttgctagcaagggattattaataataagcatttttttcacgaaatgatttcaaagacaaaactttagtaattaagttgttaatgtacattccagtggagagtatgggaaatactgtcattagatgttcatctattagcattttgccttgtcatttagagaaaggggagaatcatgaaccatctgagtttagaaaaggaggcaaaattggaggcacaggcctttcatccagcagtaatattagaagttctggttacaaatgttatttgtttctttttggtggtaatatacacatgaaaaatgaatctttaaccccctttatgtgaagtttaaatcttgcattaactgctggatggtgggactcattacaacttgattgatgactgaacttccactgtgaagtgtttaaggggcaaatattcaggcaagatgagttgtcactatgttactggaaatacacctattatcctgtcaaggtaagtctaaactcttgaaataggtactaatgtggtttcttgacctgagtggcttgaaatgccagttcagtacagaacactctatcacaaaaacaatccattgacaatatcacccaagcagtatttcaacaagcctaagtgatgttggcagccaactaatgaggacatgaagtcatgaactgaagctccacaggcctgcacaaatttacacatgcattttaacttgctttgatcttcagaattgcaactcaagtttggtcagcaatcaagtagttgaaggcttatgcttctctagacacgttctatttctgttcactgtgtgcctgggttgcaatgggggagggcagtgagggggaagaaatcctggaaaagctttgttatcattcctgaaatgaaaagtattctatttagcttagaagtttgattcttgatactaataactgatattaggcagctccagccatttttaaaatctattgagagaacaaacctgagcatttaattctcagaacatcagaatcagtcactgagtggtctgttgtgattgtaccagcctaaatttggggaggtggcctcaagtttgtcttcattcctttttttcagggttgcatgataaaatcagtaagtagaattttgctgcagatgctactgaatcattgctagaattttgctgccctgctaaattttagtcaaaggaggactgtgcattttgtattattttagtttctatcattcttatcaatatttgttcatttagctttatataatttccatgtgagagattaaatgaatcatgctaccttattatataggcagactctagtcattttttgcattaaagataggcactatcttttgcatagtaaaatgactgttgccgaagccaaaatgtagtggcttcagcaatagccattttactatgactcacaattttatgggttgggaattcaggcagggcatagcttggcagtttttcagttgactttccactgaagtcggctggttgaattcagctgacagttggctgatctttgctcatgagcctgacaccttcatgagagtggctggaaggctgggcttatgtgggatcctctctctttccatgtcatctccaagtctttccatatgatctcttcagtagaatagttcttctccatctcagggaattcatggccatctttgatctgtcacaaatgaattagtcaacttagtttcctttgaggttaagcactaaaaaaaaaaaaaggcggcatgcccgctgatgtatacaaacctaatgtacacttcattcatcccttactttctacagccagtgaaattatcatcttgagttgtacctctcaaatttaacctcaggacatctcttgcatagccttctaactggtatccttgtctcctgcatcctctccactactgccaaaatcattatactaaagcacatgtgtgattgtgtcacttctcatcaatggctcctattggtttataaagcgaagtccaatagccttagcctggcacacaaggcctttcattatttggttccagtcttctttttaaccatgacacccaccattcccttcccagctcaccccaaacccctttgctacctgtcatgttccattgcactctggctatactgtttcccaaatgcaacatgcctttgcatgactatatacttagcagctcttttctccttgaatattatcccttctccccatatctacctactaatgtggcctattcacctttcaaatttccattcatatgtcacctgccttgcactcccataacactgtgcttacactgtcagtacaggagcagatcactcttttgctgatactcatttcttgtgtgtcagcgatgcagagcagagtggtcaacaacacagactctgagccagattgtcccagagtgaatcctgtttcacaacttattagctgtactgggttgattagtgtcctcatccttctaaaaactcagaatgtgacagtatttggaaataggcttgctgcagatgtcattagttaagatgagatcacactggagtagggtggcctcttactccaaacttgctcgtatccttataagaaaaaaattcagaggcagacatgcacaatgtaaagagacacagggagcatgccatatgaacttggaggtagaaattggcatgatgcatctacaagccgaggaatgccaagtattgtggtgataccagaatattggagaaagatatggtgttgattttccccccgagctttcagagaaagcttggccctgctgacaccctggttttggacttctagcctccagaactgtgagagaatacatgttgctgtttaagccacctagtttgtggtacattgttatggcagccctaagaaattaataaatgagctgtatgacttggaacaagttattcatcctgtctgtatgtcagttttctcatctgtaaaatggtcataataatcaaccctactccatagagttttatatacgttaaacgagttaagatgcagtaactacttagaacacaacctatacacaatgaatgctccatctataatctattactgatacttatgcgtatgaatccttctctaaggtagagatcatgtcctatttggtttctgtacctttttgagaagcattatgacatagcagaaagaatcagtgctcagaaaaacaaaaaccttgagatcaagtttgggatgtggcatttaagagccaccatgtgattttggacaagttacttaaatttgagcctcagttgccttatcttgaaaataaacaaataatgtcaactttgcagtattcttatggaaattaaaattaacatgtatctgacacatagtaggtactcaaataattagagctgtatactcttcccaaaaatcacctaatgaagtgtcatgaacatactagttgctcaaaaagatgtttttaattggatcataaattaattgttttgtacccatttaaattaacatttttggcagttcattctatatttttctgcaaagtgtttttgtggttttaaattttgtgtcctttcacttagactccaaaggtcatccctatcttggattagaatgctgagtagaagcacatgattttttaaaaatgtatcttgcattatttaatgaactatccatcaatcataccttctcttgtgttttgtgaaggaggagaaaatgattttaacattcttgacaagctttccatgactgcatcttgatgccaagttggttttctcttgttctcataactttatcagcagtcttgcttagaatattttattttgttcctgttgtgctgtcactttggagacagccaatcaacctaagcatggttcaccatggtgtgtgccactcaaatatgcaataagaaagtatttgcagcaccaggctaggagatgaagttaattaatagaagtacgctgtaaaaagtcacttggggaaaatgtcaggaagaaatgcaacgccccattgcactacagctgtgctcattaccaagcctgacacagcacagctgggacatggcattagcaatgggtgccatggaggcctgcttgctccttggcagctggttatgtctgggctacactgggggctccacactagacatcattaggggtttgtagtgttggtagcttttgattttgttctttgggcctatttgtgtcattactaccagtctgagacatgaagatttttaactacggggaaaaccattgcatggctttaaaggattttcataggagaaaaagagaataggatttcatgagaaccatgtgcttaataagcttagaaagcttattaagacagctttctaagtcattagcaaggaaaggaaagtctttcaacagttagatgttacagttatacagagggctgtatttaagtatttttaatgctgtaaaaagtgcttcagcctttgaagttacacacaaaataatttagtcccagaccaatttcattggaaataaatattccaaatgaatcttttttccagtttcaactttgtcaagatatgtggttcaataaatattctaatggtggcaggtgagcataaatatagagaagatggtaattaaatagaatttatctttataggaatataaaaatcatacactttttaggctaactttttgatagaagctgcaaatatgtcacatccttaatatcttcaaaacaagaggaatactaacccagcaattgaaaaaaaagacaaaaggaggaagaaaattgtcaaattaattgaagaaaagtaaattgaaacaacctactttttcagttgtacactggcaaagattgcaaagattttgaaaaacaggactcaaagctggtgagtatacagaatatattatctcattagaataagttaaattggtatcattttctagaaaacaatttagcagtatgtttatattctttgacccagtagctttacttctgggaattagtcctaaggaataataagaaattcacagtattaggtgtaaacacttctcataaaattattataatagggaaaaactagaagcaattatagaggaatgactagatagcagtgacaaatccatggaattctgtacactttgatgaatatttaatgatatatgtacatactcataatccaagtaaaagaaaatacagaattatagatggaatattatactattgtataacgtaatatttttaaaaatgggaaatgcatcaaagttctaattattatctctgcatggcaggataatggtgatttgtgattttattgttattaacatttatcatactaattagtaattgttatttcaccatcagaaacaaacaggccattaatttttcagcctggaggcattagagagaggtcctcagctccacatcccctatggtattggtcccttcggaggcagttcactggtcgtttgggccagcatgtgatttacatgaaggtctgataagccaaggaggagagatcatgaatagtccgccaggatgggtccccacggggaaaaagacccaaacaaatgaatatccaccccttcactgctgtgacctgtgagcaccaggagatgaggtctgcttgctgagggagagtaaaagttaaggcagaaaagtgtatctgaaatgagaaccaggttctagattctaagacgtcgctggggaatgagtgcctctcctatgggctggaggctagagaaaatctgagcttcagcatctgggagagcaggcctgagggatcagtgttgaggactgaagtcaggatctatggccaagagtgcagatttggctagagaaaagagcagggcaaaatgagttatagagtggtggactgtactgtgtgttgatgtagagaggaaaggtgaagaactgggtacctgcctcaaaaatgggccgatgtctcctgggttccgttttgagttacttccaacacagtttttgagcagcatgggcagtggtaatgctaaagagagtgacacatatcaaaggcaaccagaggagcagcagtattggtgtggggagagggatggagttggaggaacagggatggggccagtggagaggcacatgagaagcagaaggaaggaaggtgggcttcctaaagtagaaaggaccatccttctcaagaatgattacaaggcactccaaggaccccttgtttcaaatgcagtaatttcggggagagagatggagggctggaagtttagcaatgtatttactggagactgagctagagaatgtaattgtgttaccattacagtgactcattctttactttgcatttccaggctggcatgtcctggcaaatgcaaatatattgaaatgtatgaagaataatgaggataaaacatgtaagtgtctctgtgcctaacagtaatacaataagcaaggaaatattttgtgatttatattttatgatctgtttagaaagtgttttttaatcctcagatatagctatagaaaattctcctctagtctctaaaattttatcatttccatattgaataattgcttttagaaaaaattttatttgttataaaatagagacccatatatgcacttaatttaggactaaagcaagtttgaataacaatataaaacactagaaataaaatttaatttgtgtaacacattttgaattataaaattataattatgaaataaaagtgacttatttaactgggttagtacataaaaatacagaaattcatccactcatcattattaaacatttattgaccatctgctatatgtcaggcactggtcaaagagccagcatttgagcaggaaccaagcagataatgtcctgcctaatggagcttatattctcatgggggcaagggttagtgatctgaaaatttttcagatattaatgagctcttcagggatttcaaagtagagtgatgtgatagagacttctgggtggctcctccagatcttgaggctgaagaaagccccttggagaaggagtctgctttgtgcacatctgtggcagatatggcagatgggggtgggcattcctggtggaagtggactggctggaatagggaggtgagagtgggcagagaggcaggcagaggctgggaaccaggcagggagaggaggcaggacttgttctgactgctgtgggcaggcaatggaggggttaaaacagaggtattatgctatccaatttctatttttaaaaaattactctagcccctgtttggaaagtggagtctagggtagcaagaggggaaacagagaacatgttgggaggctattgaaacaggtacttgagaggtgctgatgccttggatgagggctgtggaactggagatggggaagtaaaggctgtaagttagaaatgcctgtgggtgtgctcctggaagctagagagaagacacaagggaaggagctagcctcggggtaccaccaatggtgaggtatccagcagggggagagggccatcaaaggaaactgataaaaaatagaaattacaatggagtctctccaagatgagagataagaatgtctcagaaagcaagggatgagacatcagttcagccacatttaggccaccactgggcacatgaattaactcgaaactagtagttaagagtacatagcttcacaacttggcccaacttgtgaagtttgggcttcaccagttatcatattgatgtcaaccatccaaagatcataaaaggatggttacaaggaggagttaagatgttcaaacaagtgattttacttgataacaatttagtgcaattatgtataacaagtaattttctatgatgaagtataatcttaggcacaagtgatgtagtggggagtagaattgtttcatagaggattagaatgagaagaagtatgagaggttatggtctaacacctctttcatttgtaaagataaggaaactgagacccagagcattgaagagaatttgttcaacatcatatagtagctaattaaatattcaaagctaggaccttggtccatgtttcttagatcaagtatgtccttaccactcacacacacatgcactctcatcagtgcatgtagcacataggacaatatagcagtagttgatgattatttgctttcaaaactgacttaagagtaatcctgaaaaacaaactctcttgaagcattttcaagctttatgtgattcataaaatttcagtcaacacttctttttcaagaagttccgttagaagtgagttacatttaaccatagaagaagaaaaaaatgtattctttctgaatcaaaaaattagcgtaatagatatctgcactagagtttataattttcattagagacaagagttttttctacaatgaatattattagaattttctgttgcccttttatttgtgcttgaacataagctagagtagacatagataatatccgatttggaatttacatcagaatctggtatcaggcaaaaacaccaaggaagaaatatttaatattgtatattataatgtcaattaggatcaacttagtataattttatctgtagttcttgaaatatttgtaaaatatttcagactacagagcactatgtttatgtgtgcacttatgtaaaccatttttcattaaagtccccagtcgaataaagcattatcatctagacatcttcagtgctgccacactgcgcagacccaggacgtcgttacgttgaagtccagcattcaggggctgctgttcacgtggaatattttcacagctctccctggagttgtacaaactgtggctctggctgtcttctttcttcttatgtaaaagatcctgaaaacctaaaatagatttttgttgtaccttctaaagtgtaatcacttaataatatttcaaaaaaatttggtgacttttctgaccacagggttgggataaaacaacaggaaaaaaaaatcttcaaatcaatgaatagaaaaggattagagcaggtaattgttggagagaaaagataatgactcttaaagctctccaaatcacatctcttgaagagtagatgttgtactgaaatataatcccctcagcatgaagggtttagcattcgagtgttcttgcttaaatcagtgggatttcttcctccaactgatgtgcttaaaaaccgaactctaaactaagttaaggaaaaagtttaaaacagaatctagactttaagcaatggaattaggataacatgaagattttcctcatattttttcttatttatgctcaccaagtagtattttttaaagcctaggtatgcaatttgtttgcctcttcctgaaatttctaagacaaattatgcctaacaaaaggttagggatatgatctcttatgtatgcaataaaaataacactcataataatagcaaccaaaaaaatagatagcactttctataggcaaggcactgtcctaaatacttaaaaaatttagtaacgtattaatcctcacaactgactctatgatgtaaggtttattattagtctcattttaaaatgtggttacggaattcagacatcattaaattaaaaactgaatcattctaaaggaaaatgaaggcaaataactattataatgagtaaattcagaagacaagtggtttacgtaacatacaggattttggtaattaaaaacatataaaagcaagacaggcagcttatctcactgaaggggtaacagaaagacctcaggtgaaatccaatgagatcagatttgtcagaaaaaatgattttgtctccaatcagtaatgacctttcagcctgccctagggttgagggaacaccttcaaaacattgactttatcactgacctgatgaaaataatgggctcagtccatgaatcaagacatgtatgttgagattgctctaaatttatgaatcttggattgtagggagtagggagcactgaagaaaaggaaaaagaaaatctatgtgctatccattttgaaactgagacccatcttttaatcctcagaatgttattagtattttcttatagatttctgacaattatgcatatggatgatgttaaaatatcatttttaaagttgatcagtattacaagatagatacctgtattaattttgccaatacctttcacaaaaagtcttttgtaataaaaattatctaaacaagtctcttaaatgtagatagggtcaccgtattttcagatgctcccctgggaacagagttgactcactgctttcaagcttgcaactcttgggtatttgtgaccccagcacactaaagttcggtatccgaatctgccaacatctcccttgttattttaatcacctatgatgtttgtatcttgcaatatggacttccaatgatctgtattttctatgatgagaaagactcccttgccatgaggactgcccatgatctttttaggaacaggaaggcagagaggatgtgtgtagcaaccggctttgctgtttactgcatggcacactgagctctttacaatggactatggaagggataccttctatttcatagcaccttttaagtgtattgttctgccaattgcaactttttgccttatattggtgatacatgagaataaaaaagatcaggcattggctcactccagtttggcttaaaatcctaggtagcccacttgctgcccaaccttaagaaacccattttttttttctggatcctcactttcttcgttttcaaatgggaacaataggatttgtgacaaggactaaataactattaatcaattaattaatatttttgcctgaaacatgttaaaaaaatccttaaacgcaaactgttatttaaaatagaaaaagtaatgccagctcgctcactcttgagttcaagtgaaatagtatatagaaacctaaaaactccataaaaacttcagatactctcaagcagtatatcccatgcaatcattataagattttacttgaaacttaccatcaataaattctgtgacttcttaattcacagcagttccagtgatagtaagcattaacatcataagcctgactattgccccattccaacttaattaacacatataaatgatttattgttctaaaatcaaaggattgaacaatgcagtgttctcagtgaagagtgacatttaacctgtccacaagtgaccaaagacttgttatacaggtactcaactttagtaaatgtaaacataagcaacataatctttgaaaacacaaggaagtaaaataaaacttaatggaagacttgctggtgaatttctagagtcagatattgcttccagttctttgtcattcatactgatgacattttgccctgctttcttccttctttaagttttccatctctttaagcaaattacatcatggaagatgctatggtacttagaaacacttgcccctgaaaatctggttctaatttaggtcttcataataaagcttgacacattgaagcagacagtgttaggaactgagacatcagggtcaaagtctagaacaagatgaacagaaacagttgccttgggctttgtggaggtaaaatggacatctgaatgctactggatgaaataattgatttttcctgaggcaagtatgattttggtccttagaacttctaagctttttcaagtttgagcttgctaagaattatttttttaatataaagtacagcatgagaaaatcagcaggaatgttcttttcagtagatatcaaagttagattttctatgttttaacatttttggaaaattaaatatgacaatattgttagaagatatgctctcctgtggaaataacatttctatcaagttagcattattttatttacatatgtgccatgtgcacacacatgcacacaatctcacaaataaatgtcgtggaataaaagaaaactagataacaatggctcaagaactgccccatggttacatatggactgtctgtttctgtcccactgtatcattattgtgttttccacactatggccagagagagtaaatctgaatttagaaagataaactgaaaataaaagtgaaaacaatggatttcaaacaggcaattatctccagataaattcaatcatagcaagaaaaaaaaccctacaaacaagcaaaactaacaaagcaggcgatcacatctggcctctgcaagtccttagggaacctgccactatgtctatgatgactgaatttatattcctcaaaaaataatgttttaagtatctttcacactgttatccaatatacattgagtcactgacagactatgaagatttgtcttacgcacctagacagatatttctaagtagttccatgtttcagcagcatttgacttggaagaaacaaaatataaaaataaaatccctgttatatcaaattaatgtttcactatgtattaagatctgaccatctgtggagtgtgttcagttggtgatacatcatccctcagtctaagctgtactaccagaagtaaagttcaatccacattggtctttcctagccactcaggggtatccgatgaccatattcacgcctccattgtagtcccattgtaaacccctgatgtggttaaacagtgcacttgttagttgctgtcattggcacattgagcattcaattagcagagttcctttcttctgctgtaaattcagaatggtccacatttaaaattcatcaccagaatgaagtaacgtgaaagagtgaatttcttgagctcttgcagttattcagatgggatcttacccgttctcaatacgcagagattatgggtttaaactcccacactgttgctgagataatgacaccaactcaaagcataaatgtggacgatctaaatttagtcaggtagcagtggattctcctgtagaaatgctgcctttctgctaggaaggatgaggaaacgtagctagtcacacattgatgtaaattagttttgctcctgaaaaagagtgtaatgtacaatctgcagtaggcaactcttgtttctgataacatcacaacctcttctcccagtgctgtttattgggtaaaaatagttttattagatattgattggatgccaaacagcaaggaaacaccttttaattttaaatgtatgtattttatagatacagaaagatatctatgatgtctttatattagtttctaccattgaaggatttgttgtcatcctaaagggtcaatgcatgatggtaggtgtggaatcagagaggacttgggttcaaatcctagctctactctaatagccctgtaaaggtagacaaggtttttaaattggaaactcaatttcttgtgctgttaaaggaatcctcctcacctgagcatattgttcttacagtaaaatgagatcgcacagtgaaatgggggattgagcgcagcagcatagatgccagtctctgactgttgttgttagtggacacaattgctcttgttctctgtgctgaagagtaggtgtttataacggctcctgctcttataggacttttctaataagcattgcttcaggatgctttaaatctgtcatcttgtggctaggtgctcaaagtctttgtctcccttccgttggttctgtcctttctgaaaacgtcttatttcacttcttaaataatttcctgtccccactccattctgacagaaaagtttagaggagacatgatttccttggagactcagagatgccataacttacatataaccacacaatggcccatgtgagctaggtggctaaatgctgaaatacttttgagggaccaaaaatatcaaacaagcagaggctatgtattgtccctgggaggcaggaccctatgagcagatgatagaagtggctaaggaagcagcatcagttcacaccatgaggagagccaaacctccccacataacaccagctgcctgagcagcccttggactccacgtttgcagtgggtagggaaaagaaggtctgtccagaaagcaggagcatggagctccgtagacctgaaacagccccaagtctgccttttactaattacatatagtggatacatcatttgttttctctgaatctaggttcccttatctccaaaatgaaactcacagacctgtctgcctctcacagggtagttatgagaatgaaacaagatgttgtgtgtgaaagcacttggcaacctgtggttctgcttaataccgactgctacatggctctgaaatcacacactgaggggcatacgaggcacaagatgaagcaaaaactgcctttaatcctctgtagtttggcttctcagttgtacgagaattccctagggtactggtttaaaatacagatttcaaggttttgccccataaatttctagtttatttggcccatggtggagcctgaaatctgcattttaaacaaacatacaggtgattggttagagctggttggtcccttgggccacattttgaaaactgctgttctgccccttaagaggccagaccactggggatgggtgtgttttgggggattactaagagcgaataatgtggaaaatcatatattgtaggctggaaactttgatacctctactgtactctagaatttggaaagtttataacaagttgaatagggcaaaaaagttttctttgcccaagtgaggcacagtttttaaaggtgagtgaatgaaataaatagatgaaggaagaaagtcagataagatcaacagattcattctcagtagagtctttaagctctcagctgcaagtatcataacttgctttgataagttttgtaagttagtgaacaaaagataatttaagtttaagttgagcagaaaataatttattgcttttgaaatgctggctgccttgtacaggattatctcaatctttatctccagttcatgaaacccaaggctacctattgacaagggaaaaaaaagcttttctgaggtacatgaagagattcaggcattttaaggttctcaatcatgtcaccttttctcgcttaggttttaagtcgaaggattccttttgagtttgcacattttgttgaaattaagtggagggcctttccaaattgtcagcttttatttcttgcccattcaagcttccatttagaattggtataaaattagatctgcagtagaactatagctgtaattttaaaatcactatggattttgattgtgcaagtggcatgcttatggctagtggaagctaacaacaaaacagtgtcacatataataacctcatgagtgttaagagttaatcttaccaggctttttttattccaatgtttatgaaacttttaaatcaccaaagtcagccacatctcagcctgtataaaattctctagctcttaggcttttttcttttttcattcaggtctcagttcatatattaaatgtggttctaagggttcatcaaactaccccatgcaaaggaacccctttcatctctatcactttatttggcttcattttcaaagcactgtctgaattgtcaagcacttcatttcatgtagcactgtctgaaattttcttatctgtgtatgcatttatttactgtcttcctcttcccatggaatgcaaaggttatcagagcaaggacttttgcctatttaggttgttgctctttctaggacctgaaggtatacctggagcacagagagaaaattaataaatatttactgcatatatgaagaggaggagttaatataataggcacagttttctcagagctctgtattctgtcctttgcctattactgaaatctgatggaggaagattggaggggcttaaatggatctcacggctcttacacattgcttaactaaatggcttccacaattcctctctctcttgtaatgctctgtggcttcacacctcgagccaggtgtctgctcaattgtgatttatgcaagccagttccaagtagcagtgaaatagtgactgaataataaagggtcacagacacatctgtgaggccagggtcagggggaaatggtctgtgccttttcatttccctctctttcctccacttttcttagctaggaggtatccttatgtcaccttctgcctgaaacctgtatactaatgttgccccaatcctcccatctttccaacatgatagtttcccacctggtgtctgagcagtattttggaagaaaacactcttatttcccattccaaaacaaagatagccagtgatgtatgttgcagagagaaaagaaaaataggcaaggacaggatttgagatggaggcaagagaacattgttttagaaaggcggggatttggcacccaaatcagatgttctgccttctccatccaactccagagagacctgaagaactctcatctttgagtggcaggatcaacttccatgccctgaaatttccatttggtcctcacttattcaacgtggagcagaaaccagtgcatttttgtcagtataggctagcatcacagaagtgcaaaaaaaaaaaaaaatgacagtagactatagctcattttgattagtggacatttttacgatagacccttaattattcagtcactatttcactgctacttggaactgaccctgtttgtcttactcatccaggttgcatgccttccccttacttataaactctccatctagtggttttcccagatgctaaattcgccacctccccgccggccccggccccaagtaataaacaactaattaaaaatagaggaaattttggcaagtgctgtctacagcctattttagaaaacacacaccataatattatctaagcggcgtctgaagctctttagtgagggttataactatgtggtggaacgacttcagggctcacagcatggagcattggcaatgacatctggagtctttcattatgcagttgctggtgctgcacagcctcccactcaccttggtacctgcacacactgctgtttctcctgcagccccttgtgtggctgcatctgtatggtgggaaagctaaaaatgcctaccgagatggcaatgtagactgacattagctcataatccttgcaagatgcacatgtgtgttaaaaaaaaaaatcccaaagaactagcatcccaaatgattcaggtttctgtaggaactagaagcagagaagtaagctcaagatcaaaaccaaatagtgcccccaaattatttttgaggtcttgtacccttagaatcagagaaactctccttctttttcttgcctattaattcaccctaagtattagtttaaaaatatgtttgctgtgttgtcatgtatccaactagttgataaaactacaagattttaataaacataaatttttattattttgcagttatattgaaatagaacactagtgaaagaattttagttactcatttttttcagagaaaaggtattttaatacgaacattgtatatttggacacagaaactgctatacacaacaagaaaccatgatttgatcaattatgacattattatctcttctaaaaacacagaaattacattattaagcaattacaagaggaaaaaggaagtctgtaaagtcctattcaatttacttttttaaggaaaatgatgtttatttgactctggtcacggttccattttgtctactttctttgtaagttcagcttcagtgctacctaattctctctttgcttcttcaattttcacttgagcaagagatggattcagcattaaatctaaatagaactccatttttttcttcaaaggtatggtctatcgttttaactctgccagtttctctgataccgctactagggactgatgaaatggagaagcatccatgcctctggctgaaagtgactcctctgcagctttgatttcaaatctgaactccactgactttgtttttagaacatccctgttctgaagatgaccgtcgactttgaccctttccaaagacaaatgaaactctactttcttgagatcctctttttgacatttttccaatattaatgttgcagttagttttttttcaagattttcccattcaatcttgatttcttcagtttgggattttgtttgaaagatcagatgtcgaattattcactgcagggataaacctagctagtgaggtatctttagtttcaagggcgatgtgctgtcaaccaaagcattcagatacctggaaccagtgctggagagattggcaggggaaaagttcacactctccatgagaaggtcttgaagaggcttggcttctgatttatattcacttgctttctgcctgtttcaagtcatgtattaccaggtagacatccctgtcctggagcttgttgcattctaaaaggtggtgtaaaatctctaattcgtaggttcacctcatactatgggtatgagattttgagtatgggtatgaggtaaatgggattacctccattttttttttttttaatcacacagcaacctgcacctctttctcctcctggggctccatagctgccactcctgccacttcacacggaactcctcaaggaagaagtgccctgcaagccccttatttactaattttcatttcaagaattttattttattatcttcaaattttattttatctaaatcttatcatccacaaaaaaagagtttctcaatatttcacagtgtacagacatggtcagttagcttcaggtaacaaaataatcttcaaaactgtaacagtaaaaagtttcagaaccatttggttgatatgatttattaaaggatttaattattcattggagatgttgataccttagagctgtggtaactatccaatatggtaactactgaactcttcaaatgtagctagtctgaattaatatgtgctataagtgtgaaatacacagcaaatttgttttaaagacttacaacaaaaaaggaaatagttcatttataaattcttatactgattgcatgctgcaataatattttgaatatactgtggtgaatgaaatatattattaaaattaatttcacctgtttacatctacttttaaaaatacctcttccaaaaaagttagtctatttccatcacatagcactactttagagaaacaaaagtttctggttactctacagggaaacagttaaaatataatgttgccaaggaagacagaaatccaacaggcagtttagatgttctgccagagagcctgatcattgtttctccagaatctactgcaaagacacctcctgaaaagaagaggccgttttatagcacatgctgattcaaacctgggtccctcttctgcaagatcaaccatatcagttagtgctatctagaagtagttaatagatcttaaattactggaactaaaggatacaaatgaactaacatgtgcaggagagggagacatttcagtgccctctgaatcttgtctgtgataaagcccactgtccctttctaactgaagcctttccctttagcaacattgttgtccaaagttggaaggccttccagtactgtattttattttattttattttatttttttgagatggagtttcgctcttgttgcccaggctggagtgcagtggtgcgaccttggctcactgcaacctctgcctcccaggttcaagtgattctcctgcctcagcctcccgagtagctgagattacaggtgcctgctaccacacctggctaatttcgtgtttttagtagagacggggtttcaccacgttggccaggctggtctcaaactcctgacctcagttgatccacccgcctcggcctcccaaagtgtggggattacaggcatgagccactgtgtctggccagtactacgttttagatacattaattcattggattacgttttaggcccttagacacaagggaatgtggtctctggacttttgtctttctgagaattttttgtttttctgtgaaacctaaccatctggttcgtgaatattccagaataggaaatattaatataaaagtgattctgtttatatgagtcttcacttttgatacaagaaataagatcacaagtttatgggaatgtgtttttaaaagaatcctgctaacatatgtacatttcatctcttaaccctttctgacctgtatatttttatttgttccaagtgactcaatcccaacgtgtcagtaacgacctcccatacataccaagaagcttctgccatctggtggtatatgtggaggacgtggtagtcaagatccgcagaaggatcaaatcccccagtccagatcccagcttccagatctgttttctcaaaaagcttgaaagatgggatggagtataacaacttgacaccatcatcagttcagctaatggttgtttctcttgcttcccagaaagttggtttgttttgtctttttataccatagtaatgacatcacttgacttgaacatttccctgcactcatttttaattatttatttataattttttatttttaatgttcgtgggtacatagtaggtgtatatagttatagggtacatgatatgtttggatacaggcatgcagtgtgtgataatcacatcatggagaatgggctatccatccccttgagcctgcactcattttaattagcagtcattttctttttacagaaataatctggcgttaacaccacagttttaataaaatttagactaaaattctcaatgaattacacaagtaaaataaggatctaatgaaatctgtggcatgatttcactatcctttgaagctgattttgaaaagttgtctcccagtttaatgttgaaagctggtcttcatacatctcataagtgtttgtagtattcatgtaacctcaagcataggcaacattttcctatttcatgttatttcacctgctctattagaccctcagacaaattatatatggttaacagtttgccctttaaaatatgtttgtattatctataatcaatttttaaaaaatcgttttgtcaattagtgtatatttcatgagtatctatgatgttaccaagccctctgggaaatgttggggataaattgataaataagataacagtctaatccttatggaatgtacacagaaaatagacagtgtttgacttttctgaggctttttttgttctgaaaaataggaatcaaaatgtttgcatagtttcaataggttatagacattttaagtggcgtataagtgatttcagaagaagaaaagcctacctctgtaactagtcttctcaataacatctacacagtctttcactgtaatccaagagtattgagactaattggagcatttcttgaccctccaataataggagacattcaaacatggtattaacataatctgccatcatagagaacagctgaattaatgtgatatgaatatcatgatcaaccttgatggaataaacatcttcgtacagctgcacagtgagatggggatgaaagccctttttctgtgtcaagcttccaaaaatggttaattaatctgaatactttaggtaaattaaaaaaaagaatggaatgaagaaggatgtgaataatctagataattaaactctactgtgcaccttctttgaaagttagtctagggtttatgccataggattatgtaagaatctgttaagagagcttattgtttaattgttctggtctatataacagtgttaactaaaacataacctgtattcagtagaatttggtttgaagtgggtttatctccgacccctatctactaaaatgctccatgcatcttagttacctgtaagaaagtcccgtagtaaagctctgagagcccccagacaccagcacttctgtttgggatctgttccagctcctgctagaacttgccatgtggttttattcaagacaccatctacttgagctcaaatttctctatctgtaaaacaagggagtgggccccaaattctgattttaccaaaatcagaatacaataagaaggaaactgaaggtttacaaatatcatttttggtgtgtcttcattgactgagtgttaattatactgccatttcactgcagcatttctgttgtaaagacttctgttgcagtcagtcagagtcaatcagtgttgaggttaactttctctggctgtattgattgggtgaaagttatccccaaagctggaggaagcaaataaattccttctatcaacttaaattgtagcgatgcctgtcacaatttaggggcacttcttgctatttgcctttctggagttgttttgattccaggagtacagagacttaactccagctttgaaggggagggttggagacgattagagggagatacctctgagcccaaggaagcagcatcaaggacagagtggggaagaaaaccaagtgtcacttattgaaaagcaaaggctgtgatctgcagtttctggtttgttctgatagaagactttggaacccaaaccatctggacacatttcagggacaataaagaattgaaaaaggttttacaaatagaaggaaggtggataggttatcaggggaaaatatgagtcacaacctagtgaactagtttagaggaaccaggctcccagcacacaggaggccttgaccagattaaaaagataactcatttgtcacatttgtcttcctggtcatattcaaaaagcttcacctgtattcggttaattaattctcatgacaaccactacaggtaggtctttactctccttatttaatacatgagaagatggatttataaagaagttaggtgccccaaatcacagttgtgaagcatcagacccactgaggctggccccaaagacaggctctcattggtacaaatgtcctttctggctccagctttcttagttccctcatgatcacccctttctttcatgtccccccagatgcttgagtgcttcctgatcggtgcataagcatgtgttcattagttaagagtgcttatgctggtaggtagcttatctacaaatcgttactagagacggaattaggagccatgcctcctcctcatttctctactcactctgctcttctgtttacatcaatcaaatctctataatgttcatattagtaaattacttaaacataagctattttacaaatatatgctaagttcttaaatatcttcattctgcctcatgcatgcttggctttctgtgctagtgtctcagtcaaagctatggaattggatagttcgggtagaaaacttctccaattatctatatgttcagaaaactgggaaaacatcctcgaagaagaagcacacattaagtgcctttttcctgacagattttagcctaccacaggatttcaaccttttgtgcttggggaagtactttcttcaacaacaaaaaagataacattatggttctgtggtacattgtgatatctctcaaaccttcttcataagcctgagatggcttttagcaaatggtttttgctcagagatatgggttttttttttcattgaacaaggaatggaaaatatgctaattataattgaataatggactcaaaatttagattaaccctacctgatcacactaacaagatactgtgagtctgcattcatttgtttggtcaacacatcatattgagcattgcagtaggcagattgatatggcggtccccatgacccccacctcctggtgttcaaatgtggatggggcctgtgacttccttaaaaacaacagagtagggcaaaggcagtgggatgtacttggttatatcacataacatcgcagtgcccctcctgctggagcctctccttgctggctttgaagatgccagctgccatgctgtgggctgcccgtgttgggagcccacctagccaggagctgagggtggcctcttagagctgagggaagcctccagccaacagctagtgagaaatagaagtcctcaagatcacatacattaggaactgaattccaccaacaaaagcagatcctttcccagtcaagccccataggagaccccagcaccaaccaacagacacctttatagcagcctggtgagacactagcgggagacccagtgaagccgtgtccagactcctgactcgcagaagctgtgagatgccaggcctctgttgttttaagtcactgagtttgtggtaatttgttatatagaaacaggaaactaatacaaacaccctcagtattccagacacattttgaggaattagaaatggagcagtgaacaaaatgaagtccctgttctgaggagcttgtatttcaataaatctaaaacatagacattttagaagctttaattcatctcaattataatttcaaagtaaaaacctcagtgatcccaaaatgggaaagaaaaatttacttaaaatatttatttttaacttttattattattttttgagacagagtctcattctgtcacccaggctggagtgcagtggcgcaatcacagctcacagcagccttgacctcctgggctcgggtgatcctcccacctcagcctcctaagtagctgagactacaggcgtgtgtgaccatgcccaggttatttttgtattttttctagagacagggtctcactttattgcccaggctggtcttgaacgcttgggctcaagtgatctttctgcctcggcttctcaaagtgctgggattgcgggcatgagccactgcacccagaaaaatgagcatttcttttctggtccaaaggaggaaaaataatgctggacatatctcagcattgacttaccaggtgatcttattcaaggaaagaatgggaggacaggggttgtcagctgtagaacacgagttctccatgggctgaagctttagaatcagaactttgcagtcccatgataatgcaatagtgagatacagtatatctcactatttcaaaaaaacaaaaaaagatactgaaaagcttaaatacataactgccaaaagtcaccaaaataagaaaagcaatttcaaaatcagcttattgatttgatttctatagaaagaccattgtctaaaagaaaacctaggattcattcagcattttcagaagatcaaagtcacattcatgaacaacatgtatgttagttctagtgtccagacaagacagctaagaagggcttgaatttccacacaagctacctggctttataagtagccccagaatgcccaggtacacgggccacagaatgcccagaatacacaggccacagtccaccctaggcccagtgtccagcaaatttgaactgccagtcacttgggggaccaggagcctgtactgtatttgggaaaccacaaatctaaggccacattctatagaatagacttaaaggttttcttgaaattaatatgtaatcaatcacactcagaatatatttgggcagcttatatgtgcaatgtgttacatgcagctaaatgactctaacatttctattgcagtgtacagaaggtgttcatagagctagctcttgttgaattgcagttatggttgttaataacatgtgttgagcactagttctgtctagacattgtgcagagcactttgatatgtttttaattttattttcttaaaaggattattgtccccattgaatagaagagactaaaccttagaaagcctaagacacatacgcaagatccaacaatgagaaaatgttggggttacaattttaattcaggcagtctggttgcagaactggtgcccttgaccactatgcatggcacctcctgttaatgtgacaagcacagtgtcagatgctgtgttctttcatttgttctttataacaaccctgcaaaaggtatttgggggtcatgggaagagccttgaaaaactctttcaagtaattagtttaagaaagaggcaagatatcgacatgcatcttctgatgccataatcactttttacataaccaggctaactgggggctctaagggctattgttctaagtaggaaaccattgtgtgttaatatttatcaaatatttagaagatcaatctacttccaagaccttccccatcagtttgataatgcctaaaattctaaaagctcatgccaaatttctttaccttaaagctttgaaattattcctagtcatttacccttatcagtcatgtatactttagtaagaataagtttatctcactcattcatgaaagcagatttttatggagaagaggatgcaaaaacttgaggattgcaaatgctgaatcttctttagagaaggaggtcactaggagtgaagaaaagggcaggtgatatttagcctaatggctatcagagatattaagaacactttctggaggtctcaaatttgatttttttctgtataactaatcatattttctatcatagacaaccttgtgtataacctagaaatgatagaaagtatatgatccaaaagcaaggtaccatcagttctgctctgtacttcttttgaaaattggaaattgtcccaacacattttgatacattagagaacaatttgagcataatgaaaatgtcttgttttttttatgcatgatttttatccatgataacactaggtgaatgcagaaaactgcatccagatgaacagagctgtgtaggaatgtgcaaattgcacacaggctcacacctcaaacatctgccagctacctctgctcaccatgtgctttgagccgcacccatccacatctggtgttagaactttccttctgacttcagataactctccttccatacttcataatgacttactaactgcagccttttgacactcacttctgcaagcaaactccaggtctgttttcaagataaaatatagtatttattgtagtatttatgtatttcttaacaatttagcatgtgtaaaactgtgttatttttattagattaaaaaaaatgtttccctgatgactttttttttggctttttgttttttttctttgagacagagtcttgctctgtcacccaggctggagtgcagtggtgggatctcagcccactgccacctccacctcccaggttcaaacgattctcctgcctcagcctcctgagtagctgggactacaggtgtgtgtcaccatgcctggctaatttttgtatttttagtagaaacagggttttggcatgttgcccaggctgctctcaaactcctggcctcatgtcatctgcccgccttgaccacccaaagtgctgggattacaggcgtgagccatcacgtctggtcactgatgaagtttttagcatccatttttctgatgagtcctgtaggattttttgcccagtgatttttaggaatgtgtgtgtatgtgtgtgactttattgcagaactgactttattgtcacttattatgcagatttctcctgttagggggtgtgtgtgtgtgtgtgtgtgtgtgtgtgtgtgtgtgtgtgtgtgagatgcacttaaaggggtagctgataattatttgaagtacttcttttcacagtggtttagcaggttagcagatttttcccaagaaaaaagagctaaccatgcatcaaaataacacttttctggagcatttctagaggatagctccaaggaatgatgcccacttcatcctttattaaggttggtatctcaggagaacttacgctgataaacatgtgttgccccagtaccatgggaaagcagcttccagcatgccccatttcattcttatatctagctaaatttcttttagggtcaacatttgggaataggccgagcccacctccttgcacacatctgctgctgaataacatccaaatgagagcctcactctgaggttaaggccttggcctggtgaccatgccagctctctcttcttacctttataaagtcctgtatgcctcccttcctccacatcaaatcttcagaagtatatgtgtgctttttgaactatgtgcagcccgagaatttatgaaagctacaaatataacgtacttaacattttaggcactaaataaatgctaatataactgaggagtgtcaaaccaattgttaggaagtgaatgcaagacagtgacaccacagacaaaaaaagaagacatttgaagcattcgtgtcacacaatagtcttgatgtaggggaaagccaggtatggttaagtctcagaaatccatgtcttctgaagactaaattgaactcattctcaaagaaaaactaaagagaagactcagtgttaacaatgggaagagtcctagtagcaggaggaatagcccccacagtgtctggtaactcctgattgagaggcactgatgtcacctgaagttaatcccaactccgcttccatcagtcaggtaagctcgccccttatgggagtctatgctttctagaaactccacacttaacaatctgttctctcattctatctttgttttacacagtatctcaatgaaaaacaaacttctcttccagaatttccaaagtaataataatacctataacccaacagtcagccttattggtctggcctgagtcttttgccagccctgggctagtcatgatgactggcgtggctgggaaaatgtgatgctctgattggctatgcctgattcacatgctcagtttggagccagggaaggaatcagtttcacttggatcacatgaattgagaatagaagataagcagtttctcaaggaaaattggagtgctgtcactagaagggcaatgggttctgggtaagcaagaacaacacatggcccctttaagaacctcctaagccaggctctgtgctaggcactgagcctgtgagagtgagcatgaaacagagccaatgccttcctccagtttgtagtgatttggatatcaattcagtaagcacacaggtaaggaaactgagcctagagagatgaagtcacatttttcaatgttgcacagctagttagagccaacacagtgtctagaaactctaaaatcatggccaatattaagatgccatcttgccttactcgtatagcaagcagacctatttgaagcatggttgtctgttaagcacacaattgtgtaggatattactgttataaccagttgtatgctggaattgactcacaccagctggtgcaaaattattgggtacatctctttcctacttaacattcagtgaaataatgttggtagcttgagatcagctatggtggtatttacactgtagaaattggcaaccatcaccatgaactgattgttacacctttaccaacataccaccagttaccatggttataggaatttagtcttcaagcaaatttttttttcttttctagaatatttaataaaattcacataattactgatacagatggatagatgtgacaggtcaggaagttcttaaaccatagaatttttgtctcttttttcttccattctactccaaatcccaaggtcttcaatcttatatgtttagtacaatttatattttattttcgtatttggtgcatgttgatcaaagtgaaaccacagatgagaggggactactgtaccacaaactgagcagcttaaacagcagaaatttattgcctttcaattctggaggcaagaagtcctagatcaaggtgtcagcagggtgtctctattactaaggcatctgtaggtaacatgtatgaatcttcagcatcagacttgaccttactaatactgatttttagcataacaaacagactagactttagctatgttcttcttaattgcccaaattagtggccagtaacctatacctaaagttttcaactatcagatttgtcagcgttgtcctttgtactagcatgcattttttttggtaaaaggggagaaagaagatacatcaggacaccccttgataaacctaactcaaaaacaaataaaggcatttgtatcagtttctgtggctgctgtcacaaagtgcaataggcgccccttatctacaggggatacgttccaagccccccatggatgcctgaaactatagatagtactgaaccctgtatacagtatgtttttttctatacatacatacctatgataaagtttaattgataaattaggcacaataagagatgaacaacaataactaataataaaataaaacagttaatatactgcaataaaagttatgtgaatatggactcttcctctctttttctcagaatatcttgagagttaccccatgtacctaagggtaactgaaaccacagcaagtgaaactgcggatcagaggagactgctgtaacacaaactaagagccttaagcaacagaaaatgtattgccttgccattctggaggcaagaagtcctagatcaaggtgttggcagggttggttccttttgtgggctgtgagggagaaatctgtttatgcctctctcctagcgtctggtggtttgctggcaatccttaacattcattggcttttgtggcatcactccaactctgtcttcatcttcacatggtgttcttgctgtttgcatctctgtgtccaagtttccccttttttataagaacatcagtcatattggattagggctcaccctaatgacctcattttagcttgattacattggtaaagaccatatttctgaatgaggtcacattctcaggtacaggggtttaagacttcaacgtaactttgtggggaggacacaattcaacccataacagcattgtaattaaatttttaaattgtcacatgctaatatcaatagataaaatgttctttgtcaagctagagttctaacaagtaaatatttcattccttttgaaaaacaggtattcctactgagttgatttccatgttattcagaatgtcttaatgacctggtcttcagccttgtgctccttgttcaaatgcagcattaattttaagacagggctcagtcaactcagcccactgcctttttctgtatggtctacaagcctagaagagtttttacatttttaaagggttaagtgggctgggcatggtggcttatgcttgtaatctcaacacttggggaggctgaggcaggaggatcacttgaggccaggagtttgagaccaatctgggcaacatggcaagacccccatcttttaaaaaaagatttttttttttaaattagctggatgtgatcacatgcacctgtattcccagctacttgagaagctaaggtgggaggatcacatgagcccaagaggttgaggctgcagtgagctgtctacttactacagcactccagcctgggagacagagtgagaccctttctcaaaaaaatgggagggggcaatggaaaaaaatcaaaagacgaatattatttcatgaagtgaaaattatataaaatccaaatctcagtgttgtcaataaataaatttgtattggcacacagccacactcactcatttgcatattttctatggctgctttcacactacacaggcagagttgcagagttgcagagttgcaaaggagactgttagtctgaaaaacctgaactatttactctctggccatttacaggtaggatgctaattttgttaactatacctccctcacaactaattgctgctgctcccgaatgacacagcctagtcactgaagcagacaggcatcatgctgctgacctttgtgctgtgaggggggtgtcttcattcataaattatagcatcatcatgattctgcctattttgttactatcagaagaatcacgcagctaattagtaagcatttaattagaagtcagaaccaatgctgttaatgggcatgcttaatattccatcgacaaaattaactgctggcatcaaaggtgtgtgtgtggtcattgccacctccaacccccgcccaatatggcagcattttatgtctatttgttaaacataacttccatgtgtaacttgcatcttgaaataatttagttccattgaatccactgggattgtatttaatcctgtctctattagttttctattgctgccaaagcaaattaccacaaatttagcagcttgaaacaccacaagttttctgtctcagaattttccaggctagaagtccagtgggcttgactggctcctctgttccaggtctcacaaactgaagtcaagatggcagcagggccacatttttttctggaagctctgcaaagatcctgctttcacgctctttcaggttattggcggaaagaggagctggtttctgccaacaatctgaaggagggcggtggtccctgcttcctggctggcagtgggtgggagcctatcttaaagctacatgactcctgctcccatttccccctccattttcaagccaccaagggcatgtcaaacccttgtcatgcttcagatcttctcatgacttctgcctctagctggagaacaatctctccttttaagggctcatgtgattagattggtttcttttgggtaatccaggataatctccctattttaaggtgcataaccttaactacacctccaaagtgccattcgccatgtaacttcacatattcagattccgggaattagggcatgagtgtctttcaggggccattctgcctggcacgccttctctgggttctgtgttcctaacctgagagtctgcatctctgttttctcttagaagactctgagggatcagcacttggccctagggactgcacttgcttttccattttgggagcccccagaaagactagcctttggtagtctctttctattgcagagttggcatttcaagttagtttttcatggatgtatcaccatgttattcccatgcaacacaattaaatgaccccagccaccacagctgaaagcatttatacttagttatttcatacagctgtgttagaaaaccactgcatacatcaactgtgatataaacgtaccctgctagagttgggcagtgaacagcctgcttagcctgatgctgcagccataaaaaaaaaggtctgtgtgcatcttggttgcccatcttctttctccgaaaggcaagagccaaggagtcagactggaacaccttgccactctgaagtttagaatacatccattttcatgactactcaaattataggtaaattgtcaccttgctgtgcactgtaatgtttctggttacccatctaaatctggttgatgtccacgtttggaagaattccttacatttgatccaaatgtaagaaaacttgaagtattttggaagttcaggctgaaatatagttgcattttgtaaatgctagatagctaataactaaagggaaattccagcaaagtggaaggggaagtaggaatggggaataatctttttgttcactggccatgatcctggcacagagaccctcagagtgcagactaggatttcttaaacactaacatgctcatgaatcgcctaagatcttaacattcacattctaattatcgagtctgagatgaggcctgaaatttcatatttctaaccacttcccagatgacgcaacctctgtgagtctgtgggccacactttgagtggtaagaatttagagaatttagactaccaacaaaatgaatcaatttcttcccaaagggttatttttttcacaccaactattgtatctacgttaaatgtattcatattactggcaaagtcaaagagctcagctttcctttccttgcttggtattaggatttaagtataactttaaggaagctgcatttcctcagcacaggaagaacaaccatgaagaatgccattagttctaatcaactcaaacctaattaaagagaataatgtaatttaaagtgaaaattttgattcaaataggttcttgatgacaagattagcataagaagataatttctttaaaatatcttaagtatagttggagagtgagacaatgtggtttaatgatttgtgttgatggggagacatttagggcctgaactaaaatattcccttccttcattccctcctctgcatctcatttaagccccctagaattctttggaaagcctggagacatgctagcttttatcatattgggagctggtccaggaagtatgaatgtgaaattttagcatttgtgtaactgccagcaggtgtggtctgaatgtgtagtgcaggctccactttcagatttcagggaagagctaattcctcagtaatgctctgtgatgcttgaagcttggcgtgaaggctgggcattcctggggagggaactgcctgccagtggtcctgattctgtgtctgctggcaaggctggatccaaacaagcttcctcttcccctttttgcagtcggctgcaaatcctgaaggtagacagaggcaacacccaagaggctgacatcatgtctttcaccttccaagatcaaaggatttaagagtgctactaaagcaatgtaattcaatttataggagattctgaatcaccaagattaggcttggttatcatgaaaatggaggaattatcttctcagggatttgtcgtcctgtcagtcagctgagtttgcctggttgacaggaaaggccccaaaggaactccatgtgattctgctggggaatatgaagcccagtgtcgaatgaagagtgccccgtctctgctgctgagattgcactgtggtttagtgggaaatgttcctaggcttcagttttatattctcacctctagtattgtcagggacagccactttctgttttcataggatggaggtcctctgcaaatgctggtaaatgcactgcagtgtttaattaggaagaaggatgtagaaactttgtttggtgtgtggcatataaagaagagaaggtaaagcatctctgtcaacaaagaattcaaagtgtaagaactcctggctgccttcagcctgacagaaagtgtcttatcatctgtgtctgctctgcggcttggtggccaacagtgcaggctttagagagaatcggtctgatttctgatacctgccctactacctactcgttgtgttactgagcaaattttaattcctttgtgcctcagtttcctcatcgacacattgggaagagtagtactgtactttatagggttttcatgagattaaataagtttacagatctgaaacgattagaacggtgcatggcatttataaatgtgccgggaaggttagctcttattcggatgctcagagaacccgaggtaacagcagggaaatcagaagacatgggttcaaattctgactttttcatagatttaggtctatcccagtgtctctgaaattctttgtaaaacatggactgtaatacctatctcccatggttttagttaagctgaaataacagtttatgtgaaagagtccagcaataaatcgtcgctcagggacagatggttgaagtcctacttattatagcaaatatgttatcctaaaaggtattaaattaactgatagcaagcaaactagatttttatgtaaattagaaatctatttgcagacaagtgtccattatgaattatggaaaggatacaattttcctctatttagctctaatcctttcattttgattagattaggttataatcctgacagtgacatttattgagtgctttttactttatctcatcagtcctcagtacactctggcaatattatggtagatagtattatgatccctgttatactgcatgttggaaatacgtggctcagagaggttaagtaacttacccaaggtcatacagccacaaagaagcagaggcaatgctgtagcctagttttctttgactcctgataaagtgctctttagaactatggtgttttctctacatcaagtcaaatcttatggtctcttagagcaatttttgtcatgacagttcaaattatagatcagatcttagttttagttcaaagtcagaagcaaagtagtcaaatgagaagaaaaacaaacagccataaaagtccgatattggcccatttctgccaccaacatgccataagactgatcattgttttccagtcttgaaatatcttctccccaaatcagaggcagccccacagttttgttatagaagaggcttctggacactattgagtcgaaaggtaagagtggtggttgatgctcttgccttgagtgtaaatttgccaagcaagcatatagtttgtattacaatactatgcttgctaagtggtttggcatgcttcataggttttggaggctaaagcccccctgccacatcacagtcttacgcctctgactcagtttctgctaacaataaccaaactatatgaggatgcgatggtttactgcactgtgtggccagaatttagtagtgttactagattaaaccagaccacaaagaacagttctactcttaaaaaacctgtattttacagtggcctggtcaggaaaattcgtctgtttttgcttagcaagttgcactaggagatttcacaatttagttcattgcttttataaacagtgttttccttcctgtctctgaatagatcttttttttgtagggaaattggagctatcaatctatccagtgtaatttcatccttttctatcagatgatctctactaatgaatcaggaagcctgtgtgtgggctgggagacgggagggagcagagaggatatagaatgaggaaatgtaaacagcactgccagtgatgctcatgcagcgaagatacgccccaccgtcactgttatagcctctctctctctctcacttctttaaaagctaattcttggaatccttggcagaaccctgcgagtccctcttctctcatatcccttccatgcaaatcacatttaacagactacttgcgtggctatgcacttgactaaaagactgttcaactacagctcactaaagacgtgccatcaagggattgcacaacctcacaggagaatatgtgacacagagtaggtgctgagaagcctactggaagaccagacaggaaggtagttgagagggagaaaaatagaaatgaatgagctgtgaaataagaagtaagttaaaagggcaaagactcatgggccatatgtcagtgtttccttcctcctcctctcaccaactctgagactgtggccagcttagcctttgtgttcttatctgcaaaatgggataataataatgccaatctcctattattgtaaatattgagtgataaaatgaatggaaagcaattggcacttagcaattttattcattcactgttagaattatccctttcccccaccatcgtagagtccagtatccgccattcagaactctgtaagggatcatttaagatcctatgacctttgaaatgggtcaggacctattcttctgtcctttcttctttttctgtttatttttatctttcacattacagtgcaactagagtgagcactctaaagttttcccctgttcctctatggaaattcacaaaagattgggaaactaccatgaagtgaagccttttcactctctaatcccaggggctatttccacctagcacactgaccaccgggcttcctaagtgttgctgattctttgacctctctctaaaaataactacatgatgatctgttcttcacagttgaaggtaaagccccttttgtagaagctgggttcttcttctaattagcatttctacttgtatagttttcttgtataagacaaacatatttttaagctggccataaagttggaactaccatctaatttctgcctctgaaacaaaaatcacacaagccggcagtgtccccaaaccactatgaaatccagtctcaatcaagtcctactcttttgtagctggaaaaaactcagaagccatttaatgccattttctcaattttatggttgaagaaactatattggggaggttaggtgacctgctaagcatgtagttattctggaaaagcctggaacctttcccactacattgcattgttttccatcctcaaatggaaaaactctaaataaacacccttctcacctttacaggatagatgcctgaaggaagtgcttccaagcatttcagacagtattaaatctatcactcaacttatgcagatcactgtgacttccttgaattttcattattggcttccaggcacatgcggtgtgcttaaatcatcacctataaagctccctccttctacctccagtgatggcatgggctgataatatgaattggtctttacaatttcagatacttctatggttacaaaaatccattttgataataaaggaagctagaactattgggagtaggtccctgaccttggaaactgatgaacacatcttccccagcttgatctttgttgcatctgagaaaaaccctgggctgcataactcctggatctgacccagcatgttctaccacccacagcaaaagcacagaaatataaccagcaggacgcctattgattagacatccacaagttatattactgattacctactcctcaaccttcaggcaggcaaacacgttttcagctctcatgaagtcatttattttcatacgtcttaatatttcacattttcttcccttggttttagacttttctacctctggctgtgaggtttgccttgtgtattatttgcccaacagggcctccttaatctggtttcttttctgcctctcacccagatactctgctgaattactctcccggataggagcatgctctttcctaaggagggaggtgcaggggtacgagggaatctgtaacttcatccgagtttggcttcttaggcttcatgatcactgagtagagcagtcatttggaacccattctggttattttctaaaatcaccaaggaagctttgaaaaatgtaggtgccaggcccgccggagaccagtgaaacacgatttcaagggagagggcatgacatcggtctattttttaagttccccaagctaatctaatggatagccagggttgagagctactcacctggaattttcctgtagcagacgataaaactaaaaatagaaataaggaatggaaacccaaaaaggttaaacagatggcacaatgtcaagaaaaggagagctgatagcagagaaggggggactgggtgcgtgtcagtatgtcatggttttttttttttactgtcttttcaggagtcgttggtcaaatgcatcattgcatgagtctagcattatagcccaagatggtatggggtggccctgatttgtgataaagaggctttttggccttgttaggcaagaaatgaaggaacaaagtggtgtgtgctttgtttagtggacagtgactattactgtgattctagtttatgcttgctgaagtgagcctattatttttatattggtcttcccataagacagcagcttctctaataatggaaaggtgcctgtgccagacacacagcaggagctaaatatgtgcttgtaaaatgaatcaaggaggaatgagtaagtgaacagctgaattatacctatggaccaatcctctgttttgctggtatttttttttctttattatggtcatcagtgatctgatgtcaaggcatattgtggaagtgaagcaacccaaatcctgtcttctcagactgaaatcctctagaaagttatgacttagccatttttaagaaaatgctgctttcagtggatatctgtagtagcactcagtccagtgctgctggaaacacttacgctgaggaatattgatttttttagaaacttcattaaaatttatatttttaagctttacaaaatcagatcctaaataggagactataagaaagtctgcaaagtgactcatgataaaaaaaatattaggaaaaaggagtttaattatagtttataaactattgatgttacatcgtggttggttttaacatagccaatagactcttcatgattttgatgaaaaactttatctttagacctaagatcttttaaattatgctattatcagctaatcaattaattcaattttatagtagaagtgttgcagaaccagtcttacgaaaatggtataaaagtaaaagaagttggtcttcagtgccctctccagccataatcttgtaacttacatggtaagtattcatactatgcacatctttataggtattgggacaggaggtatgtgtgtagggggcagagaagttgagtaaagggacaatgagaattttgaaaatggaagcaaaagtgcagatcaagccgttgccaccttgtataattatggcattgatgaaaccaccccaggttccctctttacaatccactaaaattttactggatggaaaatcaaagtaccatatatatgctttaatttgggaatgattattttggtgttaatggttccactgttgataatacacttgttctctacttgtagatgcattcatattttctcatccctaaagttccattttacaaagcacctcacaatatacttattttttctgtcactatccaggtgagttaaatcacattcatataattagttatttactgtctattcaagggagagatatgtactgtgtgtttctatgttaggcaaaagaaatgggccttctagatgttctgacctttaccttctttccttgcttagttactcccattactaaggcttccagtccttttagcctttgtttctatgtcacattaaattaatgaaactagataactttggatctccttaagccatctgaaactagataaaccaatgaaactagataactttggatctccttaagtgaatgccatgagtgcatgatgaccaaacactagaatctggggacagactgtctagatttgaatcttgacaatgcttcttcctagcagcatgaccttgggcaggctacttaactaagactcagtttcttcatctgtaaaatgaatacagtcatattacctacctcataggctagtcgtgaggatcaataacatactgtatataaaagaacatatgtaagtgcctaggataagtgaggagctagatggttgttaagtactaactgcagtaccaggaatttcataggaagctataacagctacatatgtgtgccttcataagccagaaacacttattcagtgaattgtcaactacttattaaacatgtcctctgaacataggactctgctaagctcagctcaggatttgaagctgaaccttgaagtttcattaagtaggatttagttaagtggagaagaagactgatcgacgttgttcagtatggcaggtggcctctagctacgtgtggctactcagcactcaaaatgtggccagtctgcattgagctatgctgccagcatagaatacacagctgattttagaaacttaatgtaaaaggagaaaatataaaatatctcattaataattttatatggattgtatgtcaaactgataatgttttggacacattgtattaaatgaaatatgttattacactttattttacttatttgtttttactttttaaaaagatgactgttagaaaatttaaaatggcatatgtggcttctattgaatttctagtaggcagcactgtttcagatggtgcaactcatccatcattataaagaacacagaggcacaggcagtgagcacggtttgtggactcacacagcttacagtctaggaaagggacacagtaccttacatgactgggttcataacctgtggggtttgagctcacctgtatcatttgcactcagtggtggaggttggaggcaggatagttgcaacaatgactgtcacccaccgaaagcccacctacacaacagaagaattttcctaaccagtttagagaacttaacagcaagttttgtttgtcttctgcaaaactgggtatcaaaatagtaaaatgagggtaaaactgctcgctgctgcttctgcaatcttcagagcttctttgttcggagcaaaatttcttgctttggtttgtgtaatcttttggccaatatagttgagacatattttgtagcactttgttgaaataatatcagatgtgaaataagccagagtatagaggacttgaaacaagaattaaaaaggcacattttaaagcttttagccttgtcaagaaatagctattttaactttcagatagatagcttttgagcctgccaagtaaaggaaacgaaatttaaactagtctaccagagctttatttttcttctcatatatgccaaatttgaagtggctgttctgccttccagtcaagagtatgctctcatggtgttccaggtctgcacagtgggtgccttccacacaccctttccacacaaagccaaaaccacacaacatcttgcaccttcatttttggaaatagagaaaggaaggatggaaagaagggtggaaagaaggaagtggccattatcgaacttctcgtatgtgccaggccctgtgctagacatcagcatgtgtcactgaggaggtatgggatgggctagaactccctggtaagtaatttaaggtgtgaaactaacaaatatcatcccaggacatctgtgatggtatggcacaccccagactctgcatcaactcctaatctagactgaaaccacatagtgtttaccttaaagtttctttctgcccattttgtatgtctgactcatggagtggcctgaaatctgcatataccattaagagcactccatggtgtggagtgtggcccagtcactctgttgaggtgtgttggcttgccttttgatgagaatgcagtgctcatatttgtggcctactcatcatttccttctgagcttgtatcactttttatcattgctaggtttttccttctgaaaattatctttaattcatgaattcataatggaaagtatggagacacttgaacacttcccatccagatctgatctttgaagactactggacttatacatgaacaaaggaaaacatatcagatggacccatttctctttgctctgagcaaaggcttgtagagaaaagttgtaaggaaaacaccaccccgtactcaaggaaaatatgaacccttcaaaaaatgtacagaaagggagtttaaacttttctagaatgttcccagcagtttgaaattggtttaaatgaggcaaatcaaaggaaataacttttgtttgtcagtaggttatagtgctttgcaacatctgggaaaagaatgccccttcattaattgaattgaatattcagtgaataagtaatgataacattatggtcaacaacctaaatctgtacataaaatgccatgttctttgaaagagagttttgtgctgtatatgaaccaattgttttcatactctgaaaacaataattcacaccaaaaacttaattacccatgtgcactataactatgccaaccacattaaaccctgattttaaaaagttcaccccccccttctctttagatgaatgctaactggaaataaagtagcatttttgttttgctttgccctgaattgtgctgctgagtgatattagctggttatttactggatttctatcctatgctacttatccagtcctgacaatgcaggctgggtctttacaataaaagggaaagaaataagggatgaaaattcattcaacttgcaatgtaatatggtggcaccacatactggagcccccaagtatcgccaccattcctcctgtagctttagaaaagccttgcaaaattggagctgccttattggaaagcctacgtgtttgtctgtggaacataaacatagcctcagactagcatcttatttgaagaagtctggttataaagtagatagccatcactttaattgtcaatttaatatgtgtcaagtgttttcttggatgtcaattgtattatcttacaatttaattttgatttgttgagtacaactttccctgtgccaggtagttactgaactgctcatgtactttatctcatttagtccttgccgaagcctgtgagcttgtttctcttgctttacaaataacgaaactgatatttagagaaactgaatgacttgaccaaacgaaatgaaagtgaggactcaagtctaggtcggttgactccaagtctggtgataggcatgttggctttccagtattccaggagtctatgctgaaggatggagaaaagaatgccccagattgtagtagagaaaagcaaacagtgccagagtttcctatacaatcatctttttagaaattagaaacattatatttgtgatctttatggaatataattgagccacagctccatgatgcagtccattgccaatgagcacttggaagagccctaaccagtgtcacaccagtgatgaccatctccaatatggaatgatgcaaaatcctagatcctatctccaacctaagaaccctgtaccatggaggcagacattcatccccaggagatggcattttatggcctaagtatatatactaggtctgtaccgcttgtcattttacaggctccttacagaccatatattctgtggttggaatcccttggcatcagctgctcctgtactcttcacatgagcagttatgagatggcagtagtgcattttatgctcgcaagtgcatcattttttttaatatatcacagccccaatcctgccttagctaggcatagtaacaaagctgctgtcttcctgtactgctaaaggcagacccagagacagtattatatatagttcacttttattcacttggcttagctcttagtgttgtcagagctaccgggctcctatttcaaagtaacttatgggtggctgtgttcttctggagcttcagaggggcacaggactgctctaaatgctatcagctaaagtgcctggtgacctcacaactaaactgaattatgttctgatgcttttttccagtctttaagtactcatgaattaaaccacacctactttaggatgaaacttcaaatggaaacatcagtgattctcctacctttaccaattttagatagtgatccttcagtatctaaatttcttcattagtaaatgacagatggtattggtgagtcttcacaactgtggtcattgatatttaacacatattctgtacaatatattacaggttacagaatggtatgttaggccacctgccactgaaatgtcaattgatgatctttttctcttcagtttttcattagtgttgtcacaagaatatttcaccttcattttaaaacatggatgaaagattcaccatgttgagttggggagtgttttgggagtgtgaatcaactgtgtttttactattgttctatgtatattcaagtttaataaatgtcaagatacatatatacatatatgctgatacaggtatatcagaaatactatatatacttaaatatataatatcttcaaatatatacattttatttattaatgctgtttgaattatattttgctttgtgtatttgcatttttacttactgatatttagtgcttaacattttataatccgtatattatgagaagtctagttaagagacatatttttttctaaagttcttatatcttgtgggtgaatatagtgattgtccctcaaaactaaactctttcaaagaactgaaggattggctcataaatcttccaacatgtctttggttgcatgatgaaagttggaaacataatattcagacaagggttatacttcccaaaaaattgatcaaaaagtaattctgtatttagccttaaaaaggaaggaagtgctgacatatgctacaacatggatgaacctcgaggacattgtgttgcgtgaaataggtcagacacaaaagggcaaatattgtgtgatttcattccacttatacgaggtgtcttgagaaggcaaattcatagaggcagaacatagaatggcgggtatcaagggctaggggcagtggacatagggagttagtgcttagtgagtatgaggtgtttgagaaattcattctagtaaaagttctggagttagtagtgatggtcacacaacagtgtgaatgtgcttgatgccactgacttgtacagagatgcaaaaatgagaatacgtgtttatgagaaagcattttttttgtgctgaaatcctctaaggaaagttacagtgattctattttcttggccaaagttccaaaataaaaagaggttaagtaacctcaagatcactcagtaaataaatggaagagctaaaaatggaacggagggtttcccgagtctctcttgctctgcgtcttgatgaacacgtgagcatccttctctgcagcagcgaggttggcagcgtgcgtgaggggttggcaggctgaagagaatcttccatgtcctaaaatagttgtggagttctaaaaacctatcatggcaaagcaaactctgttacaaatgctgactcctcatcccagctctggcactctctactaaggaaactaaagaactgaaggaaatagatggcctttgaatagccacattttcatatcctgatgaattcctgctatttagatacttaattgtttgggtaatttttagcattgtttttcctcttttatttaaaaaaaaatagcatctgtgaagtttgctagaactttttcggtgccacggaaattaatataaattttaaaatcaattcaatttgcacatacattaattgaaattctttggacacctactcagagttataaatataataattatatttccatgaaaaaatgagagctcagtactatcaaagataaacacagctgtacattcattaaagtggtgaaaacagattttattcagtaaccactgacagtggggggcagaaaggagttccattctgatttgcacagaggtgactgggtctttgaaagggagaaggagggagtgggaagtgggaatgaggctgggctcaagagtcaaaagaagagaaaaattacaaagtgttggtcagtgtacatacaattaaggcagctgtgccccctagctgtcaattatctaagttaggattctgtgcttccaccaggactgggaaacagaggttctaaccttcctaatgattacatttcaaaaaaatggctttcaggtacttgagaaaggcactctgaaggtttgatagatacacgtagatctcagagggacagaaggattcacaattcaaagtcctttttagtaaatgccctaagaaagagtggtcaggggccaatggtcaggtgtaggctagaatgaactgtatattctttttacagccttgaacttttgcaaacgagagctcaaaagggggctggatcatcccaggatgcagccctaggttactagacttctcctagtgcagaggtgtgaatgttcgtgtcgagagtttctgcagtactcggtacccttgatgttatgtctttataggagagaatatagtgacagatgcagggatgacaacaaaaagtttgattttaagctgtgctttaggtcttctgtgtcacattagatatgagaatcatgagtgagttttgacttttgataaatgctttgtctatggttgactgtgtttggaagaaagtatcagtggttcactggcctcatgggattctcccacctcagccgcctgagtagctgaaaccacaggcattcaccacccatgccaagctaattttttatttttatttttagtagatacagggtctatgttgcctaggctggtcgcgaacccctgggctcaagccatcctcctgcctcagcctccctaagtgctgggattacaggcattagccaccacacctggctttttttttttttcagaatataaattaatagttttgagtaaaatattaacaaatttatattaatgaatgaatgtttggtaatatattcagtttttgccttattttagctcacaagctggaatttcccccacttaagtaggatataagatttattagtctagctggaaaaatctatattgaataatgcatatcagaaaaaaagaaagaaattataattcagaaatgacatcttgtctaaatagcttttataaacagatagaaaactatattattcaccagaccaaatagtaatacctgaggattaatagacaatatctataaaataggcactactttataagaattatgtttgctactgaattaatttgatattgtccttttacattgtgcaagtttttttattttttttcttggattgcatacttttctcatctttacagatatgtgcataatacaaaaccatgccttctgtgtttttctattaaagacatttttattgtctccttttaaaataggatgttttcattatatctaatagcttaagaaaatatttttctattattcctctgtattttacagaatggaataaattgtgcttttttgacatcttctcactcatagctttcagaactttttcactttggatttatggatattggtttctgctttcaagttatacatcactgaatctgttttttcacttggtctaaatgtctctgtgacagatactagaacacctcccattcacttaaaggattcaatatcagtcaatttgcaaaggtgagattggaagatgagtcatgagccctttggatttcccactgagtattcaaggatataaaaatggcaacaatagacactggagactactagagtagggaggaagggaggaagggttgaaaaactattaggtgctatgctcacttcctgggtgatgagatgaactgtaccccaaacttcagtatcatgcaatatactcatgttacaaacctgcatgtgtatcccctgaatctaaaataaaataaaagctaatctttaaaaataaaaggtgatttccactatcatcaatgagaatagatacttccatgatgggaagtgtggggtccaaagtgttgagcagtgtattatgagaaatatcctagccctctgtcatagactagctccctttagaatcccagagaacccctaaacaacatgatctttttctctttgtggggattctgaacagtcctaaacatgacatgatcaagtgattaataatagaaccacctggaatgactccaacaggtgaaacctttaaattgcaaccgaaaggatgacttttgcatctcactaaacagatggttctcctgcgagtgacaggtctgttcttaattagctggtaataatgcagtgaacttggaagacctactaaagggagcaacagggaggagtgatccagcgttccacctcatttcatgtcactatggatcataaaggaataaagcaccattaaaaggaaagacaattatacagagaagcctgtaaactagtcacttacatagttaattatttaaatgaaatatgtgtttgtggggaaaaaatagttaagtaacaccctgtagctattttatagaccttgcctagaagtttctatatatagcttgcgtttatttttacaagtccatttaactaatgattccagatttcttaactaccttagacacttttctgaatttccagcctgggactttcagtcgccagatgcctcaacctcacctcctatctcccacttagttgccacctttttctaatagttttgcccctgctcacctgctcttacaacaaaaagagacaggaaatgacattagaagagctctggctttgagtgagacactttcagtacatttcatcatttaatctttccaacaatctccatatcactgatgaagaaactaagattcagagaagttaagtaacttcctcaagatcgtgttcacagcatttatcagagctaagggtcaccgccaggtctctctgataccacctgtactattctcactctgcattcagcatcacaagctcttgtcactgacttagtcacccactgatgagagagtgtgtctagtatctataagagtctgcttggaaaagagcagttttaggatttataaggtataggtgtgcacatttttaaaaggacagtcaacatttatcatgctttctaaagaattaaccttgctttcaatgtctgtaagctctggtgaagatttagaaataaatacaaggagatagatgttgatagaggtccccctccctggtcaaaacgacttttaatcttcccatacagacttgtatttactatatggcagccaagatttatttaatagacgaatacatttggaaacctctagatagctttggagcattggaaaatgaattgtcaaaattgacattcattttccaaaccctagaattaccatgtcgcaaggctgtgggttgcattggaaaaaatgtcttttcctgtgctctgcagcattcattgagaaaacttcagtgaagagattatagggaatgaggaaaacactaagcgtagcctaatacttttctttcaatataaacatgtttagagtgtgtgcatgaggcatagttatatgtcatatttcattttctacaagccttataaaaataattttattaatatccaatttgacctatagttgattaaagtcattatttctgctagtaaataattttcaatgagggcctagggaggctatttggacagaggaataataagcaattttgtcttgggaattctttcaaaagttgcatttcaattaagatggtgttggataacaaaacagttgaagtggaattatgaatttgaagtacttaccatcaaacactaaaataactcattaaacccctactgttaaagattacttaacattaacatccacagagactttttgccccccaaagtcaatggaggcagtgctgagccacacaaaccagtgataaaaggctcagcagtaacttggctagaggcccagatgtggttcatccactataaattttactagataatcatagtcaattccaagcactttttgaaaaatgctcctattttttgtctttgggcaccagatctacatccagtcgatccagtaaccttacactattagggagaaatgtaacatcaatttattgtatcatttcatgatacaataacattgaaactgagcatatcagaaattaacccctaatttagtatatgtaactgtctactcaatctctttatttgaatgtttaatagacatcttaaagatgaacccttgagtccatccctctcccacgtcacatgggcatgatcccatttgccccatcttggtaaatgatactacctagtggtttgagtcagaaaaataatgtcttcttgattcttctttgtatctcattccctatgtcaacttctaaagtctataaatttcatctccataatctactttgaccacttctcaacaccttcccaccactagtccaaggcccaagcttcattagcccatgcaatgcccttggacaaattttgtaaaggcatctctttctcaaggcaaaatcaactgctagaatattggtataatatactctttctctaaagaaaacatatcaatgcccatctgctgaaaagttattgtaataaatatacaagtccataatgctcatgctcatgccgtaaattgcacttctgggattgtgtcatgcaaagcccacagaattgtgtatggcagccctgagtgaggccaccatcgtccgatgtctagactactgcaagagctatctacctggcctatatcctctcttgccctcctgccacagccaatgtttttccatggggcatctagaatggtgttttgaaaattatatatcaaattttgtccttcccctgttaaaagccttccaatggcttcaatttatgctcaaatagaaagtaaaatccaaactcctttccatgatctataaatctcactaagatctgccttcagcctgtctctccagtcttccctccaagctctcaggctgacatttcatcagtatgcattgatagggcttaatgaccggtaccctttctgactgactggtgcgctgccatgctggacattaatatgtttagtatgtattttgactctgttcatttggctctactcatggattttgtggctcatggacattgcaagcttattttaatctgtgttactttcctagggctgccctcacaaattaccacaaactgagtggctcaaaataacaggaatttattctccaacagttgtggagactagaaatctgcactcaaggggtcagcagtgttgatgccttctagaggcagtgagtgggaacccgtagcctgcctctctcctagcttctggtgtttgccagcaatccttggtgttccttggcttttggctgcatacctccaatctctgcctctgtcttcacatggcctgtcccctcctctctgtgtctgtatccccttcccttctttcataagaagagacttgtcattagatttagggactaataaattcaagatgaccttgtccccaaattcataatttaatttcatccataaagattcttattccattaaggtcatattctgaggttctccatgaaaatatctcttggaggaccactcttcaatccactatactttgtagcagcttttgcatgtaaaatttcttccctgaatatttttcacctggcaggactggcattgttcctttactttatcccaggttcttctcaaggaatagttcctcagagaggcttttcctgagtgccctaaaatagctttcccttctccctatcactcttgattctcttattcagcttttatttttattttttttgtgacactttgatatcacctgccgtatcattgggtattatttattttttgtttattgattcttctcctgactataagctccatgaggtcaggaactttgtcttcatctcattattacctaatgaggaatcagcaaaccatgtcccactggccaaacctgacctgccgcttgtttctatgaagtttgattggagtacagccaagcccatatgtttacatatcatctatggctgcttccatgctataacagcaaagttgaatcgtcatgacagagaccatatagcccacaaagcctaaagtacgtgctagctggcactttacagaaaactacatgttgatggcatatgtgtctgggttatgttatatacttgttgaatatttattgtaaagagttatttctaagctgagaaatttaatttggttttaggattgacactgaagagaaagatatctgggttcttttttatctgtttctaatttagagcaattcataaatgctaatttcagtggttaaaagaggaagaggaaattctgttaagacaagattagagaatgcactttttagatcacaaattgctttaaagggtatgccatcttgtttaattttcataatgatccaattcagtcaatattatgctctctgtttcacaggaagataaaatgaggtcacccaactagtaaggggcaaagccaggactccactgggctctgacttcaggtttcagggtcttctctttgcttctgttccacagcaaatatcatcttccaaagagcgtaaacctagatacctcactggggccatttcatacatccaacattttctatgaataagtgtatatcatgaagtatatctcaggcttctcaaattataagcattatcttacattttagcataagatgtaaagatgaaagagtgacagctatttcagagcataaaaaatgccatcatttttgtatccccacaatctctagaagagtgcaacataatacccaagggagataaccaatacttagtaaatgtaattgtattctaatacccaatacaatataaaaagaagtgctatctaaaggcctgagaaactttaaatattttcttgaaatatcaaatggccgtctaaacaataaaatgataggtacatgggttttcttaaaaaatttagattctttgtatcatttactgctttttcagattcttcaagtatttgctttactaaagaaatgtgaagtaaaaaggcagtgaacataggtattttaaaaagcaactagtgaacctgaaaaaagtctcctagaacatgggaaagaaagacaaagcaggaaaactgtgagaaaaagataaaaaatactgctgacgaggttacggggaaaagggaatgcttatacatagcgagtggaatgtaaattagttcagccactgtggaaagcagtttggcgatttctcaaagaacttagaactaccatttgactcagcaatcccattgttgagtatatacccaaaggaatatgaatcattcttccataaagacacttgcacatgtgtttcatcacagcactgttaatgatagacaagacatggaatcaacgtaaatgcccatcagtggtagaatggataaagaaaatgtggtacatacacatcaaagaatactacacagctataaaaaagcatgagatcacgtcgtttgcagcaacatggatggagctggaggctattatcctaagcaaactaacatagaaatggaaaaccaaataccacatattctcacttataagtgggagataaacattgagaacatatggacacaaagaagagaacaataggcatgagggcctacttgagggtgggggatgggaggaggatgaagattgaaaaactacctattgggtactatggttattacctgggagatgaaataacctgtacaccagagccctgtaacctgcaatttacctgtataacaaaccctgaacctaaaataactgttaaaaataaataaattaataaataaataaaagatctggaggacagagcaagggattcaatgtctatatggtaagagttttagggaatgacaggattagtgaatgaagaagagacatacagatatctactactttctaaagtaaatagaataactataaaccaatagatctaataggttccccagaaaggaaagttaatcaaacagcaaacaacaaatatagttttgaccatgatacattaggaattctgctggtatatgtaatattatttaaggagtaaaaaagtgttcataataatgattaagactgtgaatagaaaagtggaaatttcaccagtcacattattctaaaagatggcatggatacatctacctgagactcagtcttttcttgcttttttatttattcatctacaacatgtggttgctgggcagtcagtgctagatgctgtttttacacagcagaatatggcatgttccttgtcctcagggagtacatagtcagatgagagacaatttcaatagatgtggtcctaagaaaggtcaagaaaggtttcttagtggaagagacttttgagccactcaggaaggaagggacattgtgggcagaaaaaccagtgcatgccaaagcacagaggcaaaagaatcctactttaattctcagagtcctgggcttttctccacttcttcacccccgtactttcaattttgcagcactgggactttcagaccaactatttcttaggaaaattgacatctcccttcattttttcaatgatattttccaaatgaagaagtgtacaaatcaaggcaaaagattaaaaaggataaagaaaaggacaagtgtcttaaagacaaagcaacttgcacctctgagagtgagctatcctcagaagtaagatatttaatatgaaatattttgcctgtctaattcattcagaaagccccaaggcagaaacctgtttactctatggcttatgcaatgctgaattggctgtcaacattcgagtcgtaaataataataataatggcacacaaaagccaggaaatgcaaaagcaaaggctttcattgtaatgttaactcatccaaattgtacatgtataatctctctcaatatctggataaactttccagggctgttttgttatatgaaaaatgtgtaatatagtcaagttacgattataatgagaatcttaggttttcacaatttggtcgttttctaagccttgtggtttaaagccttcacattatattcataggaagtttcatgttaaggaatagatgcagactatcttttgtatttgtagataacacttttctccctgtatagaaacaatagcacatgcaccgtggaacctagttttttttcagtagaggtcatagatttcctcagtgactatctcatcagatccagcttaggaccagcagctcactttctcattatcgggctaccagaaaggaagcattgtgttgcctgagacagaaagctgatggttcatgtccataaacccatatgtgggatggaagtcccagcctctaacttgttactggccacaggctctatttcattagggtagaaaaccacccagtatatcttcaaattcacttaactaaattacttttaattcaatttaataaatatttattgacctcctcggatatttctgtgtttaaaacatatggtaggcacagtgcaaactacacagattgaaatacagttactactccacaaacccacagaattataatctgtaggaatagtggtcaattatacaggaatttagcaagataatatacaactaaagaagtataaagtactttgagagtttgtagggagaaattacaggaaaagatctgaagcaaattcttagaaaagaagccactaaagataacattttaaagatggacaggatttttttaatcaaaatttattcagttaataacatattaatcttaagtgtagccctagttacacaaaaatatactttgagtttctaatatctccaatttcaagattactcttgtaaaactcttactacattcacgttatggagaagttgttaaacagcaacaattgaaatatcatcttgaaactagtaaaggaaggaaatggaacatttattcatgaaattcacttcgaaggtacatttataaaacagtctcctaagaaatacaattctatccagtttccactgagcaattgtatactcactcaactacagcactgaaactaaatgagaggaaattcgaaattactttggaaaagaagaaaaaaagtttctatgcttctggatcaataggagagactcgttaaatagttctaacaagaacatttgccaatataaaaacaaaataagatgtaaccactaataaaattcacatttatataacgtatatctaaaaacattctccttaaaatgataattttgggggtgacacaattcgcacccatataagacagagaatttaaatgataaatgttgtgtgtgtcctgactgctccatcgatcagctcttcctccatctgtctccttctccatggacttcctattccctgagacccagcaatattgaaattaggccaatagtaaacctacaatggcctctaagtgttcaagtgaagggaagagtcactttttcttcactttaaatcaatcacaaactagaaatgattaagcttagtaagaaaggtatgtcaaagccaagacaggttgaaagctgggcctcttgagccacacagtcagccaagttggtaatgcaaagaaaaagttctagaaggaaattaaaagtggtactccagacaacacacaaataataagaaaaagaaacaactttattgttaatatgtagaaagttttagtggtctggacagaagatcaaaccagccacaacatttccttatgctaaagcctaatccagagcgaggtcctaactctacaattctatgaaggctgagagaggtaaggaaactgttaaagctagcagaaatctgttcatgctgttaaaagaaagaagccatcctcgtatcatcaaagtgcaaggtgaagcaacaagggctgatacagaagctgcaagttttccagaagatctagctaaaatcattggtgaaggtggctacactaaacaacacatttgcattgtagatgaaatggccttctgttggaagaaaatgctatctaggagtttgataattagagaggagaagtcaaggcctgatttcaaagcctcaaagaacaggctgacacttgttaggggttaatatagctggtgactttttaagttgaagccaaagttcacttcccattccaaaaactctggggctttaagcatgatgctaaatcctctctgcctatgctcaataaatggaacaacaaaacctggatgacaacatatctgtttacagcatggtttactgacaattttaagtacactgttgaggctcactgctcagaaaaagattcctttcaaaatattactgctcactgacaatgcacttggtctctgatggagatgtgcagggagatgaatgttgttttcatgcctgcaaacacaacatcattcaattttcagcccatggattaaggagtaattttgacttccaagttttattatataaaaaaatacattttatatggctacagcccccatagatagtgattcctctgatggatctctgcaaagtaaattgaaaaccttctggaaaagattcaccattcttgatgccattaggaatattcatgattcaccggaggaggtcaaaatatcaacattaacaggaatttgaaataagttgaggggttcaagacatcagtggaggaagtgactgcaaatgtggtggacatagcaagagaacaagaattagaattggaggctaaagatgtgactgaattgctgcaatgacacgatttgtctttaatagatgaggagttgcttcttatggatgagcaaatagtttcttgaggtgatggatgtgctgtgaacattgttgaaatgacaacaaagaatttagaatattgcataaacttagttgataatgcagcatcagggtttgaaaagattaattccaattttgaaagtcgttctactgttggataaaatgctatcaacagcattgcatgctacagagatgcacattgaaactgtgaaatttcattgcacattgagattcatgccacattgaaagtagagtcaatatggcgaacttcattgttgtcttattttaagaaattgctgtagctactccaaccttcatagccaccaccctgatcagtcagtagccatcaacaatgagggcaagaccctccaccagcaaaaactcattgaaggctcagatgatcattagcattttttcataataaagtattttaaattaaggcttgtacattttttattagacataatgctattgcacacttcatagtatagtgtaaacataactcttttgtacactggaaaaacaagaagtttgtgactcactttaatgtatttttactttatcgtggtgatctgcaacttaacctgcaatgtctccaaggtatccctgtaaaattaaatggacacaattaacctatgacattcacatttaaatactctaattataaaacattatactgagaattatagttataccaagcttcagttggatccattgtataatcacttaacagcaatataactaatagaggaaacatcaaaattattttcatcttgtgggtgaaaagcctcttgctgtggttctagaccttcagaaggatgcttgttaaaggagaatgaacttggaaggtggcttacttttttcaagtgggaaggttgaaactaaagaaggttgcaagtgtctgccagcgcatggagccccgggaagtgctttggagtgcccttgcagaggatgaaggtggtccgatgaaggaatcctgcctgagagtccttaccccatcagggtggcatctggttcacgtgggatgctggacctgacttcctgtgccatcacaaccagatgctcctttttccttgaggacctggccacccagaggattccctggtggttctcacaagccctaccaaatacctcatttccaacatcagagacataagtatgccttttggaatgtttaaattcttccatgataaattttgtctgatttaatctctctttttaggttattgagatttctctcagctgtcagagctctcaaagtatcaccatgagcttttctttcatgggaaatagctggctttgataacagtaatttactagagtttttgtagacagattttggcttgtattttatacatgtccagtctttacatggatagctgatcttgtcatcagttttggatagattcgcctctgtttttatgagttaaacttgttatttattggatatttaatgaaaattcattctttaatatagttcagaaaggagctaaagtttctcctggagtttttgcatcttcctttctaatgcttttccctaattacagggatactttctcagctttaagatttctaatttgatcattaagtgcatccattattttgtcttattcagttaatttagtgtacattcggttgcttttttatttttcaaatacatttttttttcttgagatggagtcatgctccattgcccaagtggcatgatctcagctcactgcaacctccgcctcccaggttcaagcgattctcctgcctcagccttccaagtagctgggattacaggcatcggccaccacacccagctaatttttgtatttttattagagacagagtttcaccatgttggccaggctggtcttgaactcctgacctcagatgatctacctgcctcagcctcccaaagtgttgggactacaggctgagccactgcgccttacctcaaatacatttttgactcagccatatcaattgttttcttcagaactccttttgatttctgttctaagaggtctgcattctctgatgcatttgttatatccaattccacatgtcctcaccattcgtattgtcttcttcaagaatagcaacccagtctcatctttagcaagagatcatctagaaacctcatttgacgtagtcatttaaacttgtctcatagatactttaggatactctgccattttactctgtttaatgtgtttgtttctttccattcctcatcgttttatgaaagccactttaacttccttgaggagtagaattttcattcacagcatcttttagtgctgtctgaagttgttcttcatttctctgatatatttgaaggctgttttagttgcagctacttaaaattggatgtgtgttgatgcatcttctaaaaactgaatctttcttgtcatgtcaggggtcagctcaacttattctaaatgtttagatttcttttctcaaaggcctgctctaaaaatctctattttaaacccaagtagagacctggagacttacagtcttttattaatgatctcagttttgttttgtctttggttttgttttgttttcttttctttctgataatttgttgtagagtctggcttccattaaagttgactaaaggcctcaaatttctttttcaaagaggttaagcctctcaagaatttgatgtcttctccttgaaaggcagaaattccagcatccagttcttcatcctgcttgcttaaagtaaacttccaatgattaaacatcctaccatgactatcagtgccaccactcccatagcaatccatgggctctgggtctggtctcagggctctggcagcactactgcctcctggcattgatctccagggccagcacagtgcaaaggatcatgaccacctgtagcttctccatggccctgaccctgcttttcaggaactcagtggccacaacagattgtagagggcactggggagcatgctacccatggccaaaccagtatagggcaaccagcacaggcctcagtggggctggggagggaggacagtttctcccaacattctccacatcacgaaatacctaggtaatgataatatcgcatgacactgggaaatatgaactgaggctactggaggatatggatgatggctgggggctccagctaccccaggccctcaggcaactaagagcagcaatgtcacactataacccatttgggttactggttggacaacactgtggtggaggatttccaggcccctgatcctggtcagtgctcttcattttcttgagtaaatatttcattctgcagtcctggagatgtcatcctacttatggaggtcacagaaaactgtgctctcggttcttccttgttctgtgtctggcctgccttgaatagcaaggggagtgggacaggagggctaatggaaggtttggcttatttcactcattttacatttaaaaacgaaagaggaagtaagtgagattttcataatccatacatttcaagagtgtgcaattcaactatgagcaaggaaagcatgattttcagactctttttgaatatggtgaaatgtttgatgacatagaagtcttcagaaaactgatgatcagaatgatcatctttgatgcagtggcaggagtgctgggccacctgagctcctccctaccatggaggctgtccctgggcacattatactaaccaacatttatgggacatttctgcactccaggtgggaaccaattgctttaccggggttagctcataacaacattatgagataggtgcttatatttttagttcttgtaggtggattgacaaaggcttttagaggttctataacctgtctacggtttgcacaactagtagacacttgattataacccatttttttaaataatacaagacatggaagactgaaagtgaggaagtattccaagtaacaagtagggtgctttggttgaatatggaatatatgttggatgtcatcagagaatagtgggaaggtaatttggaatcattatttgtggtagatcttgggtagcagtgttctttaaaaatctacttaattcttcaggctggagttttgcacactgcttcgctaagctctgatgtttctgaatgtgtgccatgctgggtgttggggtagagtattagacagtcatttggtctataggctcaccactcccaccctacttaaagcaaagcatttctactttcatctttattataatttagtataacactcatttccaagaaagggttccattgcttaagtataaaagtttgactgctgtctggaacaatgaaaagtcactggagctatttgagaggggagatacatgatgccagatacgctgcagtaaggtgcagatatttatgtgagatagattggtgtggaaacaggaaaggtaggacaatcaaaaaggatggtatttacactgaaaaaataatagctttcatatttctgtatttttattgttaattttataaacaaagaccttaaacattttaaagtattacttccaaaaaccaactgcagtttgtctgtttgttagtgtaacatcattgcctccttctgagcctctttccataaataaatggtcctcctccttcttgcttcaaagggagccctgccttaaatgaaattctctttgaaagcagatgtcaggccattttagcttttcaatatgctccagttttctgctttagattaaagtaaaacagggaattcattctcactgcaggaattatgtgattcacctgggctttcaaagctgtaagatcccaggagatcagaatgaggcttaccggcctgtctttgtccagcggataccctgtgtcagctcagctcctggctcttttactctgcagcgccctcccaggtgaggtccgcactggtactctatgcagggccagcccagggattacgtaaaggtaaagtgtcagcgtctgaagaaggaagagtttcctacattttgtgcaaggggtgaatttgagttcaagccagcatgcatttctgtgcttgagaataaagtgccataaacacatccagagataacatccacaaacacctgtcacttctcccccaatagttccagcagttttcatcatctctggttcgattaatggcctgctggcgagggtcagcataaaatgccacctctaccaaataaaacccttttatgttacagagactgcttctgtagaatctgttatttcaaaggaaagacttccctttctgatttgaaagatagaaagcatctctttcattataacattaacacacataacaaatctttattaagtacttgttacatttcagacagtagtctagatactagggatgtagcagtaagcaaaacaaaaatccctacccacccagtactgctttccagtgaagagaaatagacaaagtaaataagtaaaatcacaatatgttagaaaacgataactgcaaatgcatgagactagtttggaatcattagggattgtaagtttaagtaaggttatcagggaaggctgtggaagcaaaccatgtcgagataggctaaggaaacagcaaagacaaaagcccgtggcaggagaatgcctgcagtataatatagacagaaaaaagagccagagagactgcagtgctgagagccaaggaaaagggcaaaaaaggccaaggggaaaggaagtggggaagaacatctaggcccaggtaggcaccagcatttactccatatcagctggaaagccaccggagggtattgactggggctgtgtgcttgccataatctcacttgcttttgcatatgaccgcttgaggtgctgcactaataggatgaagaggagaagaaggaataagtagacatgtggcatttgtgataacccaaacaagaggaccacggtctttgctggagggatggtgagaggtcaatggatactggtatagggcttgactggaaaaaacaaggaggtctccaaggcttttagctgcaaccgctgggagggtggagttgtcatcacctgaagtgggaaactgctggggaagtcggatggggaggaaagaacagagcaggcctgtcacagacctgctgcttgtccctcctatccccatttaaaaagtgaaagaaaatggtttagaacatccatatatatatatatgaaattcccaaatatttttaatcaacattataaataacataatagaggtgtatcatcagggtatttggggaaaaatctcttattcaccattataccctcagaacctaaggtgggcctggcacagagcaagtacttcatgggtatgcagttactgagttcaatcggatttcccagtgtggagactaacatgtaagtttgttcttaaatcgttcctgtttttatggatatttacaaattatagggttgtgttactcccagccaaaaacttagttctattcagatgattatgttctattcaactgaaaagcaaccatagccccagccaaaacagactagctgcctcccatcaagctaatcactaaccacagtcaaattttccccacctaaccagctgacatgctgtgaaaataaactggttatcacagcaaatgaggcgggtggagttgtacacacttggagaggagggaactggctccccatgtcccctgggacagggtttagcgtcccttcttttcttaacttgccacagctccactactatgaccaactatgaccatgtgtctatttttttttaagtaaaatcggaaagatgtgttccttttcaagactacttgacactatgaacttttcaaattgctttatgggagcctgcaactttcttttctttacaaacaaaaataataacaatgcaattaatacaatgagattctttatgcagatgcttctggtaggcgttattttctcttcagaagtacacacctgataccatctgcctacatgagcaagctacattttcgatccctttttcatagttctttctgctgcttaaaagagggaaaaaaggcccttccactttattttatatatctcccaccttgagaaagtgtgattttgcccattctctaaaaactttaggagaataataatggtcaatatctgtaacactttgaaaagcacttttgagtacattatcaagtgtaattttcataccactatcttgattttgtaaagaagaatatcaaaagctttgattgaattctaaatgaaaggtttaggaagcagtattctgtggtgctgttttattcagtaagttgtctgaaatgtggacaattttctattttcttcagtgaccttcaaataaaaaataaaaagtttttttttttttttttgagacagagtcttgctcttgtcgcccaggctggagtgcagtggcgcaatctcgggtcactgcaacctctgcctcccgggttcaggctattctcctgcctcagcctcctgaaaaaatagaaagattttatacttcagttaataattaatttttttttcctgaacatgaaaattataactactagaaatttcttcaattcttatctgtttttgttgcttttatttttggttttcctttctacttataacactgaagtagaataaaaaagaacacaggttttggagcaggatgttcagattctgttttttccacataagtgtgtgtgtgtgtgtgtgtgtgagagagagagagtgacagagagggatggagagagcagagagagatagagagaaagagagaaactgagatacttcgggcaagttatgtaaattctctatgtcttggtttgatcctttaaaaagcagggataatgataagcacctggcagagtctttgtgaggattacctgggttagctcatggaaagcagataatactgggcctgaagcataataagctgcctctttattctcttcctgtcctctgaatgatggaggtcctcagggattggtgctgattcctctctcttgtatgtgcacacattctctctaggtggccacacccattactgtgctttaagtattattcatctgtccacctgctttcacctcctaaatgtatgtgtttgatcctctcagcttagatgtttcacaggatctcaaacttaacatgtctaaatttgaattctttttttttatcccacaagcattttcttcctgtagtcttcttcgttttggtaaataacaccaccatctgctcagttagttaagacagaaacctaggaatcatctgtgattcatcttttccctccctcctgaaatacagcccactaccaaattctgcttcctccatatcagtatatatctcagatctgccatgtctctttatcttcactaacctccctcaccccagccccatttaaatcaccatcatctcctgcgtggctccctgaactccatgcttccacacttacccagttctaatgccttccccacacagaaattatggtgatctttggaagatgtaaatcagatgtcaccctcttacttaaaacccatttaacggagtcttgttgcacttaaaacgtaaactccataacctttagaaccttcacgtcagagattcctcatgatcatgaattccttactcactagcccctgctctcactgactgtgttgggggtccccaagaccactctcaggcttagtgattcactagaaggactcaaataacttagaaaactagttgtactcatggttatggtttattgtgacaaaaggatttgggctgaaatcaacaaaagaaaaagacacatagtttggaatgcaggagaaaccagccatgaacttccagttgccctcttccagcaatcatacacatagcacttaattctcccagcatcagtgtatgtgacaacacatatggaatactgacaaccagggaagctgccctgagccttgatgtccaaggtttttattggggatcagccacacaggcatgaagcacccatgtagctgaccttaattcctcagtttccagcttctccagaggccacattgacaccacaagtccccaccataaatcacattattaacataaactctctagtgtggattatggcccctgtagacaaagacaccactatcaggcagggtattccaagtatttagaggtagtttcttaggagctggtcaaaggtcagactgtcctttggaatatacagagtttggacaacccaggcctgctaagttaatcctttactgcacactcaccagccggcagttcctagagcagaccaaagccttttcctccttgggccagtgtcctgtgtgcctcctcctcgttcttcagatcttactttaaatatcacctctccaaagaggccatttctgaccacctgacataagtaggtccattccctttattattttccatcacagaatcctgttggaatgctttgaaagatttgagtcatgattatgtttgtgtgttcttatttacttgtttattatttgtctccccaactagatctgaagatccatgaggacagggttcatgttattcctgtgcctcacacattgtgtgagacatgattgttattcaaaagacatttgtcgaatgatggaagctgttatttttatattatatatttgtgtgtgtgtgtgcatgcatgtgtgtgtgtgtcttttctccttggattttattagtaattttagtgaatgttttataaatctttctaatttggcattcaaaggtaaggattttctgtctgctatatctgtaacctcttgggttaattagactgacctggctggtcaggaaatttctagtttccatctctccaggtgtttctttatgaaactgcccactttctgaaggaatgagagagaccaggcagaaagctacctgttcttccagctcctttccagaattactggcatagctcaagatccattatgatcctttgatcatccctccatttgctttgtgaattgcatgtgtatggcatttgcatttcaactgaaccagtgctattcagtgagtttcctagaattaatgtatcatagctcagtaagactttaaagtaagtatgacattttgttttgaatttgactaatatatttaactaatgatgactataaaaataactgaataaaaatgtatcttttttagttcaaaaaaactgacagaaaagagataaatacattcaaaagattctgattcatagtgatgtgtataattttggaaatgtcactgtaataaacagaaacttctctcagttttgaaatttaaaaaaaaccctctaattgcccatggcaattttcagaatattcttttattgtaatgaaatcacgtgacatgtatttcattcagattttttacaagaatttgagagactgtagtacttttaagtaaagcagagttgtaaaaaccttctgtgagtgcacattttctatttcagtacaaaaccctgggcatgtcattcaaggatctagagaattaagaaccagcttttatgtacagcctcatcttccagtcacctaggactaccccatgccagcctcgttgcctactttttccagccctcatatattttacggtctagctggaacccccagggttgagaatattgacttgaacatatgaacaacatgaatgtgcctaagagctaattagcatcatacagagaacacctgccaggcatgaggagagctgagctctggtctcagtccttcctcttattagctggatcgcttgactacagatcactgagcctcagttttttcattagtagcataaggacattgaacaagactatctccaaattgcttccagctctaaaagcctgggtactatcttccttgtgtcgataatctggaggagttcattaattatcaagagattcaattgtgctcaaccacccacgtgaacaattcaacctcatcaaaggtgaatgaccagcaagttgcttctaatgagtggtcactgcttttagagataaatcaatttgaacttctcattactttagtggtgcctccaaggctaattactctctttgctagaacctggacttggaatagattaattctgatagaaagttttggggtaattttgagaactatcatttattgtagaatatctgaactttgcatgcactttgtctggcttcctatcaacaagatttcatgggaacagtctgggctgttcatctcttacccacagctctctctttttccgaacctctccactctcactgccatattcctaattcagatcctcattgtctcccaccttgacagtttcaatgcctatatgattgcccatttcctctccctactcaaggcagttctgtgcagtgtgatcagattaatattccagaagtaagagtgtctgtagaaataagtacaaattatttggcttgccattcaaggacataaacaatataaatccaacctggctttaaggtatatctcccaggaattaatcatttgcctttgctccaggaaaattggatcaccccttggccctaaccacgtccagcctcagctacctctgtaccttcatcaccctcattagtttttaaagttctgcaagtttttaaatattacctctcccaaaacagctgagatgtgttacctctcacatgaagacttaattttccaactccaaatggatatgacctctctctcctttaaattcatctgttattatggatgcctctcccatagtgctcatattctgccttctattattttgtacctacataataaagttacggaatttcagagctgcaagaaaccttacagagtattcttatttgacagatgttttatgcatcctacagaattctaaacagggatggaggttgagtttttatctagcctgttgccttcactacagatactatcactcaccttcccaattttgtaccataatgtcttgcacaaaggcaatgcacattccatatttgttggataaattggatgcaaatacctcaacatggaaaaatgattgtagatgtacaaatactcttcttattaataatattgttgcaagttactaatactgttgtaagttaataatgttgagcattattacagcctgcaaaaccttgattctttgattggttcattcatccagcatttattgaacaactactctgtattaggcactgtgttgggttattgccttggagtacttacagattagcaacctgcttattatgagacttgtgattgaaccaaagagaaaaagagccttaccactgaaattatgataagaaaaattccatcacagccttaatatatgaaggagaatacagcagactgccagccataatgcctccatcttccatcctttcctgtatctagtttctctttcaatgtgactctgtagtttcttacttcaaaaggtgtagtgtatctgatttccccttgattctgagcttagccacatggattgccttggtcaatataatcttagcagttgtgctacaggcagaggcttgaaaatgcacttgcccgcctctgtttcctctcttacttcattgccatgatcacaagaacatactgacaatagcctgctggagaataagatagtgctgagttccccaaatcttttgagttgtaactgtcctgggttgtaacttttgagttgtaacatgtcctagacatgtgagttcagctaagtccaggacagatcagtcttggcagactcatgggctaaataaatggatattgcatcccactgtggttgaatcgttgtttgttatgcagcattttgtggcaatagataactgatacagtgagaggacaatcctcaatccttccctagcaaggaagtgacaattcattcaaatgtagtggtttcttgtttgtttaaatatctaaaggtggctagatccaatattcattgaatacacaaagatattctgaaaagtatattttgttacaaaattattgcattaaattaggttaaatgaattagaacaatacaaagggcagttttggatcctatagaatttctctatttagaaacgtaaaagagataatacttaactaactcatttccctcaggttaattaatgtagacatttccactacagttgcagcaaattaacatgggctgcttctccacaccagcaattatcaacatgctaacacatcctgaattatggatggtttcataaaatttgacaatttgacattactctttgagaaataattctagtggcaccataagcctttgggcaattgtgataaattaagatgtatttttatcataattggtcctattatcattcactgatatttaatataatctatagtgaaaggtgtttttgatgtcttgaatttaacaaaagagctcttttttttttaatataacagcaactgcttctaaggtgtccaaagtcttctgtttattgttaaggtttttcctcaaatgtactggcactttggaagcataaatctcaaactcaagtgcaatcttcctgactcctagataagtgaggatctcatgaccattaaaaacaattcacagtcttataacttatatcatgcatgctgttattgatacattgcaacttaaaaataattagtagtagtataaaaagatccagaaaataacaagcattagtgaaggtgtggagaaattagaactcttgtgccttgctggtgagaaagtaaaatgctgcagctgctgtggaaaattatatgatggtttcttaaagagttaaacataacattaccatatgatccagcaatctcacctctgggtatatacccaaaagaattgaaagcagggactcaaacaaatatctgtacaccaatattcataacaatgttattcacaataggtgaatccacattattcacaaaaggtggaaaaagcccagatttccactagcaaatgaatagatgagtgaagtgtggtgatatggtttggctatgtccccacccaaatctcatcttaaattgtagttcctataatccccgcatgtcatgggagggaccgggtggagataattgaatcatgggagcagtttcccccgtcctgttcttgtgatagtgagttagttctcatgaaatctgatggttttttaaggggcttccccctttgatgagcacttgttcttctccttcctgccaccatgtgaagaaaaacatgtttgttttcccttctgccatgactgtaagtttcctgaggcctccccagccatgaggaactgtgagtcaattaaacctctttcctttataaattacccagtcttaggtatgtctttattagcagtgtaagaacagactaatacatgtgttatagactacaatggaatattattcagactttaaaagtcatgacattctgttatgtgctacaacatgagtgaaccttgaaagcattatgtaaggtaaaatagcagcacaaaaggacaaatgtttgtcttgttccacttatatgatgtacatagaatagacaaattcatttagacagaaagtagaatagtagttgccagggtctgggggacatggaaatggggagttattttaaggggtacagagtttcagtttgagaagatgaagaagttctggagatggatggtgatcttgatttcacaacaatgtgaatgtgcttaatgccactgaactgtacacctaaaaattatttaaatggtgatttttatgttaggtatattttaccgtaatttaaaaaatgaaagagaaaaaactatgaattagtagtttcattggcatcacataccttccatggtcattgtggggacattttccctctgcatccagatagcccttctctattggaagagccagcatgatgtggtgtgatagtgataagggcataggctataaagtcagatgcataactctgaaccctaagcgtaactctgatgactgtggggcaagttaattaacctattattacccttaattgtctgttctgtaaatggtgatgataatatctacctaaaaaggtgtttttaaagtattaaacatcttggagttcaaagtgttagttatttttcactaagccttctgaattttcttcattttggtttgctaaacaccatttatgttaacaacatttaaagttgtaagtttatttaaagatcaaggacatatcaaggtccacttaggtgttggaagagtatactggcatttcccatttgcagctttaggctcttgaagaagcagtgtacaataaatagacttttataaacatacttttattcttcagcaactttagcttatcaaagttcaatataaataaaaagatgccttgtaaatatcatcgtgataaagattgtaattctcttttaataataaggatgatgtgaagttatatgcttaaatcactagcaatagatacatgccatttgctttgtagccctagtatttggcatattttaagtatttaatatatgttttgcatggaaggaagaaacactaacttctgactgctagagaagggtagatagaaaactgcagggtatagcaatgaaattgtgctggaagcataaagccttcaaaggaagttcagtagttgaaagaattgtcagaaaagtttatttcttgctattgcagagtgttggatatagtgataccaactatatagtgataaaaaaataaagatttttttctcgtgtaaaaataaaaaaaggtattatgtaggtatgagaaataaaacatgttcctataacaacccaaaagtaaatgttatggtttcactttgctggaggggttgacttctatttgctcctttagtcataccttttcttgcatacaactaaatgtagaaatgactaatggggctacaacacatattgcaagagaacactatgaaggaaaaaatggattgttttcatcacaaagcaaggtagtatatctaggtatattggaaaaaaaacttaataaaaagtgtttaagtatctttgccaagaatttttttaatcaaagcttttatgtttatgagtttcctgatggaagcaatgagtagcagtctttgcttaatttgtttcaaagcaatattgaagaaaattgaacaaaatatgcaataagaaaaattctgtgctggtccccagggtatggactatctgacaatataatagatgttttccatttccctgtgtctagaagtctaggtggttgcaggccatatattacccttggttcactcccaccattttccctgacattaatgggaggcttgttgcagaaataaggcaatctgcagtcggattttttttttttgagatgagtctcactctgtcacccaggctggagtgcaatggtgccatctcagctcactgcaacctccgcttcctgggttcagcgtgatctcggctcactgcaacctccacctcctggtttcaagcgattcttctgcctcagcctcctgagtagctgggattacaggcacgaacctccacactcggctgatttttgtatttttagtagagacgggatttcatcatgttggtcaggctggtctcgagctcctgacctcgtgatcctcccgcctcggcctcccaaagtgctgggattacaggcatgagtcaccgcgcctggcctgcagtctgatttttgtttatggaatgagatcattctatcagatgtaagagctccattgtcctttgttacacattcaagacagacaaaaaatgctaatagcaattatgtgagtgcattggagaagaattaagactcagaaaagtgtagtgttgaaaacattcacttaaagacagggatattttcagtaaagcagcaataaacattgcaaactggttgagttgtttttgttcatattatatatctcctctacctcccaaacctacttagttttcacatatgcatggaacttcaaatttagaggtgcaaattttgaggaaatgacaatatttcttttgtcaaggtctcctttgcaaaaccaagtatggaattgctaaacatgaagaacttgaaaacagttcatttaaatcagaaagtaattgggtccaataatcaatgtgcattcacctaaattactatggataatgaaattgttgtacctctgttctgggttgttaaaatccacgtgcagtatttcttctctcccaaaagcatcgtggaaagactccaccatattcctccagacttggtgagagttcctgcctctgatctgccctctctggttcctataatcttgctcttattatcttctccttacacatccactaatccaccattctaggtggtattaagaactttttcacatactagatcataactccttaattcttagattgtatttccagttagaacactgctgatttggggggatatatagaatttacatttaaatattagtggattagaacaagaatctctgaagaaaaagtattaactattagcggaattcacttataagttgactagccagtattcagcagaggtttaggttagttgggcaagcaggggttaactttccaatgctgttgccttgtatttcgttgaggaaatttaagcaatcacaggagaacttccacagatcccactaccaccgctaaccctcaatgcatctgaatccatacacattctgttccttccctgcagcccttccactttatattggatcctattaagggctgaattttgtctgttccccccacccctgccaaattcatctgttgaactcttaacccctcggtacctcacacaatgacattatttgaaaatatggtgttgcagatgtaattatttaaggtaaaattaggtcatgctggagtagggtgggcccctaaaccaatatgacttgcatgcctataaaaaggagaaatttggacacagacgtacacatggagaactcctgtgatgcttggagtcatgctgccacaagccaggcaactacaggaagctaggagacaggcctggaacagatctctccagagtgccttcagagcagtcatagtcctgctgacaccttgatctcagacttctaggctccagaactgtgagacaataaatgtgtattgtttcagtcacttggattgtggtgctttgttaaagcagccctgggaatctactacaggccacaacctctcagcaccaagccattgtcttctcgatcctcaggacaatttcccctctgcatgggaattcccatcagcacataggcatgctgtaagccacctccagctatggccctatttctttgctccctcagatagcaaaattattgaagaaattgcttacactccttctctctactttctttcctcaattttctttggaactgattccaatcaggcttttttcaaaaccgctcttaacctccacgctgccaaatctagggcgcatatctcagtatttattttatgccatctgtcagcagcatttgtttggctaccaggatgctttctctttgtgcttctcataactcattggccactttttcttagtctcctttgatggttccttccattttgctgcccttaaacatttgtatttcaattatatctcaatgaagcttttatagaaataaacaaatagtggagtgcttcaggtctcggctcctggacctaataagatgctctgaatctacattcattcttaaattaaaacatccagtcctcctggctttagataaaataccactataccaaggcatccaaatttgtgtctagcttggacctcactcttcaattcaagaattgtctatctgttactagacatctatgtgtgtcaagcaactcaaattaaagctgcctcccctaaactggttcttcctcagtttaaacaatgaccactctactcttcctgttgtgtgaactaaaatttttggacacatccttagccctcctttttgtaataccccacatcgattatatgagaaaataacatataacatttaagcacttttcaccacctctgctgcctgtctatgccaccattgtctcttaactcgtttattgcaagatcatcctaactgaaaccatattgcattaataatttccctgtagcttacatagctgcctgggagatccttttaaaacatagtcacattaccacctgcagtggcttccatgttacttccatccaaagtctttatcaggtcctcatagagtcctgcagggtccatgtgactgtttcttcactcattctgttgcagccaatctggcctctttgcttcctccccacccccgacctccgcccaagcattctagaaaagcatgattctagctcagggcctttgcacttttctctgcctctgatgcatttctgccaggtggccatatggctcacttcctcattcccttcaagtctctggctcaaatatcatcttaccagagagcattctttgataaaacccttgcctagttattctctatccttcttgccttattttgttcaaaacaacaacactgaaagatttatgacgtcagggattttgtttgtatcatgggccatttagaacagatcctggcacataagtatgtgttgagtgaattactgaatgatccaggattgggcttgataaggtgagacttccaggaatagcctgaggtttctgtacttcattcaatgctatgttgtgctcatcctgcccaactatgcacctcaatgtaaacctttgtttgcttctctttatcctgcctaggaccttgccatgggtctctgtgcagattcttgtggtgatgccctttgaggaatcttttttctctttatttttttggtgtctagatgagtgcccatcacatggtcaatgaatgatttttttaatgattaagtgtatagttggtttttaggcctttgattttgagtcttgagctataatcctgacccaaattgattctttggctgtgatcttatttcatggcaggtttgctttaaggggatttagattgaatattttccaaaatgtgatagctaaaacatgttttggaagtacgttgtgaaacctcagttaaataacctaaagcagtaaacgcaacatccaacttttaaggaatagtatggacagtgttcttatgttcttattcatacacagactcacataaggcaagtatcaactttgttcctttcatgtttattaacgggacatgctcttcatgtctggcaagagcctttcatcacatgataatgagattccacttggtcttggtccacaacacttagcacattacatcagtatttctcaagcgtttccactgaaatacttcaaatatcagaggagagcaacatgcattcctaagggtctggctatgtaaaccaaagaagttaacagcaaattcaaaagtgttttattattacaatttatggaattttccattctactccaaataagccttggagtttttattatgttttgacataaaatattatgagatatttccagttaaattatctatattttgtcctgaatcctcaaaaggaaactgaagatgaaccatgattgtcttgtggctttgtgtagcccctgagacctggcatcagtctaaatgcctgatctggggctcactgcacaatctctggacagcagcagcactgaccatccttgttagatgtgactctagcaactattgaaccaaactaactgcctatgaagactgctccctgattatatggctgctcttggcagctgataactttctgtctgatccaatcctcatctctaatggaatgatgcatcactgtgtaatgggtcctgttttattcatcctgttctattaagctaagatcgataatgcaactaacatcctgaaggttcacattatacccaagttttactatggtgtcactcaccttggcacaagacttagtgtaataatattgaatacctaataagattgtaattatctgtacttctcaagcactacaacacagtttcaactctaattcttttacaggctttcctgggcctgtgctacagggaatgaaccatttgaggtaccctaaaggaagagcttacaaggaaggcatgggtggaagtgtgaagaaatgaagcagatgggttagggggatggagaacctcagtttgagggagtgtgggaggtgaactcagaaagataggaaaggtcagatatgtacatggggcaatgcacatcttaccttctcacttggccctaaatgctggagtgacacaattgcaattcattaagtaaaagcaacaatgcagccaaggtgaggccattggaagcttttgatccagaatgggacatgatgaaagcagcatcgtatggacgtggattggtgaatcctatatgggctgctgtggcatggaacagctggtaaagcagagctgaggctgtcccatagtccaggtgggaggcagtgaggtattgaagggtaaggagaatgggtttgggagctacctcctgactctgagacctcatctataaagtgaggatgtgacctagttcacaaggtcatactgatgactaatgagataaaatacaataatgtttagcagagtgccatgccaggccctcagaaatgcacgagatagagtagcatagcgaggctctgaacctactgcctgggtttacattctggcttcactactatgggctgctgggttctgctgcacaatccttaacttctctgagctgcaccttcttccctggaagatggggagaattacagagcctgcctcaaaagctggttgtaaagattagatatattaagtgtccgatatgtgctcacaattgtatgccctctaccctcctgtgatagcctcagactgggagccaaagaaataaaggagcaaacatgcaacaattgagaagaacagatgggaatgacaactggttttatattaaagacaatgtgaaaaataagtcaaagacgaccctcaaaatggttacactggcagagaagggaaatcaggatattgaatgagtttggcttgggggacaaggctgtacaatgtgagtgatgttaaacttgaagaaacagtgtaacaaaaaattaaaaattttaagaatagaaaaaagacagctttagaatagaaaaaagacagtaggaatataaaaggcaacaaaaaaagacagctttttttctcttggaagctgataaattaaaaatttttaattttttactttttaaacttttttactaagaactaagacaaacgaacacattaacccaggcctacacagcaccaggatcatcaatgtcactgttttccatcttcacatcttgtccttactggaaggtcttcaggggcaataacatgcatagagctgtcacctcctaagataacaatgccttcttctggaacacctctgaaggacctgcctgagggtgttttacaataaactttttaaataagtagatgtaccctctataaaataagaataaaaagtatagtataacaaatacataaaccggtaacatagtcatttaatataaagtattatgtactatacagaattgtatgtgctctatttttatacaaccagcagcacagtaggattgtttacaccagcatcaccacaagcacgtgaataatgcattatgctaggacattgtaactgctacaatgtcactaggtgatagtaattttttcagctccattatgatcttatgggaccaccatcatctatgtggttcatcaaggactgaagctctgttatgcaccacatgactatgtagtgatttaacatcccctggtccttcaatgagtgttctttagaagactcctaaatctagggattaaaattgtgttttcaagtctttgactttgctcaattaaacgacatttgacttcacagactgtaacaagaagggtttttattttcatgttttctagacatgtatgtttagtgttcctgagatagcatgttactattaacctgtctgattatacgatttgtatgtaaaaactaattcattttagagaataactgaagcttagcttttgaaatacattatactgtgttcaggtcatgataaacgtcctctggagcatggctaccccacctaacatacgtagcatagtctcctgaaaagctcaacatgacttactgggtggctatagaccaaggcaaagaatatcttatacttttctaaattatatatattattgattataccataccttttggaatttaagaaaactgctaactagtattataaaggagttgctaattacaatattaatatcattatgttcacccaggaattttcctaagctctaaagtcaattctagtaaatcccaggaagtaaaaaatcccatatttgattggggctctttgttgctgtattgcctgactctgcctcagagttttgtcaacacagttgtccaggaagtcatggacactaaagttgaatttaaaaaaaaaaaaaaaaaaaggagaggatttcactctgtttcccaggatggaatgcggtggcacaatcatggctcactgcagcctcaatttcctgggctcaaacaatcctcccacctcagccttctgagtagttgagactacaggtgtataccaccatccccagctaacttttatttttttgttgttttgttttgtagagatgggggtctcactacgttgcccaggctaatctcaaactcctgagctcaagcaacccacccaccttggcctcccaaagtgctggaattataggcatgagccaccatgcttagcctaaggttgaattctaattgtcacctaggcaactttgataaaataacatcattgagataagattgcttccaaatactagaaaaagttgttttgtgttcttgtttatcgtgtatctatataatatgttaagtggagagagaattaaaagaatcacaggctctggtttgattaataataggtggatccttctgaacagtgtttatcctggcataatgaaagaactttcttattctttcctatgtaatgtcaggaaatatgacgtaaacagcagggatgtaaaagacacaagtagctatcaccattgaacaatgttggcactgtccctaagccttttccattgcttctgacacttttttttctattccccttcaaaggttttgattattcatgcatgtaagcattaattcatttacttattccataaatgtttattgatttctaggcactgtgccaggccagtatagaaagaaagaagaaaacaataaaatccatttttatttgaagtagggggagagtttgcaagcaacttaaaaaaattaaagaatcgaaagaagaactaagttttaggaatgccacgaattaggctaactcgtaggatctgggtagcaggaatgaatgcacagcttcatcagggcactgctgctgaagtgtatccttctactggaaggagcttctgattggcctggcctaggtcaggaacccatcacttggtcagggagagcaggacaccttgattgaaaggtcctccagtggagtttgaggagctcccaagttctgctagtaaaagaaaagagaacagatactgtacaggcaaaaagagcaggtgcctgctacagaggaggctaagtgggtgctatttgtcttacagtgtgagatacagataattagagacatgggcagggtgctgcaggagtgcagagatggggcacttagggaggaggaaattaactcattaggaggccacggaagatggggttggaaacgttggcaggagctaggtcatgaaggcctttatatggcatatttgtgagtttatactttttcccttgaatgatgggtagagattgaaggatattaatgaaaaaaatcactttagaaaaattagtctgctgatgaggcagtgggcacattagaaggtaagagctggagtgaggtaatcagttagaataaatggtgagaagtggcctaaaaacggcatccttggagttagaaagggatgggttctagagatacttataatctacaggggttggtaactgattgaccatgagacatgaagaagaattaggattctgggtggctttcaagttcctggcttgagccaagcgtgtggtcactaatagaagaaatacaaaataaggtgtaccgtatctgattcattgatctgatgttcccctgggacatctgggtggcactagccaaggctgcagtgttgtagaaggatgtgaaaaccagcgagaggtcagggctgcagatgtggcagctgacagtatatataggtggtagttaaagcccttgaaccaggggcagagtgggtaggagtaaggggtgtagagtcagagtccttgggaatcacagtatttaagacgcaggagcaagaaagcagggtatgaggaaagaaggaaggttagctgcccctgcatcaccccctcctcacccccacctaccctcaaatgataagaaggtttgagaaatctgtagagattcaattatgtccttttctgtaaataaagccctagtatagtatatcctggtaccatggggaactcttgaatatgttagatttaaaaagagtatttgatcagtgaccaacagttaaaacagactatcactaggaggcttagaatttattaagaactggactggcagacctgtattgagagtagaaagtcactgagtagatttctgagatgtgcacctctcccctgagatattcacacagatttattttatggggtccacccaacataatttaagtgtcaattttattgtgcttcagccctgtgaacaaatatagtcatctttattcctttgcactattaatgtttcctctctagataatttatgtcaaaacaaatttaagaggtttccatggagtagaaaaaattataatttcactaaggcaaggaaaaggaagaaactcttctctgaagtacaacaggacttcattgctgttctaaagcacaaatgttggatttaagaatattatatccttcttaaaagtcagaagaaaacttctgacataaagccaactgtggcaggccatatagaaatgaatttgtattcatatagaaatgaatttgtatctgaaaggaatgacttggcattggggaaacatcactcttaaaatcagcaccccatattcttagggtgttttcaacaatttcagggttttttttcttccagttctgaaaaatatatatataaaacataagttcataaggacttgggcagtgttaattaattcattaacaaatattattaagttcgtgcgatatgccatgccttgtcctagaagctagatgtaccatgttgaatcgtaccaacacggtgcctgtactctcggtttgcagtgcaaggaaagacaatgtacagtgttaaaaatgaggagtgatgggtgctctgacactggaagtccagagagccatgggaacgagtaacaagcctacctaactaaatgtaggggtcaaagaaggtaacatagaagaggaatgttgaagctaagacctgaagatgagtggcagagcggttgagtcacggtctgaatgggaaggcaaaggaatgccagtataagaaggtccaggccgggtgcagtggctcacgcctgtaatcccagcactttgggaggccgaggcaggcagatcgcctgaggtcaggagtttgagaccagcctgaccaacatggagaaaccctgtctctacgaaaaatacaaaattagccaggcgtggtggcgcatgcctgtaattccagctactcgggaggctgaggcagaagaaccgcttgaacccgggaggcggaggttgcagtgagccgagatcgcgccattgcactccagcctgggcaacaagagtgaaactctgtctcaaaaaagaaaaaagaaggtccagatgtcagacagcgtggcacctgggcacttgtatgaaaacataagttcaagatgcctgaagggcagcacaagaaaaggagagctctcttaatgccaatcctttcttttttttgagatgtttatctataagattgtttttcccatttgaaacacaaaatatctcagtatattgctttgtcaagactttgacctttttacacagaaagacatactctatccctttgatagagtctgcagtatgagcttgttggagtgtagcctgggcgaccagtgtcctgctattcgtcttataggcctatttgggcttctccaagttaacagaatatgatcatccttttttggatatttttttttgaaacaaggtcttgctctgttgcccaggctggagtgcagtggcacaatcatagcttactggcccctctgactcctgggctcaagtgatcctcctgcctcagcctctcaaagtactgggattacaggcatgcaccaccacacctggccaggcaattttcttatctaagaaacatgaaagggaaagagaagcaaagctacagggcagtaagttggtattgaagagagcaatcaataaatcatcttgccagcatagtaagcaacctgaaaacaacctcaaacacaattcatcatcgagtgttcggtaatgacctctcagaaattgtttcttgtcactgggtgataaataattttctaagactaatgtgggattgttcaccctatggtagaattacatatccttggtgatttgggttagaaacagagtcctgggcacaaaactcagagattaaacccacgtcatttttatccagatcaatacttagaattaaatgtatgacctaaatagccatcttaaaattattttattctccaggacaatggtcttcttccaagctggatggcatgaaataatgaggataggctgtctccacattcctgtagaattccctggagaaatctgattcacaggagagctcacctcatagcatcagttacctagggagctctgtgggaagtcacttgagaatgctactgagaataataaaaagcatcctctctcactgacaggaagttgataatgtcttcataaatatttggaatgaattaatatgattcaatttactctttaatgtggatggtctctgatagcaacatattggaatatctgtttctaaaaacaaagcaatttttagaaactcagttaatcaatacagtgtttttcatggtattttctcatgacttggtgagcattttttggaacagtgtgtttttctttcagctctgttgtcatcacccaatggaaattttagacagcctttgtgacaatagcagaaaattttccttgctaaaatgtaattttattttgtgggtatattatatttagcctattttcaagctggacctgtcatccttctcccccagtgagtggtgagaaagctgtctaaggagattccagcaagtatgctttcttggggtggacatgtggttttctcagtggggaggggtcacaacgatggaactcataaagggtaaaactgcagcaatgaaaatacaaaaataagccatagtctaagtagtgtgccgttaaccctaaggccacaaactcaattgtttcaaatagttaaagaattagttggttctttcaaactaaaattttgtttctgtaattttgttttgaccttatgcaagtgatggttctacagtgtcatattctagaaagataaaagagccttggaaatggagacattgatccatatgcttttacttgactgtcttttaaaataaggtgcatgatgcctccatattccatgttttagaggcccagaaatggcctgccctaaggagctatagttgggagttgggtttctctcagcctaggcaaaagcaggggatcctacatggggcagctggagaagtttgggctatggagcacagttcaggccagagtctgtgagacaaagtgtggaaagaccagaggccgaatctcctctttactggagatagaacctctttgctggagatagaaccaaagcctggaaacctgagaggcagggccctgagcgttcactgagagcaccgctgtatttgcagctcctacataaagcatatcctggaatctgtcctccacactaatatgaaaatgatctttgtaaaatacccatgtgattgtcgtgtacctacttgaaatccttcatggtcctgtaactttcaggttaaaaaatccgagagcccttttgagctccttagctttctgaactgatttcttattgttctctgagtttgcatgcattgctgtagcccccaggacctattcaacgttcccaagtgcatcaagctgtttcatccctccctgtgggtttttccactggaatgcctattcttcttgggctatcatctagctaattcctgcttaacctccttgggttggctgggttgaaaaaatatctcccccaacaataccctacacctgccttcatgatagtattcaccatgtttttctgtaattcttagtgtttgtctgtctccccactgcaccataagtttcttaagggcagagaccagggctcattttactttgcatttcagtgcctagcaaggtacttaataaataattgaataaatattgaataaatgaattaactactttagagtgtaattaccataattttataaagaaaggaggaagcttaatttactcattttttaaatttatttattttttagacaaggtctcactctgttacccaggctatagtgtagaggtgtgctgtctgctcactgcaacctccgcctcccaggctcaagcagtcctcccacctcagcctcccaagtagctgggactacaagggcacaccaccacagctggctaattttttaagtattttttgtagagacgggtttcaccacgttggccaggctggtctcaaactcctggcctcaagcaatctgtctgtgtcagtctcccaaattgctgggattacaggcatgagccaccatgcccagcctattcattattttaatttgtggtacattatgtttataaataactttcacatattgaggaaggataaataaatggtatagatggaagtagatataaatggagatagagagagagagatagtactttaaaagttatttcatttgtgtaattgttcatcaataaatatggattgactaactgttatgtgacaagcactgagcttagcagtatagagagaaagtcatttagagacaggccctgtctccaaaactcattctggtggaaatgaatagacacacaagcaataaatgtagtacattttgataagtactgtggtcaacataaactgagtcttgaactttaacattttacatttaacattgaactttattgaggttaaatttacaaatcataaaattcacccattataaatgtatatataacaatttttagtatgtttgcagagttgtgcaaggactaccatgtcctaattttaggacattttcatcacccaaaaagaaagcttgtgtccatttgtggtcactcactcttcgttcccactcccagccccaggaagctgctaatctcctttctgtctctatagatttgccttttctggacatttccataaatggaatggtactgtatgtgatctttgtgtttgggtttttcccttggcataaggtttttgaggttatccatgtggtggcatatatcagtatttcattcctttttattacccgatagcattccattatagaatatatcgcattttatccattcaccagttagtggacatttgggttgtctccctttttgtgctaagaactttggaattaaaaaaaaacttcttctgatcgtgagtctggcttatgttttgcattgctacttatgaaatctgtctttattttacattcggtgactagactggggcctaatttcttttatttgtgatgctagaacaaaactattagttttcctgaaattactcattccattaacaggtctgcattaaaaccttgccctcgccataaaaaaaaaaaaatcaaacttcttaacaatttaaagctaggtagctgtagtagggtgctataagaaatatatttttttctgaagccaatctgccatattttctgcattcactgagctttgaaagctgggaagaatttcatttcatgtcactcgctcccatgaatcgtacactgtttagaaatggacatgtgtgagacatcttgattcctttgaaagtagatttataaaatgctgcccagtaagagcaaccatatgattccataattattgtttcccaataagctcccaagaagcaaattgctcccaagaagcaaattgctgtcattaccaaatgtcatcagttaaataaactacgatctttgtgtctgtagaccaattgaggatccctcctttagggaaataaagccaaaaataagtgttctatttctcaagaagtcttcctgccttttgcatagtccaatacacatgcgtgcatctctcatagcacttggcactttctgtaattcttggtcccactagactggaatcttcttgcagacataaccaagtcctacttggctaggaccatcatttctggaagtgcccagtttcaggtttccataggactttaaacaacttaccacaaaaatttatgtgaccattttatttcattgttttattaaatacatagctatacttctttaacttaaaaatataaaagtacattatgattatttctttaattcagatgcccatgagggaagcatgtagaactgtcttttcagtatgttttaatgtcacaggtgaaagaagaatctcataaattctctcacattttaaaatcagaaagggacggttgacttcacatttgcagaatcctctggctccatgttcctgaaagtaatgacaactgaatgtgtagaagtcctgagggtatgcagatgcctgtcgtatttgaaatacccacggctgcccctgaacttgctgcatcaatggagccaagtgtcaagtcgacttggtgcccgttttcatatgatgggctggttcgactcccccaggctaagaggcatttaatctgtttcccttttgaattaagtgtttatataacttgacgttttaaaaaataggctttgtcttccccagtgcctgtcattttctataatactctgatttgaactctagcaacggacatcactgtacctccctgagtaccagactttctcacagcataaaaatgaagttgtgtaactgtgaggacacatagtaccattttggaccaaattaccagttgacttaaatcctctcataacagccaatgttgaagttgccataaaaagaaaagtcttacgtacttgaactaatgccatttcagtccacgatggaaaactccttccagctgataccagttttagacactgaaatctcagaaggtctaagtcttataactattttagtgaatgtaactggtagttttttttcacgcataataagctaatctgtttgctgtaataatattcaacatctgcaggtgccacatgttaagtacacattgcaactacaagtgtagcaacttactaaaaatttgatatcctcaaaaattctcaagcccagacattcaaatggagaacctggcagtttcttgactttccaaggctaatcatcagggaacttgaatgcagcttcattgtcatggttcatcctcccattgatagttacatgcttcattctatttcatttctatttcttactgtttccttctgtaatttcaatatttccatgtgagatgattaaacaccactaactttctattccagtgcaacttgaagttcgttgtttgtcagtgatttgtgatgagataaatacagaaatgggcagtaagcattgatatatcacagtatgattatatctgctgaatctaatttttaaaattggaagctggccgggtgcggtggctcacacttgtaatcccagcagtttgggaggccgaggcaggcagatcacgaagtcaggagatcgagaccatcctggctaacacagtgaaaccctgtctctactaaaaatacaaaaaattagccagacgtggtggtgggtgcctgtagtcccaactactcgggaggctgaggcaggagaatggcatgaacctgggaggcagagcttgcagtgagccgagatcatgccactgcactccagcctgggtgacagagcgagactctgtctcaaaaaaaaaaaaaaaaaaaaaaattggaagcttatattttgtacatctttgtctgttaattgatttttctattaattaatttttattgtattttacaatcctgtgaaggattggaggtaggatggggaattatattcttcagcatagatagtttaagaaacactgccccattccagagatatttggttagtgggaagaatggacaggttcccatgtttcccacctgagaatatagtttgttgttatttgtaaaatttagtgtgaaagttcttctcctccaatgttctataacattaactgtctaacattatgccaacatccaagaattatattttgggataaagaggcatttgaattctaggcttgtacccaccaaactactccccacaaataaagtcattccatctcacgtacataatttcacagattatataagacagcttttatatttctataattgtattccatattactggttttaattcctaatttggcattattagtgctaaatattttattattcattatattttaattattatttaattatttatttatttattattttgtattattcattatattcatttatattttaaaatatattatgtattttctaatatgcaagattttttccaagagtatgaactaagaacaaagcctaggtctttgaaaaattttaagtccaataataatactgctggtaacatgagtctcatgagttttgttttgttttgttttaaggatttgctcatgataaaattatataacttacttttgataatgaaaaaataagatatcgtgattatcataatattgtgatatcattagcctgtgacagctgtcttctggccaccagtcttagctgccttgtctaatttgaacaaatgaagaacaattaggtgccctttgccttaccttctctcgtttgctgcgggccagtttgcagttacagccagacatggtggatgatatgtgtgtctctgtgtttacatgggaagggtgggcagggcttgggagcatgaacttcccacagcacttttcttaccccagtttgtctctgttctttgaacaaagtggagaccactcctttggtgcacggatgtccttttgcaaaagcactcctgtgacacctcttgtgtctgagcgtatacctgctgatgtgaagttctgtccttcctgtgctcttgtacaaggttctcaggggcttgagagactgtgccatacagggagcataaatcctattgtctgtcaacctgcacgtccacctcacagctggggagagggcaagctctgtgttctaaaaaaagcaacaactccctgtacaaattgtcagtcatttggcctcaaatgggtcccaggctcagaaatatataggcagttcgtaatattccagaaatattctcagaatgacttaaaagttaaccagtttaaccttatctgtggacgcctgctctcccaatagtcacagagttgtagtttgggctggatgtgccctgagaggaaataaaaggagaagcagaaagagaaagaaccagggatgggagagagtaccaatattccttgtctctgtcattccctgcattcaagaactatcaaccctgcttatctaaaaatcagcaaattatcctaaatctggatttccctcaaacataatactgtgccttagagttcgacattgttttttcatttcttaaactacaggaacacttatatcaaatcgaacacgattccaaatataatatagaatgtttatcttaaggaccaaatgatatatttacattgggaaagaaaatagaaaatcgatatcaaatttgagcattttaatattatctgctgtccccatgagaagagaaataattaattgtatcataactacatcatgaactattaaaggatatggaagtactctaggcctaatttaatttttgtttattcttcaaaggttatttcttaaaatatcctcttgcagacatgcaaagccctttactttgcataaggtggctaggacaaagactggcttttagaggcaaatcagtgagtttgcatgtgagacgtgccatatatactcacaaatatatccctttcttcttgtctctccaactggaagccctcctcagtattcagaaataccagagtttatataccgtgtgcatttgtcctgtttatgtattcctgaattttataaagagaaatctgccttaatcgatcattctaaagaccaaaaataaatccatgatgtagtagcagttcttagttaacaacaatttttttaaatgtgtatggaaactcttgatcaaaatattctgaaagatggagacttttacatagacagacatttttaaaaagtgttctcatatcttcccaaagatagcaaaataaaggaaaataaatactaattcattagtatgagtcattgataagcatatttttaaaaaatactgaattgtattacctttattatcaatctggatcaagcaacaattaatggtagtggttgttttcaatttaaaaagttttagagcatctgtatggccatctttttctcattaagaaggtaaaagtacacttttaattaataaaacaaacagtaataaattaataaattattaataaaataaaatagttaatagaataaataaataccttatttgttcaatttattgaactctatgtttcaagctcttaaactgatatttttcctctgacaacaagggcacctacatttttgtcaaaattaactgtaggttattagcttaactgtattaagctgaatctttataaaatttaataatgataaaacttcatcattatatgcctgtattcccttacctgtaaaacaggttaataacataccaagtttagaggaatcatttgaggactaaatgatataatcaacattaagtaaagaacagtgtttggcataaaggcagtgcccaaaatatgcatacagtttgtttgatataaataactatcaacctctcttatcatctccccactatttcctccagtttgggaaggaaatgaagagataaatatttcacattttaatgaagtagaagagtctttaacaatgtgtcttctacttagcagcccctgtcagcatcagaaattgtttgcttcagtaattttcttctcctgttttagaaataaaatatcttcttcaaaattagggaccaggtatttaaataagtatagagtttacttagagagtgacctgtttgtccatgttcatgattatgtgactatgacaaatgctatccaagatgacagatttttaaatattaatcaagtaatctaacaaaatgtgcatttaaaaaaaagagagtcttcttaatctatattggacatctcctctgattcattcatgatcttatgttcaaaggaagaggtttctttaaacgataaaggtagagccatcagcaaattaaacaacagtaccaaatacctactctttttttttctggcatgatttttctattgtctaattcacctcatcaaatgtatttcctgaaactgacttttgacacatcagtatattcataatccctgagtgaatcactgacaaaactttggtcattatttaacagagccaagttattccagcaatttcctcatcctgattacttaatgctttctgcatctgttatgtattttccaagacctcttgcaaatctggtattagttgcacaaggtgacacatcaaattagtaacagagatagaatatagattgagttgaatcagggtcctcggctgtagcccatgaaccgcactgagaaagtgattttcctaaagcgatttagtaactggtacttgcagagtcatctattggaggcagattggtgtaaccttgtcaggagacgagatgataaatctgatggtttttgaagtttccctccttgctttccttcctctatttttacgtccttcaataaatatttattaaggggtttctctgtgctaagtgcttgggcaagagttcaagagtgaatcagatgtggatcttgccctgaagaagtttataatctagctgggagataaagcaggcataaggaggatgcatgtgctgagtggcctaagagttgcataaagtaataggataattcgcaagcaagagatgatttcagttcggggaattaaggaaaacattaatctcttggagaacttgataaagacaacagacctttctccagaaaaatataactcccattatgtatataatctcaaagagctcatggcaccactggaagtggtgttggggggttatgatgtggctagaccctgggttaagaatctctttcttagagaatgtgtattggactagagccttcaaatcaggtaggatttggatgggaaaggtatagtggaagaacccgtggatggagagagcagcctgaggtcacctggagtaagtacaaggatcttcagaaacagccccattctgatcttggattctgctgtattatctaagagcaggttttctgtataaatcattctgctaactttagggacctttatgaaccatggacatgctaaaagtttctcatttagataaaattcattttcatccattattgttttcctctatggagaagggtgtattttttctatatgctagtctttctatgggaaaggcaaacaaaaaagaatggctctgtgtaattaatttgttgtttttcaagatcacttctgcattcttttaaaatggagttatcctcccaagaaactttgctacttcatattatccgtcattcatatgcaagactaaaaagtatcgatcacagcaaattactatttaatcagtgtaaatatcactactgccttattgttgaagcttattatgctgtcctttgccattattgggggtgtttcaaagcctataatcaaactaaacagactggtacaacaactactaaatgaacaattctctttccgtaatatgtgaaacatgccttagccttcctgtcttaggaaagagttggataacagccagctcctacaactctggtgcagattgagataatacttgtaaaatgcttggggaaagcctcagattcatagtaagcactcagtaagtgtcatcatcgtcatcatcatcattaattaatatttctacttttacctgagatattatctatgtcttttcattacctaattctccaactaaatgctgctcacatgctattcaacaaagattttacctagggagtcatcgctccctaaaaattggacttatattagaaatagcagcaaggtgcagtggcaggtgcctttagtaccagctaatcactacttgagaggctgaagcaataggatagcttaagcccggagttcaaggctgcagtgaactatgattacacctgtgaatagccactgtgctccagcctgggcaacaaagtgaggcctcagtcgctaaaagaaaacagaaaaaaagaaaaataaatagggtccactattccagaaaattcaatttcagagagttaaaattaactgaacagataatttgggaagcagttattctcattaaaaaaatgattttttttctaacatgaagcagcatttgaattacagtttctttcaataaattcctctaaaactagttttctaagtctgattcttttaccagcagcatcagcatcatctgacagttgttagagataccaatgctgggcccaatcccaggccttctctatctgaaattctgggattggagctgagccacaagccctccaggtgatcctgatgtagtgaggtttgagaatcaccattctgcaatcacacaagagaaacaaagaaagggcattcaaataggaaaggaagaagtcaaactacctctcctcactaacaatatgattctatacctagtaaaccttaaagactgtcaaaaggctcctggaactgataaacgacttcaataaagtttcaggatacaaaatcagtgtgcaaaaatcagtagcatttctgtatgccaataatgttcaaaatcaagcaaactcaagcaaaatcaagaatccaatcccatttgtaatagccacacacacacacacacaaatacctaggaatacatgtaaccaaggaagatctctaaaaggagaactacaaaacactgctgaaagaaatcatagatgacataaacaaatggaaaaacattctacattcatggggtagaagaattaatatcattaaaatgtccatactgcccaaagcaatctacagattcaacactattcctatcaaactacaaacatcatttttcacagaattagaaaaaactattctaaatttcatatggaactgaaaaaagaaccagaatagccaaagcaatcttaagcaaaaagaacaaatccagagatatcacattacccgacctcaaactatactataaggctacagtaaccaaaacagcatggtactggttcaaaaacagacgcatataccaactgagcagaatagagaactcagaaataaagctgcacacctacagccatctgatcttcaacaaagtcaacaaaaataagcaatggggaaaagacttcctactcaataaatggtgtgggaatagctgactagctatgttcagaagaaagaaactggacttccacctttcaccagataaaaaaattaactcaacatgaattaaacatttaaatgtaagaccgcaaactataagaatcatagaagaaaacctaggaaaaaccatgccttgggaaagaatttatgagtaactccttaaaagcaattgcaacataaaccaaaaactgacaagtgagacctaattaaactaatgagcttctgcacagcaacagaaactatcaacagagtaaacagataacatacagaatggaagaaaatattggcatactatgtaactgacaaaggtatgacatctataatctataaggaacttaaagaattcaataagcaaaaaacaacatcattaaaaagtgagcaaactaatttacacttccaacaacagtgtaaaagtgttcttatttctccacagccttgccagcacttactgtttcttgacttttttaataattgacattccggctggtatgagatgttatctcgttgtggttttgatttgcatttctctaatgatcagtgatgatgagctttttttcatatgtttgttggccgcataaatatcttcttttgagaagtgtctgttcatactctttgcccactttttgatggggttgtttgttttttttcttgtaaatttgtttaagtaccctgtagattctggatattagacatttgtcagatgggtagattgcaaaaattttctctcattctgtaggttgcctgttcactctgatgctagtttcttctgctgtgcagacgctctttagtttaattagatcccatttatcaattttggctttggttgcaattgcttttggtgttttcatcatgaagtctttgccatgcctgtgtcctgaatggtattgcctaggttttcttctagggtttttatggttttgggttttacatttaagtctttaatccattttaagttaatcattgtggaagacaatttgtggcgattcctcaaggacctagaacccgaaataccatttgacccagcaatcccattatgggtatatacccaaaggattataaatcattctaccataaagacacatgtgcatgtatgtttattgcagcactatttacaatagcacagatttggaaccaacccaaatgcccatcaatgatagactggataaagaaaatgtggcacatatacaccaaggaatactatgcagcgagaaaaaaagaatgagatcatgtcctttgcagggacatggatgaagctggaagccatcattctcagcaaactaacacaggaacagaaaaccaaacaccacatgttctcactcataagtgggagttgaacaatgagaacacatgggcacagggaggggaacatcacacaccaggttctgttggggtttggggggcaaggggagggagaccattaggacaaatacctaatgcatgcaggtcttaaaacccagatgatgagttgataggtgcagcaaaacaccatgacacatgtgtacctatctaacaaacctgcacgttctgcacatgtatcccagaacttaaagtaaaattaattaattaattaatttaatttaaaaagtgagtaaaagacatgaacacacacttcttacaagaagacagacaagtggccaataaacatatgaaaaaacgttcaacatcactaatcagagaagacaaatcaaaaccacaatgagataccatctcacaccagtcagatagctgtcaaaaaaataaacaaatgacaaatgttattggtcaaaagtcaaaaaatgacaaatgctggcaaggctatagagaaaagggaacacttatacactgttggagagaatttaaattagttcagcctctgcggaaagcaatttggagatttctcaaagtacttaaaacagagctaccatttgacccagcatcccatttttgggtatatatctaaaagaaaaaaaatcattctaccaagaagacacatgtactcacacattcattgtaacactgtttactataacaaagatatgaaatcaacccgagtgtccatcagggattggataaagaacatgtggtacatatacaccatggaaaactacacagccataaaaaagaacaaaatctcgtcctttgcagcaacatataggtagctggaggccattactctaagcaaattaacccaggaacaagaataccacatgttctcactgataagtgggagttaaacatttgggtacccatgaacgtaaagatgacaacaatagtctctaaagacaactagaggtgggagggaggggaacaagagttgaaaaactaactgttgggtgctatgctcattacctgggtgatggcatcagtcgtacccaagtcttagcatcacacagtatacccatgaaatatacctgcacaagtaccccctgagtctaaaataaaagttaaaattattttttaaaaaaaagagagaaaatgaccacttgaacacatttcaaaccaaaaccaaacaggcactgttggttacacatttaaaatgttatttaaccattttctttacacttaatagtcaagaaattaaccagttacataaaagcaagcacatctcatagcagtggacgtcatttaatgacaaagttatctattcataacaccatcctctagcatcttcattgccctgctttccacaacatgttgatactgcagagatgcagtatgagctgtggtattttaccttacacctgtccctttatgtagatttttttaaaaactttcctctacttccatttttttcatactttctagattaggaaagaggataggctggagtaggcagaattatcattatcaatactatttttaagaagttatcctaaggaaataattatgcatgagttcaagtgtacagagattcaggtataaggacattaattgagggtgattatcatagcaaaaaatgggaaacatctaaatgtccaatagttgggggaatggttgagtgatttatgcaacacacataaaaggaaaaattgcgcaaccatttaaaattatatggacatatcattatttattaagtagaaaaacttacaaagcagtactttttcatatagaatagatatgtaatattgtacatttgaacatcatgtatgttatccaaaacattaacaatgattatttttgaaagattaagattacaggaaattttagctttcttcttttcaattaggtgtattttctaagttatctacaatgattatcttaacttaggaaaaaaaatacttagcagaacacagaacatcagacaaattcatcttcatctctgtcactgataatgaagccaaaatcccaccccagcactatgtcacaacatgatcttctcagaggatgcacataccaaaacataaattaactttcctgggttcaaattctgtgccagctcctttttgaggttggaggaactcgctcagcattgctctcatttccagcgaactcagtttcttccctaccctccgcttgtcattttccagggaactccccactgagaccaagacatagaggagtttctgaacatgagcagcactgctcatcttaacaccaaacaaattgtgccagcagtatggagtctgtaccagtatcctaaaattataaacatgctctataggtggcctggttttgttttcattttgtgttatgtcccccagagtctggaaaataggacatgaagtcaattactttgctagtggccattcagaaagcttggattccttgcacattggaaaggaggggagggctgaccttatcagacccaaactgtctcagaccaccactcttggaaggaaagaaataatgtggaaatattgaaccatgatgttcatataattcaaaagtcagcttccaccaggaatctgctagaaaaaaatagtggacttgagctgttaaatgttgtggtttgtttaagggaatcctttcagcctggctgacagctctggcaggaagttgtgatgtggagctgctattataccttagaagaggctctggaagcagctgtgtcaccaggtgttaggggagaatgccaggtgtcctatggatttccagggatccactccccgtggcatgtctttccatctgctttctgtgcactgcgtctgcactacccttctgcacagtgacctggacccacctgcagactgacaaggagcattaagggaccacttccgcagcccatttctattaagaaagcttttaggtttgtttttcatcttgctggagcaacaattgagagctcttatgtaaatatcaatgaatgcttaatcagaaggccagcaacatcagcgtatagaaattaaaggccttttcttttcctagctatgccattttctccataattctaagctcagtctggtgcaattgggaggcaggagtttaaccatcagcttacacagaatgttacaaacactcccactattgtgagataagagtagcaaggttcagcttctgggaagcctctcaaagatggagattggcaggcagtaagtgattaggaagtgcccctggactcaacacctgtgggagaacatagaggagcacagagagctggactgggcaggggaagaagttgaacttcaacatcactgccacaacctccagctggtctagagctagggtgatctttcacaattgtcagcagttggggcaaggggcactgggcctgtatacctctacactgaccagtccttgggtacagtgtgtcccatgatcttcgaccaagtagctctcttcagcctcagacagttcccagagagggtctcagctgagagctgctggttgcatgtactttcagaatcagagaggatgagggcttctgtgccaaggtcagggtaggagagaagctgggccatgccttagtgtctactataaagaatagctactcccccacacaaaaaaatctcactgtaataggtggctaaaataaaaccatgggagtagctctgggacaagagatgtgaagtcattgaatgccataaaaacaactcatgaaaacgatgtgtgattaggaaggaagcactggactgaaggatatgtcattcttagagagttaataatccttccacgcatcattctattaatttcactgttagtagtatgttgcctttgattctatgcttaaaaatgtaaacatagtagatgaagttcacagaactagaaccaaagctgatgtctgcatttgagttttcagtgtacagtttccagagggtagtcatcccacacgtaaatctcacagctcaaaatttattcttggataatgtcagtgaccatgaaaaacagatctttgctgctagagttaattgagagagttcaagtcccaattattttatcagtcatttagtcagtggcatttattgagcaaataaccttttatataaaggttgtagggcactaccaaagtggaatggcattaatgactactaacatttggctcattcttcattctctatagaacattttagcataattttatctcatttaatgagttgtgttagtgtcccagtttatagattaggaaagtggagttcagaaaagcaagtaacttgcccaaaatcaactattaagggctattattaccctaaaattttgccaggggtcttccatctgaaaggagttactgaaatggcaaaactattacagctctctcggagatactgtcagagaaagctggtgtgtgtgtgtgtgtgtgtgtgtgtgtgtgtgtgtgtattggtgaaacagccaagtaatcctagacaaagggcacagataagatgagcagtgtgtccccaaaaggacctcagctttcagagggactctcctacctagcaccaaaactatggagtaggcttcaagataaatcaggagttactgtcttgagtgatctctttaaagatgaggaatttagcagtgactccaaatacagtcatccttcagtatgcacagtacttgattccaaccctccctctccctccacaggtaacaaaatctgcagatgctcaagtcccttatatgaaacagcatagtatttgcatataacctatgcacaccccccttatactttaaatcatctctagattccttataatacctaatacaatgtaaatgttatgtaaacatgtcataccatattttttaatttaattttttattgtattgttatttttccttgcttttttcccaaatatttttcatctgtagctggttgaatccttggatgcagaacccatgggtacagagggctgactgtatgaagctgtgggaggtaataaagcctagggtggtttaaatcttatttagctcagatggaccctctctttctgcatgagtgagtccctttgacatcttttctcacttcctcactatgttcttcagctaatcatttttggggactgaagcttgagctatttaccagtagggtgatttggctgaagatttgttatccctggaacgtttttcttgagatggcccctctctgttgcatacaggcttaataaagttgtctaagcccacctagttatcttgtcctgattttacatgcaggaaccatctcccatccattaacttcatcaaggaattccctcccatacatggtccaatccagtttatctgatagaatgtaaagtcagagtaatgacagatgacattagaaggcatttaagctagatctcactcatggagagaagattaataacattggagacactctgcctgggcagaagtaaatctcactggcaggttgtgcaagtgtctgtaaagatggaagtgagggaggtgtttttccaacctgctgtaagtttgggtgtagtgtagtggtagggtagctcagtagacaggaggaactcactcaaaatttgtgggctggtggaggaagacaatcaagccaactaaaccacagcatctggagaatatgggtgtccatggatcttaagagacaccagagttggtttgtgtgacatgtgtagcatgagaatgaagtgattgttaccagggtgtctgatagcagataatggcaccccaagcaccctcaatgggagaactgagagtgcaaacaagaggctcagtttgtaaagacctgaggtgctatgcaggttgttcagacaggttcagacttatagagacaagaagaggaccaggttcctgattgtgctactatatggagagttggttacaggactagggcagaaggcccattcctagatctgaggctcctctattagaaggagccaacagcagacctggctagggagggaaagatggcaaacagcgactcccagagaaggcccctccagggccaaggcaaaactgaaagactgtgaagaagcctgcatctggtcagcatagagtgcaggtatctgttgaaatgagtctaaaacccttctgaagaaagactctgatccttccctcctctcactaaactcagccaaagtccagagtttccacaattaaaaataattgctacaaataattgtagcactgttctaatagctaaatattgatacttggttatagatctgttgatggaagtgcatcatggattttggctcagagtgttggtttcaaaccatcaaatacaacatttttaaaaagtaaaaaaatataagtgtagtccacagtgacccatattaaataaaatgccttttctttaaggtgactgtgaattgttcaggcatcaggattgctgtttaatttccccagaaaggtaaattaccagttagtgtcatggtgccaggtttttcctcatgcatataggcacagggatttatagctttttacaaaaccatttctggagtcttattgtttctatctatgcacactgctgtgctgaacactccatgagttaggaaaataaacatgactggtcttttcattgtctcacatataataaaaaatatgctgataatttttgtgtactataaaatcccctttgaagaatagggatgggcaaagttgccacaaatttcttaaaaataacaattgggccttattgctttaaatcacatacttctcaaaaacatatttccagaaattaacctgctttaacctacccacagtcccagtctctgttcatgaatctgtttgttaagggtttgtgctgctcattgcctgactggttctctgctgaattgctcttctgttttgctgcctacttcctgtgatcagctctgggacttctttgttaaataccaaccttgtactccactctgcatattaccttgtaaaagttggtgctttccaattagtacttaatgggatatgtaggaaccacgagaggttatttaatctcaaaccttgccttcataaggcagaagtaaaccatcccagagaggtaagaacctgaattacaaagacatccagagaaagtaatttcacaactttccttataaccgactttaatgtttaaaaaataataaccctcacaaaaataataaccctcacagacaaaaagtggctctgcttaaaatctttaatttaggttcctcatgctgcaatttaaattcttcttgggagcccagagaagatgaaaaatagttggtggatgcctttatgttccaaaggaacctcctaattgtccccatatttcgcttctcctttaacgacctgatcattgatctgcaagcatagctttttgtttggttgggttccttgggtcttttctttaatctccatttccacagagcctcaaatggaacaaaaggaggcatggtgtgtcagtgatatgagctagacagtatcagaaggcctgaccccactcccacaaacacatgcttcaggggagcattcatctccacacatacggaagtcctgccaacattcaacacccataaagaggctatccagaactcaaaaacgaaaagtggcacactgtctaaataagaaaacagaacgtgagtaaggtttaacgtttttcctgctcacagtgttgttgctgttcttttctaattttcctaatcatctagatatgatttgggaaatacacacttttgctttcaaggaaatcatcaattaaggtatcagccagcaggaaacagaccacagaacacattcgcattagggtaatttgagggcagtgcaaaaaaagggaccttttacaaaggtggagagggagaggggagccccaagaggtggtgtttagttgctctcttcctaccccaaggcctgaagagttgaggaaaccagaacccagccacagaaggactgtgtatagagaggcccagacaggagctgagacctggggccatggaggcatccagaccaatgtgacaccatagcccactgcagccagtctctccccagcacacccagtggctaaccaacaggatgctggagtgcaaaggaacctgctgctgtggtccagtccaggtagccttccagggccagagcaagatatcgggaagggtggggagagaacttggggagcaaatgaaagatttccagcacagatggtaagaagaaatgtggcttcttatgagaatttgtgttctctatttggcttagtttctttttttctttggaaaggacattatttcaacagtgcaattgttggacaaacagctaagcgctcgtggaggtgaatctgcaattttgttctaatttgctgagatcatccaaaatgacttatcctagtacaataaggaatcaatagttgactatggtctggaagttgccattgatttcagagaatgccatcttctggtgcattatcttagagtgaatgcttctctcatcaagggttgaaacaagcctcaaatctccctgcaagcttttctgtaccagtgttaattattcagacattttaccctttaacagtggaaagagtgattacttttcagtctttgatttcagtatctccatgagtctgcctgttcctcactcccctcagccaagaatcaaatgcagacttgttttatgtcagtcttgtggttaaatatctttcctagttcctacctttgaaactcacaataatgtctttttgcctctattttttcttaataatgggagcaatatgtttccaaagtctgacacagtttaaagaatgagaatctggcataaggttattcttattcctatcctatttttatctgcagccttagttacatgagagattttagaaatcaaactctctcccaggatcccctttctaccttgtggacatcaatagccaaacatgtaacttggctatatatcctgccagattgttaaggagtcactaataaaaaatggcaggcactgaaaaaagagacacatcgttcaccctttgataatactgctctaagtactaacattatttacttcccctttacatattttcatcaagcagccagctgtttgagcctaacctcttcagttaaatgtatctagaagaacagaaataagattttttcttcagaaagaaaaacaaaagtaaaagaaaaatctccctaagctgtctctatcactttctctgtgaaacaaaaaatttttaaatttacattggcatgtggtaaggacaagagaagattctcaaaacaaaatttctaactgtgaaatttggctagccttctgtattagaccatttttgcatcactataaaggtatacctgagactgggtaatttatgaagaaagagatttaattggctcacagtcctgcaggctgtacaggaagcacggtgccggcatctgcttggcttctagggaggcctaggggaatttttgctcatggcagaaggtgaagcgggagcaggtgtgtcacatggcaagaaagagagtgagaaaatgagaggagagatgccatacacttttaaataaccagattactcttcaactaactgagtgagaactcacttatcacctcaaggagatggtgctaagccattcatgagggatccaccccgctgatccagtcacctcccaccaggccccacctgcagccctggggattacatttcaacatgagagttggaggggacaaacatccaaaccatatcaccttcttaaataaccagattcttgcagtctccaagctttcttgtcaagcatggctctgtttcatgataatgaagccactaagttactatgtacccgaatgtacagatgtttcttccaaagatgcttcttagagctgagtggttgcacagtcatgggaaatgcctggcctgatcctgaatgaagctgtaaagtaggggctgttgactttgtcacctcctgcattttcagtaacccataccccaggtgtccatggccttcagtctgcacttcccagtccggggagcctattgaaccactccccatcatccatcaagacatcgttatcctgcgtgcccatgttctcaggaccatgttagctggcagatattttagggaaataaggaataaattttcaaccatccatgagtgagctatttaaattttataagggcttctcagagaccctaacacaaaggaacattggtgttttaagggcagttatgccatctgggccccttcaaatcacatgccaaaagatgtggctaatactttgcaattctactttatttctcatatatcatctctttcaaatcatataataatccccaaataggaaactaatacttgaaaatgataaatacttcaactaaagacaccaattagagccaaaaatgaggccttagttatcgtgcatgctctgcatatatatatatatataaaactaaagaagggtatgtgtgtttgcgtatgtgtgtgttgaggaagagcaaaaactaaaggaaaagtggataggaagagcaagcaggcccatgtacctcagtaatggcaacagtcagcctcacactgagctgacttaccagtggcctggctacagtatcccggacccaatcacatagtgaaactacccaggactcttcagtatggccagagatgctgtattatgtattacgttacctccttggttagatacaaagaaaaatttcttaagatgttattaaacctccaaatatacttctgaaaatctctagatactttagaaagaaatttaaatttcatcttaaaatgaaagtacaggttttcctcaatgggaaacaatggattagaaggcctctcaaggctatttaagtggatggagaagtcagagtgctatttcctctttattcgttcatcaatattatgaacttcatcgatcaacataggctaagttatgctagtgacaaacaataccaaaatcccggcagtctgtgatggcaaggatttgtttcttgctcttgtgtccatcaatgatgctgagcagaggggctcttctgagcatcgctctcactgcaggaccctgactgatggagcgccagtatctagaaagttgctgattctcatggcagaggaaaagacagctgaataaggtcttggactgacaattgattactctggaccagaagtggtaccttttgcttccacacaaaactacttggccagagcatctgcatagcccaacacaaccatgggcaggccaggaagtgcaatactgccatgtgcccaggtggcaaatactcccaagagccagaagtatctgtgagcagcactcgtgactcccatgccatgcctgcatgcgccaggcctcctacaaggtccaggctcactgtctctcccgctgtggcctgtgcattcacactgaagagtctatctataaactgggaacttcagtaacatttaataaggtctgcaataaaggatacacaagagcatataggagggaaacccttgctcatttttcaagattcacaggaggccttttagagaacataatattatatttatgatgtaccctagaggatgaatagccaggcaaagacaaagatggtgcacagggttcctgacagagggcacagcatgtccagaggccaaacaccgggatcttgaggggaccatttaaaaagttaattaacttgggacaggcacggtggcttacgcctgtaatcccagcactttgggaggccaaggtgggcggcatttgaggtcaggagttcaagaccagcctgaccaacatgatgaaaccccatctctactaaaaataccaaaaaatattagccaggcttggttgcaggcacctgtaatcccagctactcaggaggatgagacaggagaatctctcaaacttgagaggcagaggctgcagtgagctgagatcacaccactgcactctagcctgggcgacatagcaagactccatctcaagaaaaagaaaaagtgaattaacttgccttctgtcctaatggattacttatttaatatgttacttattctaaatgtatgctcaaatatccttttaatttgccttcatttaatgatgaccactttctataaaagaaaaagcacataattggtaatagatattttatcttgtagactcatatgagcaagctcagtgtagaaagagaaggcaatgaggtgataggaagagaggaaaggaaaagggagagaagaaggagcatatttttaaggacatgccaggtgccacatcaggctgtaaggcctacccccagtcttactggtggaatagatagtagtgtcttactcacaggttcctatttcactggaaggtttcttaccctcttttatcttatgatatgctttttgttttgaagaaagttggcctggtggcataattcagaaggccaaactcctctatgggctggtcctgtgacctgggctaacttttagttggataatgtggttttctttggtaacaattatgtaacaggagctatcactgactggatgcttattaaatgccacagtcagtggtccaagctttacatgtgttatagtttaatgtgcttcaatattcttacatttaataacgactttgtcataaagttattcattttgacaataaatctttaaggtgagtattgttggctcttgagccaagatggccggataggaacagctccagtctacagctcccagcatgagcaacacagaagacaggtgatttctgcatttccaactgaggtactgggttcatctcactgaggagtgctgggcagtgggttcaggacagtgggtgtagtgcactgtgcatgagccaaagcagggcgaggcatcacctcacctgggaagtgcaaggggtcagggaattcccttcctagtcaaagaaaggggtgacagacggcacctggaaaattgggtcactcccaccctaatactgcacaattccaacgggcttaacaaatggcacaccaggagattatatcccacacatggcttggagggtcctacgcccacggagcctcactcgttgctagcacagcagtctgagataaagctgcaaggcggcagcaaggctgggggaggggcgcccgccattgcccaggcttgagtcggtaaacaaagtggccaggaagctcaaactgggtggggcccaccaaagatcaaggaggcctgcttgcctctgtaggctccacctctgggggcagggcacagacaaacaaaagacagcaataacctctgcagacttaaatgtccctgtctgacagctttgaagagaatagtggttctcccagcacgcagcttgagatctgagaacgggcagactgcctcttcaagtgggtccctgacccccaagtaccctaactgggaggcaccccccactaggggccaactgacacctcacacggccaggtactcctctgagacaaaacttccagagaaacgatcaggcagcagcatttgcggttcaccaatatccactgttctgcagccaccactgctgatacccaggaaaacagggtctggagtggacctccagcaaactccaacagacgtgcagctgagggtcctgactgttagaaggaaaactaacaaacagaaaggacatccacaccaaaaacccctctgtacatcaccatcatcaaagaccaaaggtagataaaaccgcaaagatggggaaaaaacagagcagaaaaaccagaaactctaaaaatcagagtgcctctcctcctccaaaggaacgcagctcctcaccagcaatggaacaaagctggatggagaatgactttaacaacttgagagaagaaggcttcaggagatcaaactactccgagctaaaggaggaagttcgaaacaatggcaaagaagttaaaaactttgaaaaaaaattagatgaatgaataactagaataaccaatgcagagaagtccttcaaggacctgatggagctgaaaaccacagcacaagaactacatgatgaatgcacaagcctcagtaaccgatgcaatcaactggaagaaattgtatcagcaatggaagacgaaatgaatgaaatgaagcgtgaagaaaagtttagagaaaaaagaatgaaaaggaacaaacaaagcctccaagaaatatgggactatgtgaaaagaccaaatctacgtctgattggtgtacctgaaagtgatggggagaatgaaaccaacttggaaaacactctgcaggatattatccaggagaacttccccaatctagcaaggcaggccaacattcaaattcaggaaatacagagaatgccacaaagatactcctcgagaagagcaactccaagacacataattgtcagattcaccaaagttgaaatgaaggaaaaaatattaagggcagacagagagaaaggtcaggttacccacaaagggaagcccatcagactaccagcggatctctcagcagaaactctacaagccagaagagagtgggggccaatattcaacattcttaaagaaaagaattttcaacccagaatttcatatccagccaaattaagcttcataagtgaaggagaaataaaatactttacagacaagcaaatgctgagagattttgtcaccaccaggcctgccctacgagagctcctgaagtaagcactaaacatggaaaggaacaaccggtaccagccactgtaaaaacatgccaaattgtaaagaccatcaaggctaggaagaaactgcatcaactaacaagcaaaataaccagctaacatcataatgacaggatcaaattcacacataacaatactaaccttaaatgtaaatgggctaaatgctccaattaaaaggcacagactggcaaattggataaagagtcaagacccatcagtgtgctgtattcaggaaacccatctcacgtgcagagacacacataggctcaaaataaagggatggaggaagatctaccaagcaaatggaaaacataaaaaggcaggggttgcaatcctagtctcggataaaacagactttaaaccaacaaagatcaaaagagacaaagaaggccattacataatggtaaagggatcaattcaacaagaagaactaactatcctaaatatatatgcacccaatacaggagcacgcagattcgtaaagcaagtccttagtgacctacaaagagacttagactcccacacaataataatgggagactttaataccccactgtcaacattacacagatcaacgagacagaacgttaacaaggatatccaggaattgaactcggctctgcaccaagcagacctaatagacatttacagaactgtccaccccaaatcaacagaatctacattcttttcagcaccacaccacacctattccaaaattgaccacataattggaagtaaagcactcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacctaacgaaatgaaggcagaaataaagatgttctttgaaaccaacgagaacaaagacacaacataccagaatctctgggacacaatcaaagcagcgtgtagagggaaatttatagcactaagtgcccacaagagaaagcaggaaagatctaaaattgacatcctaacatcacaattaaaagaactagagaagcaagagcaaacacattcaaaagctagcagaaggcaagaaataactaagatcagagcagaactgaaggagacagagacacaaaaaacctttcaaaaaatcaatgaatccaggagctggttttttgaaaagatcatcaaaattgatagactgctagcaagactaataaagaagaaaagagagaagaatcaaatagatgcaataaaaaatgacaaaggggatatcaccaccgatcccacagaaatacaaactaccatcagagaatactataaacatctctacgcaaataaactagaaaatctagaagaaatggataaattccttgacacatacaccctcccaagactaaacaaggaagaaactgaatctctgaatagaccaataacaggctctgaaattgaggcaataattaatagcttagcaaccaaaaaaagtccaggaccagatggattcacagccgaattctaccagaggtacaaggaggaactggtaccattccttctgaaactattccaatcaatagaaaaacagggaatcctccctaactcattttatgaggccagcatcatcctgataccaaagcctggcagagacacgacaaaaaaagagaattttagaccaatatctttgatgaacattgatgcaaaaatcctcaataaaatattggcaagccgaatccagcaacccatcaaaaagcttatccaccatgatcaagtgggcttcatccctgggatgcatggctggttcaacatacgcaaatcaataaacgtaatccagcctataaacagaaccaaagacaaaaaccacatgattatctcaatagatgcagaaaaggcctttaacaaaattcaacaacacttcatgctaaaaactctcaataaattaggtattgatgggacgtatctcaaaataataagagctatctatgacaaacccacagccaatatcatactgaatggacaaaaactggaagcattccctttgaaaactggcacaagacagggatgccctctctcaccactcctattcaacatagtgttggaagttctggccagggcaatcaggcaggagaaggaaataaagggcattcaattagaaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagggaactcccattcacaattgcttcaaaggaataaaatacctaggaatccaacttacaagggatgtgaaggacctcttcaaggagaactacaaatcacaactcaatgaaacaaaagaggctacaaacaaatggaagaacattccatgctcataggtagaaagaatcaatattgtgaaaatggccatactgcccaaggtaatttatagattcaatgccatccacatcaagctaccaatgactttcttcacagaattggaaaaaactactttaaagttcatacggaaccaaaaaagagcttgcatcgccaagtcaatcctaagccaaaagaacaaagctggaggcatcacactacctgacttcaaactatactacaaggctacagtaaccaaaacagcatggtactggtaccaaaacagagatatagaccaatggaacagaacagagccctccaaaataatgccgcaaatctacaagtattcgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctcaaaccataaaaaccctagaagaaaacctaggcaataccattcaggacataggcatgggcaaggacttcatgactaaaacaccaaaagcaatggcaacaaaagccaaaattgacaaatgggatctaattaaactgaagagtttctgcacagcaaaagaaactaccatcagagtgaacaggcaacctacagaatgggagaaaatttttgcaacctcctcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagatactatctcacaccagttagaatggcaatcattaaaaagtcaggaaacaacaggtgctggagaggatgtggagaaataggaacacttttacactgttggtgggactgtaaactagttcaactattgtggaagtcggtgtggggattcctcagggatctagaactagaaataccatttgacccagccatcccattactgggtatatacccaaaggattataaatcatgctgctataaagacacatgcacacgtatgtttattgcagcattattcacaatagcaaagacttggaacgaacccaaatgtccaacaatgataaactggattaagaaaatgtggcacatatacaccatggaattctatgcagccataaaaaatgatgagttcatctcttttgtagggacatggatgaagctggaaaccatcattctcagcaaactttcgcaaggacaaaaaaccaaacaccgcatgttctcactcataggtgggaattgaacaacgagaacacatggacacaggaaggggaacatcacacaccagggatggttgtggggtgggggaggggggagggatagcattaggagatctacctaatgctaaatgatgagttaatgggtgcagcacaccaacatggcacatatatacatatgtaacaaacctgtacgttgtgcgcatgtaccctaaagctgaaagcataataataataaaataaaataaaaacaggtgagtattgttatggggttcctcccctctttcttctgaataagaaaaccgaggtttagagaatactatgggaataaattggccgagtcataaggcgagatttttttcccccaccttttggtagatctgaatacttaccccaaatgtcaagataagggttatggcaaatagtagtaacaagagactttagaaaacatctgaagaaaacatctgaagagaggcaacagtgttttttttttgttttgttcttttgctttgtttttttgtttgtttgtttgtttttgctggtaagttagacctggaatcaagtctaaccttgcaatgggaatacatggaatattctctctaatcactgttttaaactccttttgatatttccctcgacctgcacataacccatggtattagccacatctataaggaaaaactcagctcccattaaatcctgacttttccatgttcttgtggaaatagtggaagcactgggaagatatggccctgctctcttagtctctgaaactcaattttcttggggacaacaagcataaaacaatctactttgtctatcttttaatgtacagagaatagtgacattcctttcatctcagatctttcctgctgaaaatatcctgttgtgtttattgctaaatagatttctttagcaattaggcacttaccaatttagtatgccaagtggctagcgttttcatatgtatattaaaaaaaactctagattacctcttacttttctatctgcctaagtcattataaatgtcctcctattggtttccttttaatttaaaagtagaaaaaagcttctgggcctgaaggttccacactttcctcctttgctctgctccctcaccatctaccagggaggcatcatgagcagggagtggcatttggcacttgcagtactttagtggcttaaaaaaaataaaacaaaacaaaagaatgaaaaaagaatatttgattgtaattgaaaaacaatgagccaaaaagacaaaaggaaaatcctaggaaaaatgaatttcataagaaaatataacaggaaaaagaagatggttaagaaacagatggtaagatggccagtctttcctgtctgtattctgaagaaaaccctcagaggctctgaagcattcatgatggtgctccttgatgtctatgaaaaatggagcccaaagcagttaatgaccaagcctgggctaattacccattttatctccctgcacgtttcagtctcgcatcaacacactgtaccataagtttttaagtatatatttatgctgtcttcttcagagatgagctgttagccactgaactccaaacatgactaagtcccgatctctcaaggtacactgatatcttggtgcttggaaggagatatattagccggtcagtttactgagactcagtttggaggtgtcaaaaagcaagagataatggtcatgtatagaagacatgtattcttctttccatttcctcatctgttctggagaaaacctctctgcatcttagtccttgctgttttgctgtaattcttcacctgacagtggtttctctaaatttccctcagagtgtgtcttccccaatttctttaaactcatcttcaaaaggaatctttctttcaaaagcccttcatggtcaagtttatctccttgcaaaacttttcccgactctccacactcttcccatcatatttgtttcctcactgtagtcacattttctgtttacctctcttgtcaccttcatcatagtgcattacacttagttgtctgcactctctcccctactcagtcatgggtccattcatcttggtgtccccagggcccagcacagtgactagcacatagtagacacttgataaaaactagttgaatgagtgaatgaacataatgaacataggttgggttttgtcatttgacagacatttattgagcaactactgcatgccacggtactcaatctcaataacatatgatccaccctagatactataaattatcagtgaatctaaatacttttcgttataactctcatgcttttccaagtacttattacttagacataaattttctgagtaagttttcttccatttctattaagtcttcacattttgttttgtactgtgtagatacaataaaactagctgatcagagctttttaaagattggtaagagagagatgaagtttcatttaaccttggccttgaattcacaaagaactccaaatctggactttgtcataatctctaagtgaggctatgcctacattaaagatacactaaaaaaactgaaactttaaaattgaaactgaaacatcatctaacatcatccttttatcccgttcttggctcacacagcctctggtgtatatactgctattgctatgacacacgtttctttattggatctctctcaagcccagcccacatacaccacatcatccgggggttgctgtctttgctggtgaactctgctgaatggtgataatgtggaaatgagttcagtgtgctcttttctcctttaaaatagaagcgtcatgaggacaaagacctcttctctttattccagccatattcccactatctagcaagaaatctggtaaataatacatcctcaatattgttacatctctgctacctaaaagaaagtgagagtaaggttattgactgggctaatgtaagaaacaaaagaaaaataagatgtcaaaggcagaaggaatgggaaggtaacagtggctcagtggtcagtatagagccattcatccctggtgcaggactctacagttaactctgtgccctcacagacatgaaatcaccttactcagaccccaccctgcaccatcattctcatttaacaaatgcagacattgagtctgcatggagcagggagggtctggaatcagttgtgtggcttgaagttccttgttctacccactactgaccccaaaaagcaaacatgcaccttcctctttgacataactgggcaatagaaacttgaaccaatggtttctgtgctccttctctgagctccagacctaaatatacagccgccaactggacactttcccctgaatggcccaagagcaagctgtccgagactaaatgcactcttttctccattgagagtccgtgcttgatccatttccagcatgtgctgtcttagtgataaccaccctagttttcacagctatgccagctgggaaccccaggatcctccctgaagtccccttgccacatctatgaaagctatcatcaaatcctgtacatttgcctcctcatatcttctcaaatctgaccacactttctctaccaccatcatctgtgcaggctatcctggtggccaacaaccccagcagcatgcacctcctcaccaaccttcctgcacattctctggccccccttccagtctgttctccaccctgcaggcagaatgatcttccaaactgtaaatcttacctgccaagatcctttcaaatggttggatggcttctcattgcttgcacaattaaggcaaatcaccatgatgcccaaaggacctgctgcctacctccctctcccactatcctctgaaccagccatggggccttccctccttccctgggatatgtagtgctcccctctagcccagaggctttgcatgcgctgggccctctgctcagactgctcttaccactctctttgtctagctaacacctgttattcctttgtagtacttgtcagagttgtatcttatggggtcatcgaatcagtgtctgtaagctccagaagtccagggtgtgtctctttctgctcacctgggacagtaaatgctgattaaataaatggacaaaatggttctaggcatatgcaagttaaagcacactttgctctagatgcctagaatatctcttttgtttcagacaaattagggaattaaaataagcatgcctagaaatctattgacaaaatcaactacattaaatacaatatatgtattattgattaacaaattcaacaaaagtatttagtgcctgctatggagaatgctagattttgtacatactccaagccctgttcacattctcctagtccatgcacacagaaaacctcatcattagaaagagctctgtctttttctcaccagtcacttgaaaatttaaactgcccaaagtgctgagaagagccaacctcccttcttcttttgacattagtgaggttataaacagtgcatattcttgcgagaattaacatttgcctgagaggactgagaagtatttgatttgaatatgtctagtaatttggaatttttgctttttatactgtttgattatgaaatgattagttaattaaattggcaattggacagggagatgcacagaagtgaaattcctcttaaattactcaccctccatgcctcactttaagtagaacatcagaatgattgcattaatgcatgctgagagtatgctttgcacgaggtgcttatttgaactaaaacatatttaaaatggggtaacactagaactaaagaaactaaaattcttaatagtcactaaaaaactacatcttgttgtcccaaatgaattgaccatccttatttcttcagtgtccactataataaccatctcttggcaaacctcagactgtgtgcgctctcacaggaagtgattgtcctcatggtctccctggacacaggaagtgattgtcctcttggcctccctggagccccaatccctcctgtgtcccacactcccactcctgggagacccagtgggctctgttgtcatgttggtagccactcagcttctggtgtcagtccctcctctacctagcctcagacactaggtagaattgcttcccttactctcacaatctaagggccccaaatacaaaaggcccggtgtggtcatattttctaatccaaacctgttggacatgcactctttcagagacccaagaaatggtagaattttccaagcccaccctaggacattcagttatggaaacattctgaaccagatttctgtcactggcaattatctgaagaggctagagggcttagccgtgacttgttaaattagagcaagtactctctatgtgtgcatttctaccatgatcacttcctgtatcgattttttttgggcagattatgagtaaccaatttctccctggctgttctatcacaatgtttacatcttgtgcctgggaagtggcactgctttcctcattcctttattcagtttcagagtaccttcctcatatgagttagagcttctcatcttctgctcaattactctctggtccttttatttgttctgtcctcttgtcatggtgttatagcggtatttcgtcttccttgaggatatcacgtgtcactgtctgctttgtatttttgttgtgtacccacagttctgtaaattaaatatgagtgagtggttatggccaggaaaatcaatctttaaacaaattaatatttcaatgccagttgtacagctattcctccatttaatgtgtgtcttggcttacaaatggaggacaaagaatgtatcactttggaaaaacttaaatcaaagtgaagataaagaaagcaagccaaatatgccataagattttgaatctgagtgttggaggagagctagtgccttaattggtaaagtccagatattttaagacaaacagctgcacctttatttgatttcttttccggccatatcattttcatgatatggaaagtagaatatgaatcaccatacctacctaaaattgccaaatacaatattaggacaccacgttaaatttgaatttcagataaataacaatagtatgtctcgaatactgcatcaacatacttatactaaaaaattattagttgtatatctgaagttcaaagttaacgatgcatcctgtattttttcttgctaattctggtaattctaccagatacggcagttgtgagaaattaaagcaatttcctgagataatgtaaatggacggatctagcataatacctaacacacaataagtaaatatattaatttcccttcccattactagaagtcacaggttgtcattctgataataatattttttattcagagaaatggtttagttttgagagctttaacaccaaagacatgctactttttattttttattttcctaaccttggagatatcacatttacttccacaaaattgttttaaggtttagttctctttacatctctagaaaatcaatcactccccttctccatttaaaaaaatatgtttaaaaaagaaaattattattttgtttgcagcaaaagaataatttttctcccccaccagattattccaaaattaaaatataggcaagaaatgccagatattttgaaattttcatatcttgattgtacctcaaacagggtatttgtggtaaatgcacatattttatttccttttctgtctaatgaaagatatttctatcattatttgtaacagttctaggcatggagccagcacattgattactaacaatttaaaagaacaagaagagttgtagtgttagggccaagtgaaagtcaaattcaatctagcaaattttcaaaactgaactaacacttagggaagtcggctctctcttctgctcgtgggagcattgtaagttttctagaaggtggactggcatatttggcttgctttctttgtcttcatatatatatatatatatatatatatatatgtgtgtatatatatatgtatatatgtatatatatgtatatatatatgtatgtatatatatatatatatatatatatatatatgcattcttctgaaatgaaccacttctgtagagagagagaaactaaactgcctcagctctcatcgtttgcttgccggacctcctttccagccccggtccttctgcccagactgtgaactccataggagcaaggtttatcttattttttccttgtatgcacagtaacttacacatagtaagcccttagtaatgatttgcacactaaattaattttgaatgaactgagtataggatttggttatcctaaattaattttttaaaaggcctctaaaagcacatacccttttgtccaacagttctataaatttatgccaagtacagaggactttacatttgcaaagatatgtgataaggatgtttatcacaactttattatactactgcaaagtgcaaacaacctaaacatctactgtggagtgaactgcgtccccctgcaaattcatatgttgaagccttaacccccaatgtgttggtagttggagatgggacttttaagaggtaattaggttaagatgaaataaggatggtggagcccccatgatggggttagtccccttgtaagaagagacaccagagagcttgctctctatctcatcctgccatgtgagaacatagcaggttggtggccaatcacaaatcaggaagagacccctcagcagaaaccaaccatactggcaccttgatctcagatttccagtctccagaactgtgagaaaacaagtttttgttgtttaagccacacactctatggcattttgttacggcaacccatgctgacgcagaccaatatctaagagtaggaaattggttatataaatgatagtaaatacatacatagatgattgtgcagtcattctttagcagacttgtaatatgggaacattttcattatgtttaagtgaaaagccagactataagacagtattaactatggtactattttttataaaaactaatttatatacacatacgacatatccaatttattttaaaaatacaaggtcacatatcaaaatgtgaacaaataattgtttctaagagattgaattacaggttatttgtctttcgtttttctttgtgcttttacaagttctgcattttaaatattttttacttttgtaatcaggaaaatcaattaagagatttttttgttggttgttgttaatgagccaacatccattccaggaagtgacattgaaaatgaagaggcagctcaggaggtaccttcaggaggtaccttctcagacccaggagtcttgctgcatgagaacagaaagctcccagctccagccagtagcctcttgatgtactaagagacagagttcagagctctgatagcaacgtgaacctcacctaatgaaaatgctctctatttgcctctctttctgctttttatctaatcactattcacttgccaatttcctggatatttttgctcattggattaaaaagactagtaagctaaaaaagagtcaggaaatctttaacaagtagaagcagaaagattttttaatgagctaaagagacctttagaaattgaaacgaaatgaagagaaatgtttcaagcagaaaatgacttggcttttttatacgtcccccccagacctattttaaatccccagtacactcactcatttgcctaatttccacacagtttgaaaatttgtttagctatcaaatattttagcaataaaactgaaaactcagaaatagggataagggcctcatcttcccttcgctattgtagtaagctcattaaccaagacttttgctcctcttttctttgttcttttttgtcgtacagctcattatagtagcacatatgtataactttactgcagtgttataaagtggaagcatttttatagcttacattcaaaagccaagtagagctaccagtctatgtatttgctaggtgaccctcagccctcagcatagataaagtctttataccttggcatcttgtttgaagtattggcaaagtctgtatataatgggaaaggctgtggttctcttacattgtcacaaagtatgtgaaggaaccattagccaggagaattacatggacttcctgtgaaatggctgatggcacacaaattcatagtacaataagtcacaaggaggattagacaagagatcatatatcatgactgaaaaacacagaatgtaacattgaagatcctttatataagaaggaaatagacttgctagtatttctaggaactgattacagattctttagctattttaaagcatagttttatggagtgcacataaataatagtcttagcaatacggcacatttttccatttatagactttatttgactaccagaattatatatccaaaaatgcaaggaaaatgaaactaatttggaaagcataaaaaccagttcaaaactgcagaaaacagcatgcagtctccttgttgggtaacttgtaattgtcctgttacctgaaccatgttgcagttatgaaaccttgcagaagaatggaggccaactctccttttaattccagggcttccagaaatgtccctgttctcagtttgcctctgttttccagacatttctgctcagtttttaacttgagagaatggaaataaacgttaaccccatgtattgttgactaaatattcgggtcaaatatctgtattatttataatgctttcatttagcctggttaggtatggcactcagttattcctcacagagaagctgatcaagaaatgtcatacacggcattccatcctattcctgttaatcctgctttctggtcttgtttctttgatctatacattcatctataagagctagattaatgaataatcattcaggactagttaaaacaaagactagatcagacaaaccaatgaacacctacatgtattatgtttcaagcaccatactcttctaaaatataaaatgagactgtagccatggtctgtgacaccagcagatgtagatagatatctatgatataatatataatgtgatacatactataatggaggtattaatataaatatgggaaaattagctgcacctaaattaataattaattttttacctgtaaagcaaagggagaggggagggaaagtaatacaagagaagttactgaaaaggagtaacatttagactgggcctggaagtatcgtgaggtctttgccagagaaagcaacacagggtattgcaaaaagagcaataaaccatttgtttataactgacattattcttcaaagaatttgaggtgaatttaagttaagtggtttatcttgcaataaagtaaataaataaaactttagtgttaggaaactataaacaagagtacaacgttaaagactgggtttagattaggatgcatgtgaagaccatgatgtctttcacagttaacaaaaactgagagataaacctgtgtcctggcaattaaagtgatcaaagaaactctttgtaacttgggatcactatttagttgtgctccagctctgggtgtcagtttgtcatctgcacaatgaggagttcccactgcatggagttgtggtaaagatggtgtaaagcacatggcccataggaagtgctgaggaaatctcagttgaccttcagacctagtgtccattgactttgcatattgttctgctaggaatgcgcaccaatactattccagtggtccattttctatttttttaatttggaaatattactttgggcttctgctccagcattttggatatagaggaccctgaaggttaaaaactgactcttaaatgcaaactcacagggaggccaatttcctgaccatacacgggttctcagaaagagaaatctgcagtaaattgtcacatgtgaagtttcacttgatatcagtatattccagaacatcctttcctcttagcaaatgtttgaggaagacaaatccattttatgaagtacgaagacagttgacaatgttcacaactccatctcctaagaatatttgggtcttgccgggcgcggtggctcatgccagtaatcccagcattttgggaggccaacacgggtggatcacctgaggtcaggagttcgagaccagcctgaccaacatggagaaacgctgtctctactaaaaatacaaaattagttgggtgtggtggcacatgtttgtaatcccagctacttgggaggctgaggcaggagaatcgcttgaacccgggaggcggggcttgcggttagctgagatcatgtgtcattacactccagcctgggcaacaagagcaaaactccgtctcaaaaaaaaaaaagattacacacatatatatatacacacatacctacatataaatatatggtcttaatggggggcagagaataaacttttaatttggtcatttcagttctttgataaacatggggagagaaattttcctgataattctgtggtgctgttgtttttggtgttgtttaatgtaaagttccttcttgatgcccgtagacatcatcccacataggaagcccccaattctgtctgctcctgaggggagaacttatgctatacattagtagcaaaactttcattgtcgcctagagggtgggggaggagttgagcttgttaagggccaactagagccaaaagtacatttatagttttgctttcgatgcatctccccttgcgacttttcttttctgtaagcagtcaactgccattccaaatacatttcaataaattttaacctggatatctaaaagagcctttgatgaaatctagattaatttgtattaatttcaaattaaatgtcaattgaatactaaaatcatattaggaaataacagtgtatcatgcttatcttaatgattgattaattatacctgttgtgatttgccttttttattaatctagcaaagtcttactgagttcataataaggcagtaactcacaaactaattcatttgtcctggttccttcacagtcaatgtcatttttttcattttccctttttaataaatattaagatgtgaagggaaaaaagcaattagctctttcttagatacttttactttgaatactgaacctccaaagataaaatggcagagttaaatcatctaagtaaaatatagtatgtgtagagagaaagaatatagcatataattttttaaacatcagaatcataacgtgtaattaagcccaatgttgaactactgaagaccagccaacttggacaatttcttataatcgtatttttaagaaattgttcagataactctcactaaaacaaaccaccttagactattaaaaaaaaatgagaaaacttcataccagaagaagatgttctcctctacaaaagcagtggtgcaggggtttagctttcctgaccaggaagccatggttaaccgttcttcctattccttcccttctgttgtgtgtcatttcactaagggctaggaaatgattgctggatgtgagatgtggatcctgaatgattctgttgcagtggccagaaactcacacttcaaagaactggtctataaaggtggattggatggaagggtgagtgagtgagtggggaagatggagagagtaagaggaaaacatcttgcatcgtacatgtattatcctatactttcagaggatgaaatgttttggctactcacatgtttcacttgcaagaaagtcatcatatatatcagtgatgaatagttcacttaagaattaacatacaattaaatacactgaagacaaaaccatattggacataattaatttcttttaatgattcagaaggcatttcagaatctggcaatcctcattttgaacattaatcatcattgtatgttaaacatggaagtatctgccaagagagtttgcccattaaccaagtgttactgtgcttttaaaaatatttcacagacaagaagacagcagcttcatataaaagttactagtttaggagctgctttgggcaaggccacttcctcaaggataaatactgtgatgcagtgtggcgcttagtcacaagtgagaggcagtgttcaatgtgagtgtgaacatatcatttgacctttctcagcttccgttgcctctcaggcaatgtggaatgctaaggccactcctctcaggacaacaatgagaaatgaagaggagagaaaaacagatcataaatcaatatatgtcacagaacttctaatggaaagtgttctatgtttgtacagataattgattttagaaattctgattctttgatgtcatgcctggtaagctagatctttgccaatttcagtcttgtgagtctggggccactttggtttcctaggaaccagctgcctaaagattgtctctgctgaagtcatatgtggcatctggtagcacccatgagtttagctaattaatctttgtagaatagaaaaggtttctacacagttagatgtgagttccctgctgaatctcctccttcagatgccaagaggaagcctctgttggaagtcactgcagccaagtggattctatctggtacagggtgttttgtttatttcccacagaatatgttttcttttattctgttggccttgggagttgagctgtctgccatagtagctttcttacttgtctgtacagttgtctattcagaggcagcttattatatgtctagctgcaggtctttagttggaaggtgctactccttagctagaacctgtgagcactacagtttatcggtctgtcaactcaaactccaactttacaagtgaatgtgaggcagagcccgcttgtgtgacaagctgtagtggtgtagtgagtcttcactcctccctgactctgctgctgagaggcagcccacaggcttctaggaaatgtctggcaacattgtgctggtcactttctatcctttgaacatttagacattgcaagaatatgtgactaacagaattgagatattagttgatagctagatttgtttttcaaaggatttttgactgcaagaattgatgagctaagaaagtacttagaagcacctagccagcccatatttacagcaactgagatgtttcagccattgctggtgatcctgtggacttggggaaaggagtaggttgcataagcatgacttccatctattaactgtttttcaaccatgcttgagattaatattaagtataaggcattatattaaaaataagatgtgtaagagcatcttgtacctctctaagactaggctgcctactcagccctggtgctatgatggtactccatgagatgtccctgtcataaagtatatcatcctgcactatcacttacctgtggctcacctctctccccaactaaaatgtaagcactttgagagtagtaattttatctttgcatctccagcacctagcactctgcctgatgtgttgaagatgctaaaaaaaaaaacagaacagataaatgcatgaaaagataaattaacatgtaagagaaagggagtaaggaggggaaaatagagagaaggtatggaagaaagtagaacagaaggagggaaggtcatacaaacgtgaaggttattgttatttagtctgagcagatgttatactaagagttgtaacttcatttatcacctttaagctatgtgttcacatagtgtgttcagttttcaaataaagatttagcaaaatgatatccctttatttacttttcacttacattgtctttttaaaatacaagccaactagattcaagaattttgactttggctttggtgagacaaagtgtagataattgacatactccacctcaaccaggatggactttcaaccaggacatgcaatgagtcttccattcttgaccaaacaggaggcagcctagcataatgggtgaaagcatgggttctgcaatcagatctgggttcagagtctactctaccactaattaaatatatgcccttgaatatgtgatttatctgagtcatcatttcctcatctgtaaagcagggattataatgactgtaatataggactgtcagcagactcaatgaagttttgcctgtaaagcattcagaatggtacccggcaccctgtagacatgttctacatgttgacactccaaaaccatccctttccaggaaggtagtcgttaggacagcaaggaagaggagtgttctgagctgatcaccccaagctgcagtttctgattgtagcccctgatttttgatgtagccccccgtttggtgtggatgactcggaaggcacctgctatgagcactgaattcttggaggtgggaagggggacagggtggttggagggggaagcctgacattgaagtgaactaaatctgtgcaagtggctatttttgtcagcccagccacagtgggtgtgtgatcgggcgtctacttttgatccagctctttttatagatgctgctttttcttaaaggcaactctcctcaatcgtctcccaggctgctgagctgatttggaagattgcttacggagtatttatcatctgcaatctggaatagaaaacatttatattagtaattagatactcctttaagatgtaaaagcagtctcattatcaactgtagcatagattcagtgtaacggtattttatccataaagactacaaacacagcattatcatttcaaaggtgcttcatattgtcagcctaggctcaacctgtacaggcagctttggtgaaaataagagccaacatcagtacatcccagcagcctattgtctttattcttataatgaaactttgacttcaaccatttcaaaatatgtccccattattatcactcagactggttcacttagaatcccctagttctttccaaagagcatgtatatgaagttacaaactgttggatataaagggaggacatctgtgtcatttggtgcttttaaatattttttaaagaattgtctgaaatcttccctacctgtattgacacactgaaaaggtatttttaagaagctggatgctactatgacgcctgaactacaggatccataatacgataccaggtgtgtctctggtaaccatgaatgaatattccccgggagaagaaagctgaatgaggctcattgccatgccccctgaatgtcttcaataccaagtagactgaacactacgtcttgaaagaggaaatcagtgtcagtcagtgaagacgtgctctaggggattacctggctgcatggtgcatggagcacctcataataacaaggaagattttcgacagcttcagataaaggtcagccatttcagaaaactctgaactcttttctcccttgttcttccccaccagggccaggcaggtggtccatgcaggcttgtgctaatgaattcggcagcttgtactgtaagaagtgcgttttcattactatgaacaaaacaggctgcagggggaatttgataggtggcttccactcaaaggacaagatgcatttatctgaaggcaattcagtggtttataatggaaagcagggcccctttgtctccttgtcacaatcttcctgtgagcatcaccatgattcatagtcaaattatagtcactttataccaacccagctatttaaatcacagactccccaatccaccgtcttcacaattctaaatggcatccaggagtgaagttccattatttaacacaaattgtacaaataagaattggtcaccaggaagtgacttttttttattatttcttgtgctttgctatagataagtattgaggcttttaaaagtactttgattagaatcacatcatttcccagaaagacattattttgctcataaaagtcattgtgtatcttaccaaaaaaaatggcaataatttcctatttccccgcaagaaatctgtacatcacccttgatactcagctcgggtaaaggtctcacatgcaaaaacagctgaggtgataatgtaacaaggtattgtctagatcagtgattctcaaactttactgtgtggtaatgtcatctagtacaatcggcaaaaattcagacactgaagctcattcctacttcatcaaggctgacctttctattctgtatgttctctccaggtattaatacatattggactagctaattttatttgcttagtatattaagaagaagaacaatcctggtctgtcttttgggagcagtagggcacagtttgtgtaggaatatgcatgtaatagacacagtatgcatagcagtcttttactaaatggattgccagtcccttagtcttttgatttgttcagatccaacaagattgctgttaatggatgttgttaagatgtatcgcagaaactgggcagagtgggccaaatttcatctttcatataaattatagcttcccagtaaatcaaactacaagttgatagacaagttgtttgatgattgctactgcttagagaatacggtatggaaacaatttccatatatttttgcaggcccacaagattttaatctgtgattccaaaattccaacaacactgaaaactgaaatatttctcaagttttacaccaaaactcacttgacagcaaaacttggcctgaactgatgtgaggctactaatagcctttacttattgtataattacacaacttaatgtgaattgaaacatttcactgaaaaaatataaatgatttggattctctgatggccatattatacaaattcaatatatataacctattgtccctctatcatttaaaaaaaaaagcttgaaatctaaaatatatctggccccaagatgtttggatatgaggttgtggaccagaaatatattattctattttgacgatggagaactggaggacttgtctcctaccttggttttatcccaagagttgttattagtaaaattcaacaagataatcagtttccaaggttcattagttgaaacctaaaatgattaactcgtcttaagaatccatgacaagtgttaatgttcattcattactcaaccatggattctccttacatttgtttgacaagatgccatgtttgaagcaaacaaaagaagagtttgcttggttttcaaattcatttcttattatcccctaccttccagccaactctttcagcacccccgcttcagtctctatctaacaagatacaaggataatgcattctaaattaacctaaagtttataactgaaattgaaataaaggtaaatacaatggtaaaaactgagccaagttaacataacatgtgattagttattttggaatgatgtcagagatttctttgggagcactctactgcagcggacctcaactgctgagaaatttaatattattcctgctgtagtaaatgtactggtgattgcttggaagatatgctccttgaaagaatatacatatataaatatttttctatccttgtatatacatttatgtatgttacatgttaacctaaataatttataattgtgctttacaattgtgcagcattgaaatgtagttgctattttttttttttgctcttttgttatggttgtttttgtttgtattattaggcacacaagaaaccaaggtgactgaaaatttacagttagtaaaaaatactctttctcaggatatttaagcataaaataagctttgtgaaagagtctaatgatagttctgattttttaacataagcttggattatagtttagtttgcaaataatttctgaactaaataaacagcaatgtacttgccttccaactaaggaccattagttgtgattgatcatatctggattttaccaactatattaagcaataaatgcttctttgggcaaaattgatagcctgttctgattaaaatcttggcttcaattcagagttactgtgggacaaggttacaccttcacagcttgtaaacatggctacttagcagtgttcattaatgcaaattagttgaagataaatgttctcaatagttgtatttaaagagaatgtagatccttctgtgatgttttctagtacatagccagattcaatgtttagtttcagctattataattggcaaacttcatggcagcatggaagacatcatgattgaggtattgagttgcaaattgagtcctctgcggtaagatgggaagattactaaatttattagtactaactagtagttggacgtggcaatggggtggactggggcaacagttgaggaggactgtcttgctgtaggttgaagaacagacaatagtctgcattccttctcctcagaagaatacacaaaactcagttcttcatggttacagagcctttaactcctaacatttgtttttcagattccctagttttgatggcatttctactataatttagaaacacctctatcaggtaccactaaaaaaatatccaaatgagatgcaggattttcctcattttggaaatggtggccctagacccactttagccttgcaccatgcatgtataatccaagaatttccagactatttatatcaaaaatatacccgtttacacaaattgacatactctaaaccaatatagttttcagagattctttaaaagagttctcaacttgagggcctctctgagagatggggtttgggtagccaatgctctgttatatgtaagaattgtgtattttctcctggaagatgatccataatgtccaccaacttctcagaggctccatgacacctcaagaaaggttaagagccctcattttagaggaaatggctacctacaatttctgaactacaaacatgtatctttctgcttttattagaagtttgtgccgacctttaacttaccctgaactctgactgtaggcaggaagcccctctgggaattgatcaccaaatcataacctgagtgctcattctatcaaaagtgacttctaagattgtttcctgatgcttaaaggactgttgtctaagttgtcttctaagatagcaactgccagccccaagtttgtttcctccttctcagctctctccagtgtttgcgtctatccttcagagccagccccggctatgtgtcactgaatatgccaatgcattaatgtggggagccacataaagcccttgatgccctctgccaatccctgggagaaaagcaagtcatctctactccactccttgctgtcctgctgtaactgcacacagttggcatgtggtgattaagattaattggttgctgagacttggtggttctggcaaaatgcagctcagtaccagggcacagagggtcaagtttgagcatccctggcaagataataatacactgaaccaagagttaagtttaaaagagttttatcatattaagtaacatctatcttctagccagagtttttcttcaataggggcatctgggaacattttgacataggatgtagttttcattttgacatcaagtttaataggtttttaaaaaaattatttacatattccaactataccatttattaggattaaaagattcttttctttctctttgaatttacctttcaagtaacaagtgactgatcctggctttaggatatattgtgggtttcagtgtatctgtttatctcacctatatcctatatggtttcatagatatcaccccataatcactctgacctactatgttctcactcaaagtttcttcttttatagtcaaatatttcaaccctctggaagaaaatctgcctaccatctgtctcctcccaacccccacccccgagaactggaattcatttaataaatatttattgaacacctattatgtgccacggtttcacattaggcactggggacaaaaatatcaatgaggtatggatccttactcactttttgaaaactatggtgacaggggaattagacgagtagagaagtttttcaatactttgtgaaattgctggcatagggttaaagacatagatacaatagaaacaaattggagggcacaaaaccttttagggaatagagaagacttcttagaggagaaaacttttaaagaaacatgtaggaattaagcaaaagcgagtggaagtgcatttcaagcagaaggaatggtctggaggtgcaaaaacgatgataaatctggaaaattacatatggtttggtatggctggggctttgagtttatagaagaatgtgctagaagatgagcctggaaaaataaatagagaccaagaaaaaggattccctaaaacatgccaaaagatttggactttgtcctgtagatcaaaggaagctttggaagaaatagaaagggtactcaatcatcagttctatcagtagtaccatattgttcacccttttattttttgttctgattgtttgatgggaattctaactttctaactaaacagaagagagaaaccacataaagttgtgccatgtacaatactgtacacaaaacagacatttagtgaatatttgctgattgatttattggaacagtacaactgcttctagatagctatactttgggcctagtataatgatgtaatgaatagcattttgtaaatactcttctgagagtttcagagtctgtctgttaagaaaaaaaatacttccttgtgaacgtatgtgttgtatcttctttctaaatttgcttgatattgatattctttgagcctggctaatattcaatggtagttaaattcagatcaagttgaattatttgtatgatgtttgaaattgtgtcatatcaaacaggtactgtttttattgacatattgacactgacccagaagagaaaatgaggtgatcattcctgtaacagattcagaacaagatttatggctaggggatataaacagggacccatgtgttgaacagtagggctcttggaatgcctcagatcaagattcagctctcaacgtaactggctaaggcttcaagttcttcaataagaaattgaggccactgtcccctactaaaaagtgaatatggcagaggaagataccctattaagccatagtagtcattcatatctcatatgaataggcttataaaacccttcccaaagagcaagttctcatggggaaaagatgagaggcccatgaacaaatggctgccaaaaggaaggggcagagcaggaaaaggcttagatggagaaatacaatcttgactttcttcacaatgtgcttccagccctgaactctcctttgaatgctttagtctgaattacagccaaagaaaatccctcagcctatctttaaatcctaaatactgacctttcttctcacaagatcttatatttgtcaattcttccaactacaatcaagcattttgaaatttatgtgacttaactattttttaatattgacaggtagagatttgcagcaagagaaaaatgaattataaattgttccatggtttacatcctgaatattgtaactttgggtattttaattgatgtcttagatgtctcacagtttgtaatctgtatttctctattctcaagacatgtttacttttcagatccattttcaaactgtgaactgaaataccgaaatactgttgattactaaaatgaagagttttctctttccattatgttttaatttcatgtgttttctatatatccctttttgattgtaatctgacatttcatagaagctgattctgaacacattgatttgaaaggaagaagaccagatttggagcctgccttccagccttgtattctgccacttccccacgagcactggcttgtgaactacctgcagtttctagaatgttccatgtacctttgtacttaggagccttacctttgaaaatctccttctgccctgttacctgctaagttcttactcagcctttgatactcagttcaaaatcaactctttctttactgcccaggtagaattagtgactctcttatctgtgcatatatttcttttcttattattattatttcaatagatttgaaggaacaggtagtgtttgattgcatggataagttctttaggtgttatttctaagattttggtgcactcatcacccaagcaatgtacactgcacacagtgtgtagtcttttattcctcattccaccccctcactcttcccccttgtcccaaagtccattgtatcatttttatgcctttgcatcctcatatcttagctcccactggtaagtgagagcatatgacatttggttttccattcctgacttacttcaattagaataatggtctccaattccatccaggttgctgcaaatgccattattttgttcttttttatggctgagtagtattaaaccacaatgccataccaccttactcttgcaaaaatggccataattagaaaatcaaaaaataatagatgttggtatggatgtggtgaaaagggaacactttctacactgctggtgggaatttaaactagtacaaccactatggaaaatagtatggagattccttaaagatctgaaagtagaactaccatttgatctagcaatcccactattgggtatctacccagaggaaaataagtcactgtatgaaaaagacacttgcatgtgcatgtttatagcagaacaatttgcagttgcaaaaatatggaaccagcctaaatgcccatcaaccaacatgtgcttatatttcaaattgtgtatatttctgctaccctgtttttacattatattgttatggtttcaattaaggcttctttagattttgccatagtttaaaactgtatttgttcaccattgatctttgaatcccattctttccatctgagtagaagtttctccttcttgaagtacattctttagtaattcagcacaggtctgtaaaaattcgtgtagtctttttctgaacatgtttataatattgctttctcacttgaaaaacagtttagctaggtaggggttgtctttgcttaggattcctaataccataagggtggtataaattaagactttacacccatggctggtgcagccttgggatttctatttatcactggagacacctcccacttcaccacatttcagagccacaggcagaatacgctggcctgctgcctctctggctggctgatccctcatgccagctatgggcatccaggtggcctctaacttcccacaccacaaataatgtggtgatcaacctcctcatccccttaggtacttgtatcagaagaacgtttcctgtcctcctgtgcgtggaaggggcattttctccagagacctggctttctgcagcattcttcattgcagcttccactcacatctcacatctcccatccttggcagagtgggccagagccaatgcacgggatcctgcagtcagcctatgactttacccatgacgtctgacgataaattcttctttcagacttggctctgtatttttaaaaaatgatagctacactttaacagcatttataaatgttgccattggggttggggtggaatctataccagctctgtcccatatgttcccaggactagaaacatggtatgggctatgtctcactcagccatgagcacctttcaggcagatgacgactcttagtcatattttatttttaatgaagtgcagtctacatccataaataaaagaaagaggacatgggctccaggtgaaaccatggatatgtcacttactagtattagaatgatggcctcagcctgttcatatataaaatgaggaccttgaattgcagctaaacattctgaaagatattttctagctgtagtatactatgactttaagaaacattaagacaattccttatgaaatgttagacactaaagttgcctgtccataatcgagttataaatgtggcaatattctaggcagttatggcccagagagaaaacacatgactacttgtgtgtgtcatctctaactgtgacctgtaccttccctagtatacgttgagtgtgttgcaaaagactgcgtgtgtttatctagagaataaatattcaggtggaatgccaatttccctttaaaagcacattctttgtttcaaaagactgtattggatggcagtttaaaagggatcgcagctagttaaatttagggtgttgaacaaattccaatccaagaataatccttggcgctgagcccatggcatttttatttgattctaaattggataaattgtaactcatttaaattacttgctttctgtattttttcttctgagacaggcaaccaaccaatggtattttttctgtctttcacaagacagtgaaattatgacatattgtatatatactatcacatttcctgtaagtttcacatattattatacagattcaactatactttaaaatatgtcaatcacatcagataaaatcctactaaaactttgcccttagaaaaatatgagaaaataattgctccataagtctttttcctgtagttaagatggccttatatttcataatgtagttttagtgaattcgggagccctaagtcttattttcctatatatttttcaccaatttctttatcagattttgtattcttctttttattgggcggggggctttatgcttccagagagacaatattaacttttaaaaataatataaaaaaagaaaccagccttttatctattttgttgagacggttgaaagtgatttagggatactatttgaaatctgggagaggatagatccataaagccgggaataagagaagaccaagtgcaggactttgaatgagacctagtagagagcagaaggagccacagaaatgactgcagtttgctctttcatatgtgtatgtgactcagtttccacagtttcttaagagaagaaatgagtattgtgcatttcctaaaagcctcataccacctaccacagtgagcagcacttggtgaatgctattccaccattcatccagtaataactgccagttactattccatgggccaaggacacagtgtaaacaaggtagctgtaaagcccatgtcatcacagtgcttatgttagggttatttgtgtgggagaggtggagacagaaatatatttataacaaaatataggaataatataatatctgtagcagtaagccctttaaagaaaataagccaagtaatgggctaggaagtagctccaggatggggctaaatagaggaaagatggggagcctttccactccctctggatacctctggaaggaagtaatattggagctaaactgtccatgctgagaaggaactgccacgtgaattgcttagggccgagcatcccagagagaaaacacaagtgccaaggacctgaagcgagaacaaactgagaacagctgagcagtagtaaaaaggctaatgtggctggagcctaaggcacaatgacaagaaaaagccataggggtaagccagatcctgagggcccacagccaggaaagttgtttgaaatgtattctctttgcaatgggcttataggctgccccactggatcctgtgtgtcttgtcctcccactgctgtggctactgccagcttcgctgagctgcatggtcctggttgacagagtccaaagagacttaggacataggcagaaagaacccagcacactgctactgcagctctctctttcacctcctgaattaaatgtgcatgttgggatccctccacctccctgatccagagagaactggtgccaactacccaccccaccttgggaaagaaacctaacaagtagaaaagctgcactaataaaataaatctgcaataaggagtttttttaatcctaaaaatatgtgcagtgttaattaggagagaaggaatgtaagagaaaatgaacatgcatatttttatggcatgcatgctcctagttacccaggggttaagggcacagtcctccataagactgtcctcatttcagacaccagccacaaattcagagccccagagccacgctcactcatgaccaactggccacaaattcaggcattcctactacccttgtaggtttgataattgactagaaagaactcattggaagcactgtgtttgtgattatagtcttactgaaaaaaatacaaattagaacatatacacatagggcaaaatctagggtgatttcaaccatgaaactttcatcattcccctctcagcacattgatatgtgacagtatgcagcgatttgccaaccatggacattcaacctgggcttcactgtccagagtttttaatggggttttattaaataggcaagactgattggataagagatcagaaggttgatctctgatctccagcccctgctgccctccccagagatggagttgatatcacctggcttggagctcccaccctttaatcacatagttggtcttcctggcatagccagtcccctcccttcctgagtcacttcatttgcataaactatcaggcaccggctcagaggcccaccatgaataacaaagacactcttatcactctgaaaatttcaagggtttagaggctacctcccaagaaccaaggacaaaagccagtcaaatttttgcttgcatactaaaactctcaaatcagatttgtaatcaattatctgttctgtgtactagtcctgagtacaatttaggttgcttgagtattgcagaagcagtacttgttgcttgaatttcatggcaggctagagctgtgggatttaaggcatcattataaagtactacagatttttgttattcatcctaggcattaagcacccctttcccaagcagtatttctgtgtgcttctttcctagctgacaagcatcatgatgctactacctctctcctctaccaagtgcatgttgtatatttgcctatacctggcaaatgttacattgagcagatgacatcaatattatgaaaagtggtgaaaggcaaccctagcttgtccttttgtccaattgagagtggtcataaatagaacctcaatgtccttaacatttagaaccagaagctgctgaaaactctttaaaatgttcttgtctactaaagaaaagacaccaacaaacaaagaaatataaaacaaacaaacaaacatgggtgactcaatggggagatcatgcagagaatttcatgtctgacggcctaatggtctgggagacatgtggcttcatctactggttttccagatgaccttgagcaatacacagaaactgccttctgtgcttcccgacatgtgtgacagctgtaaggtacagcctcagaatgattgcactgctctttgaacggctgcaatatatctttctgtgattgctgggcctgcactgacctgaagaactctgtgggagatgatggccacatgacggctaatttgaggtggagagccacaaaattgaatcacccaaatgtttccaagcagtgagtagaccaaccatccagaaaactagattttcttcaaactaaattttattgtcttggcgcctcagtttaataccccttctcactattccagttcattccaagtgaaggtttttctgatcacaattcctgaggaaatctgatgtcatcttaatgggtttagtggggtgttttaaaagggtacctgggatttgtttattgagatgtagaaagacaaccgacatggaaatgattgtcatgaaagaagtttttttatactcacagatccctagaaatggaaggcatgacacatatttcaccaccacaaagggaagccccaggggctgtgtcaggaagcagagggagagggaagaaaaaggagcagaagccactgttgtggtttctgccaaaggaacgggcaaggcagggcaaacaggtttagtactggctagtttgaataatttcagcaggctctgggaaagaggagctgtccctagttgcatggtgcctggccccatggtgattagggcagatggacagtgagtggcccagatcgtaagagcttgagctccatagaggaggtggttgggggtatgggctctgactggttggtttgcacatgaaaggcaatctccaagacaagttgtgtactgtctgtgacagaggcattccctccagggtcagtccttccaggtcagcaaggtctcaaatctcaaagtgttaccagaaaggggtcccaatccagaccccaagagagggttcttggatctctcacaagaaagaatttgaggcaagtccatagagtaaagtgaaagcaagtttattagagaagtaaagaaacaaagaacctaatttatttcctgaattagagattctgtaggttctgtatcaataaaaccccttgactttgcaaatccaaaatctgaaactacagtaagaaaatatatttctgaaagaatactgtgattatttctaaaagcaaaggaaacgaacaagataattgtcaacttactgtaatattgtcatgcttagcataaagttcaaacctagatgatgcactttttattttagagagcaattgaaattatatgttgacacctttttatccactcagtcaaataaagcaactgcagttttcttctgtttaggaacaatctggtgcttccatcttcaaaactgctatttacttatcaacagctttgttcagctcccctgctctttggtcaagtgtgaaattagaatgaaaacagggtggtacccacagatagtaagataataaaaaaggcaaagaaggagtaaataagatgattagaagaaataagcaatataatttaaaagtggacatggattatcttaatttaacatgagtttaatttttattgttataacttctttgaacatccttcatgttaatttcctcattggttcaagtctcattgacctgaaaaacgtgaagtattttttttccttctgaagacacttactgaagtaaatgtagcctctaagatgattttatgtcattcagccttgttctatcagataagcttcaacagacctcccaacctttctctgttctggatgattgcaaaccaaatccattagaggagcaaactgtcattgattcgttttataatattgaattttgtcatgataaatctcatgctatttttatttcaaagatctgtaagcattcagtgctttgaggggaagggtcttagagaagaaggatgaagttaagtaaattaatatttttccaatcctactgaatttacagagtactgaactcactttggttttttttttgttgtttttttttttttgaaattaaaagccaaaaaccatggagttttattataatggtttattcattttaaaaatctctgattttttaaattttatttttataatttatttactctttcttatttttattgacaacaatattatatacttattgtgtacatgatgttttgaaatatgcatacattatgaaatggctcagtgaagctaattaacatatgtattacctcacataccatttttttgcagtgagaacacttaaaaatctattctctttgcaatttttgaaacacaatacattgctattaaccacagtcaccatattattcaatagatgtcttgaacttattcctcccgtctaactgaaattttgtaccctttgaccaacacctcccaacacccttcctcgtaatggttttttctgatgtacataatgtgtatagtactccagaacctcagggtcttttctagtccactcatagattctactctgaccaatcattttcgttttcattttatttatttatttattttttgagaccaggtctcactctgttgtccaggacagagtgtgatgatcacagcttgctgcagcctccaactcctgggctcagttgatcctcatgcctcaccctccagagtagctgggactataggcacatgccaccatgctctgctaatttttttttctttttagaagagacgaggtctcaatctcattatgttttccaggctggtctcaagctcctgagctcaagcagtcctcccaactcagcaagggattccaagagtgacccactgtgagtggcctgaaccagtcattttctctgagagtgtgaaaaaaatgatttttagctggtgaatgtgtttttatgataagaaatgatcattgtatttttacggactccatatataatgtcctttgcccatctcagcaaaggaacaagaaactatttttaaacataaatataaatacttataagccaacctacttattattgcctagaactattcagacaagagaggtaacattttacacccaaaaaaccatgatattgctttaaaagatttttttactatgtaatatttggcgtatacaaaaaagtaatatatatatataatataatacatattacttttttgtatatgccaatatatatttgtatatatacaaatattatatataatatatataatatataatataattatatatgatatatacaatataattttgtatatattatatatatttttatatatatatacatccatgttttaaaacataataataaattaaatactcatgaaccaaccaaacaaatgaaggtgtagaatattagtaatatctatgtgccccttccctgcctccccacactcacagaggtccactagagtgaattttgtgtttatcaaagattttaccatctatatttacagacttaaactacatactccttagctgtgcttcttgttgagcattataaaaagtgacatcatacatagtgtcatagtgactctacatggtcacaactgtatataaccttctgtgacttgctttcctccataacattatgtgtcaaatatttatctattttgttacatgtcactgaacttcattcattttttcctattgtacagcattctcttatgtggacatcacaatttacctgttctcccagcagtggatatttgtgttgtttccagtcacttgctgttatctcagtgcttataaatgattgtttctcttacacccaggaattccattcctgggttatgggttatgcttattatgctcacctgcacagttgaatttcaaattgttttccaaagtgattagacctccttctccttcatcagcaatgtatcccattggttctttgtatgtcaaacttagcagtctaaggaataattaatgtttgcatcactgaactgattgggaatacttgtttctgtgagttacttacttttcaaggtctccagaggagactttcaggccttagtaaggtcattacagcacattaattttgtcttctgggtttctttacttggttttactttagtttgctcacagatgccccttccaaccaagcaccaggtgcttaaggttttcttccataattagttccatcaacagtttttgttttttatttcctgaatacacgtgcgttaatggctacatgtactttcctacttatacaggggcaataaccaccttatcaacagtaataatattgactaacatttataaaaatcaaatgatatcagtcactcacttatccttctctccagtttcagccaggaaacaagtgaaatcgagatatgatatcgcatttctgcttgtaaaattgcgttggagaaatggaaaaacttggccccatccttattcaatctgtctccagttactcctggagaaacttaagaaggctaccctgcctgtatcaggggtcaggccctgacttgagaagcttgaagcttggtagcaagaagctaaggaggaaaggatattcagcttcaagggatgcaggtaggaagcaggagacagagacagacagacaagagttggagacttaggatccctacatttcagtgtagcaaccccatctctggaagccatggcccattgcaagccagactcacaacaatcacatagctcttccctcttcctatggaggaaatggaccactctattaaacactctgtatacattatcctatttaatttgtaaaacattcttatgcatggatattaatatttcattacaatgttatagatgaagacactaaaagattacagacatactgataatttcatagctaaaagtgatagagctgaaatttgaactcaagtctattgacaacagaacccaaaagtttagcctcttccctatactgcgtcttcttaacaggaaccttctggaaaccctgccttcattcagcaaactaactatgctaaggtaaagacctggcaccaaggcaagtcataaggagatgcctcaggacttcttggttcccctaaaaatatatattgtgcaatcgtctttgacttcagaattccaaattcagcattgaaaaactagcttagtaatgtttccacttagacattttagtacttaattaaatgaatacccatgtgaggcttattatgtgcctggaactctttggattgccatctgagcccccacctacatgcacatgtacacacatgaacacatatacacatatgcccatacacacacaaaatgaaaaaaagacatattgcccaccctcaagaagtttgaaagctaatggaggccaggagggaagaaggagaaaacatttcatccaacaactttaagtgtcttctttagacagagcgaggcctgtggtgtacctgggagaaacatgaagaaggagatggatgcaagaaatattcaggattcaaatgattgggtagcccagtgcatattggtgtgatagaagtgaatggtgaggtctgggtgaactccccactttcaggcttggatggccaggtggtatcatttgccaggaaaaataataaatgggggaagaataggtttaagggaaacatggttagttaaatagacaagtgtgaaaatggctgtaaaataaagccaccatgaaagatgatcataaaactctgtagctattaccatagaagctatgatagttaatttcatgtgtcaccttgactggatcagaggtacccagatgtctagtttaacattatttctgggtgtattggtgaggtgtttctggaggagattagtacttactccgtaaagtagatggtcctctttaatgagagtgggcatcatttaacctattgagggtctgaatagaacaatatgcagaggaaggaatttgtccttcttttctccctcactgctggagctgggacatctcttctgatcatctactgcactcagactgggagttacaccattggctcctctagttctcaggccttcgggctcatactggaagtacaccaccagctttcctagtctgccttgttcaaggagcttagagtctagtccaacttgtagatggcacgtcgtgggatttctcagcctccataatcacatgagctaatttcttattttatatgcatatatcgatatagatatatttcccattggtctgctctctggagaactgtgaataacacagaagctaagggctttttaccaagataaatgatcattactccaatttccaatccttccaagatatcacacacactctactcaggttcttccaagacactgtgcactgaactctcagacaggacacctaagctctcatgagttcccatttgcttccttctggaatatcataaaatcagtgctgacatttagatgacatatttccatttttttagcttctgagacctcagtctatgaatcaaaatgttaagcactgaaggagagattctgtcctgaatatgtcaagctgacaacgtgaggaaatatgcattcttcttaagactgctgtattttcttcttttagaggtatctggatagcaaacctggatctttgaatagagttgaatagatttttgttggtaggagtggtggtaaaaatccatgttttcttcagaacattaattttcattcattcattgtttcctttgacttaaagtctttagttctgcttactaatgagtttacgttgataccacaatatgatattaaatatgtgacataacatcataatgatcattttagcaacatcagttttataatagtacaatcgaacacatttttatttagcaactcttatgcctggcaatatagtagtgaatcaggcaagcgcagtgtctgccttgttcaaggagcttatagtctagtccagaagagtcattgaaaaagtagttgcagttgggttgagagttacacactgggaagtacagaatgctataggaacctggaagaagaggatgtaaccaattgagtagcttgtcagtagcgaacagcttttatttgaccctcatatcaactatgtgcaataggttatcccattttaagtttgagaaagcaggctccatgagcttgatagacttgccttcatagttaataagtgttcaggactagaatcaaaccttttgttccaatccccaagctctttccactaaaccactgcagaatagcaatcatgatttagaagaaattaatcctaggtatggataaaagggaggattagtcactagccaatcaaaaattagccttagaaactcttcctttttcctctctagtcatccaacagaacacacattaagcaatatgttcttggtgattttctgcttatttgaatctgtgagaactgggatctggagtcctgcagcattgcacctgttgggtgaggggaggcgcctgcagttcaggtactgcccatgtggagcctgagaacagagtctccctgggaaagtacaaagacagattggctcctggcaagagcttggcctggaactcccttaagactcatcaagcccactctgaactggagctatcaagtttgaatagatgcatggaatcactactggaggactctgaaaaataaattgtaacaggccaattggggaacaagaccagaacctgaggtaccactatggcagtttctcattttcctatggaatttcgcagcctggaatcaaggcagcccaaagcctggaaggggaccttgagtatggacagagagaatgccaggagaagccccctaggtctaactcaagacatgcaaaagggaaaaccaatgaaattttttcctctcaattatttgcctgaactcccagacagttccattgcagcagccacaacaggagtctagtctgcaggtccctaaaaccctgagggaggggacccttccattgtaattcaaggagctgtaatcccaaaagggtatggaagacctaccacctctctgccctcttgcttagccctgaatgtaggtgcagttgcagcagagttgtggctagaccccagcttttcggctatccagaagacagaaaatgaataatttagacttgagtaaaatttataactgttatcttgcagaaatactgttaagaaaataaaaagacaaactgtggtcgaaaagtaaatgtttgcaattcatatatctgatgaaggacttgtgtgctgagcatataaagaactcttaagactcaggagtaagtaaacacattcagttgaaaaatcagcaaatcagaagaattccatgaaatttatataagtccgccctcaaggagagggagcagaactacccactccttgagtgtaggttgtgcataatgacttccttccaaagagtgcactatggaaagggggagggataactttacaatggagaagcctgacacacaccacctgagccagatgatcaaggccaacatcaacagttggtagaagatactcttggtaagatatgatgggaacggcatttttcctctgtggccttcctcccccaaacccacaatctcagtctaatatttaattagaaaaacatgaaacagatttcaattgaggggtgttctataaaataactgaccagtacatcttaaaattattacagtcatcaaaaaaacagggacgtctaagtaactgtcacagccaagaggcctaaggagacatgatgactaaaggtactgtggtatcctggatgggatgctgccacagaaaaaggacattaggttaaaggaaaggaaatctgaattaagtgtagactttagttaataatgatgcatcaacattgcttcattaactggaacaaatgtaccatattttttatgcaagatgttaatcacaggggaaactgaagacatgatgtagggggactctacaatatatgcaaatttcttacaaatctaaaactgttctaaaaaataaagtttattttctaaaattacattaaaaggcaaaagaaatggcaaacgatttgaccagacacttcttcaaggaggatatatgaatggcaaataagcacatgaaaaactgcccaacacctttgctcattagggaaatgcaagttaaaaccacaattagatattactacacaatacccgacagtacacaattctagaatccaagaggtcttagttgtcatttgtacccagtgtgcttacgaatgaaggattgctgcttgttttataaggcaactgttttggctttcttaagccaagagaaactttccattcttgaaagttcattgacaaggaaaacggttcccccaccgcacccaactccctactcactacaacacctccctgtgtgcaggacgggtataggaaccggtagcatcttcatcctgcagggaggctggctggggaagctgtgtccaggagtcctgccagcttgggaaagctggctcctgtagccctcctcagctgtacatatgatgctgctttctggccatgactaccagaaaaggtctggatcttctcacaagtggatcagtcgagaagtggtctgtataagcctcatgtgccaagaaaagcccagctcattgtagtgggaaggactccttggggtccgcagtcaggagcaggctctgaaacacctggaagcaggtcacagccttccacgaagcaggagccctgtgacaccacacaggctagtgagttgctaggagcagtggctccctctcacttcctgccattgctgctctatccctcccttcctgtctccctataccctgtcccatcacactgccccagtcctcagttatcctccactctgagtcttacctctgtgatatcttataccagtatcctatgtcctgtatatgagcttgggttttatgtgacagaggtagtgcaaagacagtgattggaacaacagtttagacccatggttcttgaccttggctacatacttgaatcacctatggagtttttaaaattccaatgcctagaactgccctggctaattataacatattttgggaaattgggagccaagcatcagtatttttctaaagcttcctaattgattccaatgtttggccaagcttaaaaagccaccgatttaatcgaaagcacagtagaggaaagtagggaagttattggtctagctatagcctctgacccttcttacagctcagttggaaagttcctgcagtaggtcaggtaagaggataagaacagcagtagtgatgaagaggtgggacagctttgagtgatcatgaaaggtggggtcagcagaccagagctttcaggagtcattgaatagggagtcaaagaggggtctagaggaggccatacattcagattttattaaatcagtataaggaaggcaggaagatgaggaaaatagttttggttgtggacatgttggatgtcacataattctggagctatccaggtggcattgtcagatgctcagaggagagttgggccagaaatataatttggaaatcattggcagagcatgatacttagaagcttgggagtcaatgagattatcttaggagagcaagtggagtggaaaggacagaaccttggggagcgccaatgtgcttaatgggagggcagaagaaaagccagccaagcagactgataaaaagagaaccatgagaactgtcatgaaagacaaaggagcagacagtttcaggaggagaactcagcaggtccaatgctgctgctagatccagtatggtgtctattgaattggcaatgtgaaggtcaatggggacttacactagagcattttagctgaccacaatggggttggagagggaaatgaggaaagggagacagcaaatacagattactcttctgaaaaacatggctgtgaatggaaagagagatgctcagtggtacctggaggaaaaggcagaattcagggaggaattttctttatctggtgaatttataaggtatagggaaagagattgaaactcttaccaataaagagattgaaactccaagagagagatgggtaattgatacctcaaggatccttagtgggagggagggataggtatttagagatagtggaactttgagcacaagggacccctttgttttatttattttatgtgcgtgtgtgtgtgtgtgatcctagagaaacaaaaagggtttcttgagggaagattatggtatcaacacacttttatttgagcctccttgtagaaggccagggttggcacaatgggggctgatgctgaagtttgggcactgacagcaaaggaaaagtgagactttcagtaacagaggagccaagatgtgagcacaaaccaaatcccaagaagtgctgagcttcaaagttgaggaagtcaagagtggtcttcaagttcaaaggttacaagtggggccaagattacgataccaagccaaggccacatgccctgtggggtgtgcatggcatggcagaggggaatcaaaggcataataaggagactcctaggagctgaggctttgttattcattacctggcctgaaaggagagcacaggaagttgagagattgccctctgcagagtggctctttctttctgctccgaacaaggcaggactcatggtgtctgatgagcaaaagggggcaggagtttggtaaggagactgcaggagaaaggaacagttctggaacggccactgagaagattcgaaaaggaagttgaccaaggacaaataaaagagtggtccagctgaaattggagactagcaatatgtagtggcattagtcctcatggttgagttattgtctccatttgcacttggcagcctaggtgtagcagcaaacaaacagcattgtgagatccatcctgccaggcaggtgtggcaaagtccagggtccaggcaggcaaggatgctggaaaagaccaagccgaacaggctcaaaacaaatgtgtataaacatagatctaaatatagccatgcacttacatagctaatgaatgactcacaattatgaaaattaatccaagcctgtttttagatggcattttctcacttttctgagagtaaaatctcctgtttgttttattcaagatgctcatctgctccatgtttattacacaaacctctgagtcttcatttccattttgaaaggagaatattctactctctcttctcattgttgaacggttatcaggcagatagcgaggtagctgaagttctagcggtacttttgcagtgagtacctaatgcttaaatagtgatttaattggcagtcattgaaaactcagggcccacaattctatattttttgaagaaagaacattggttatttcccatgggcatttcattaatggagaaaaaacagaactctgctgactaacctggtttgacatttacttaaaataagccaagtgctatttatctggattaccttattatatgccccagctctgttggataattaagggacagctggagaatgaggataaaatcatgccaatattttataagaagaacttttagggctccttttcctgtgtttaatgaacttagtctgaactaatgaaagtgttatgttggggccacggggatagagtggaggcagagggtaaggttgaactccctcttgttttaaaaagaaccttgcttattttaatcagtaaaaaagagggatagagggaaggatgtgaatcttttctgttttaatagaaaaaaattcgttcttggctcatttattctactttatgatactatattacataataaaatacggaaaatgaaactcgccctgtggagaaaagaataccacctctctatattcattggaaattaagacataaaatatcttaatgggaatttatgataaaaacccctgggtaatctgggaagaatcctgcaaaggatcatgcctcctataggcacttgctgtatgttaataggtggccatcagaattaaaatttggttctctgctccaactctgctgccttctttctcctaccactgttacccaaaattatgcaaccacactgtgcaaggcttggaaaagaacttatattctcatctttttgtgggatgaattaaccaaactgcaacatggcagatccagaatgctgtgatccacactaaccattaaaagtaatagaaatcaccattcctgtactttggaagcagtgataactagggccttggagatagagatagagatagagatagagaaggtgatacaaggttcagtctgccccagttctgaatggcatcctcatgggtaaggtggctcagcaggcaatcatcattcatgggaggatttatcaggaacccttttaggataagcccgttattcaaaggctaggagtgctgactggatagctgaatgagatgagatcagagtcaaggtcgggacaaagccaccagaattcaggtaaggtaaccagtgtcactggcagaagcaaggaaactcagtgtgattgggggtgtagtgtctagagtttggacagcctcttcctaaaacaaataaatcagtggtccacatagtcaaccgagatgcatgcttttacttagccttactttgtccttctttggggctttaaaagatccttcttacaaaaaggagacaagttgttgtaaggacaagcccagatgtcatggaaagtctacagatttggagccagatcaaccaaggtgaacctcagcctcagcacttgctactttcatggacttaagcaagttaactgacctctctgagcttccattctcttaacttggaagtgaggacaataataactacctatcaggctgctgtgagcattcagtgaggtaatgtatgaggtttctggcacataagagtgtcttaataaatatttctctttcccattcatgcatagacattcaaacaactgaaatcatgtaggccagtactgaagtcccccatttttcaaatggggcaggtaaaacattttcttgcccaacacctcaaaccatcattcccaaatttgctccctggaccagcagcaacagcatcacctaggcactcaggccccatcccagacctactaaatcagaaacacatgagatgggatcctatgtttcactaagccctccagcttattttgatacaaaatgaaatttaaaaactattgtatgaaggtaaatcagatcagtaactcacagtatatgacaggtatggagctcacaggcctcagttagcagcatatactaagtacagcctcatatttacctactaagattgacttggtgttggcagtactttactttgagctgcatgatcttggcctcaagtggggtccacatcatcatggtaccaaagtcctggacttggggagaacagtaatttcccaaattatttctactgtcagaccatatgttggatcacgtatcttaatcaggtttgagaaacagagctcatcacctccctgctgcatgaagcaccatcacctcctctttcccttcttcccagctgtatttggtgactgaatagcaagtggtcactgggtaacttgggatgcttttgactattgtacaacctcagattctcaaaaaccattatgactatcaacagcagcagcccagagggtaagcttccaattgtccttgatagtttagcctatgggtttagggagcaaggtcagtctgcaatatctgacttacatagtccagaacagaggtgtactcggaggagatgctgccccactctctaccctgcatccatcctgggggccctgcattgggtgctgcctcactgtggactttgaaatactctgcagcaggcgtctgtcatgctatgggttacctgcacacctgctccctctctcttctagtccttccatgtgagagaaaaacaaaatacagccttgagcttgaaacacatgcattcacaaatgagccccttccaacaatgcctaaggagatttggggaaaaaacccagctctttctctcttgtacacactgtggttgccaaaggataagcattgttctgtcaaggtccaacacttgctagagtgattgctggaaccttcagggaggagagattgtgtttataatgagaggaaaatggattaatcaaaactctagccttcagctgtcagcactagaatacaatatgtcaattggaatatgaggtggctttgacaagaataccatcttgcttgctttagtcaatcctatttggagcaacctgatctaagcaatgattttctctgcagcaaatgaatgcataccaacaaaatccattagctatgaaagttacggcattgattttagaataaaatactgttacaaaaaaaggaagtcatattctaatatctccactgctgacagcctgtacaagtctcaggagagagctacttgcaaaagtatatccccttcataaggcacagataacttgtatatcttaatcaatagcctatagactctatagtatagtatagagtctagtctataaataagatcactagcagttagatttatgttagaagtctaaaacaaaaatttgttttaaactggcattacttttggggtttagagatacttgtatttctgtaagttctttatgaaatacattgtactacctgccaatgagttcaatctgagtagcgccaccctcctgctctaaacaaacatgcaaccatgtcaccgaatttacattagaaacccatttcaagttaccacctgcttcgcagccaatgtgactttctgccagtgttctgtgatcgatgggggatgtgctgtggatttgaggctatagctttaacattttccaggcatgaatgatacgacatctgtacctattccagtataagcatatcagcaatctaaaagggatctgctgacatgtttagacaaattgccttaatattgctgaaagcaaaactgagaagaaaataatttttaatggaatttcacttagaatccatcccatctgagttctcctccacgcttaacatctccattactcaaatatgtggttgaatcactgaagtcctgtactgcttggcacagtttaggtgctcaacattgtgtcctgggtacacaatgtcttcacaccaccttgggccttactctatctgataagggatgcatcccttgatttcttcatatgtaaagtgaggatatacattattcatatccattcatagggatttcagaggattcaatgaaataataatatatcagggagcttgcctatagaaagtgttcagtaaatgttagctcttattattctgtgtatgccgatctgttccaagaagcctaaagctcaataatttgatgtttctgtttctccatttgagcactgaaaagctgactttgtttcctagtagctaaggaaaaaacagaacaaagcaaaaagtaaatcatattaacaaatatatatatatatatatatatagtgtgcaaatactcataaacatacatacatacaataagtgaatttttcattttaatggcaaaataaggcatatgtatgtatataggcagaaaaatcctttctttgaattaagttatcttcaacgagaactttgcaaagtaaaaaaaaaaaaaaaacagaaaaagaaatgcttttaaacaaactgttcttgggtcatttctatcctaaagctgaggaactgatatcaggtagtaactgagaaagggcttctctctagagtttttctcactaatgatgtatgttagctcgagggtagaacctgaagactctggagcagtgcacatagctcacccgcaccacttgggtatttcactaaggtgcagattcctaggcccaactgacacctaagaaatctgaatttccagggaatcctgagtctcctttttttttaactccccctcctccccaaggcaattacaacaagcaccgaagtatcagaaccactgattttttgctatctctggctacatgttgacagatatgcttttgaaaaatccagtgtctagatgggcatcggacagatgctggatcctctaaaactgagatggagctaaatggggggttggagcagttaatgaattggagagccatttgctgaaacacaaaacccaaggagagaggcaccatttggttgtgattatttaaaacccagacttcaatgtctcaaaaataatttagcatggacattggaaactgagtgtctgtgggtaaagccaatagtttccattgataaaaacagaattctttaaacgattactcaaatatgtggttgaatcactgaagtcctgtactgcttggcacagtttaggtgctcaatatgataaaagactaaataccaagaagaatgtattataagcttaaacaataagtattattgtaaaggcctatgtgccacactgttggaaaacagaaacagaaggtttcccagaggaggagaccctggggaaggagctgggctttggtaggaaggtggaggagaagcagcatccgaggcagagcaaacagaatatacaaggcacaggcacagcagagaccttgtcttgttcaggaattacaagtagttctccatgccaggagtcccatagtcccacagagaaagccacagaaaccagggccagtaaccaacaaccactgagatcctggaatatgatttcaggggtgaaagtggaaaggaggactcagctagatgccaatgaccttaaggaaagaggcgcagtgccctgagagttggcagagcacagtgacggagaaaggcaggatggataagatgactttcactgctggatgataggcaaccagcacctgactggagcagatatgggagaatgtgccacctttattcaagatttggcaaataacagaatgagggcctgcagaaggtaaggaggtggagacaacacctcacaaagaggttggagatgtaagggaactgtattccaaaggacacagtagaaatggccaaggaggggaccctaggggttggaagagctgaaagagggataaaacacacagggctcatggttctatcaactagtgtgatggtcaggaaggacagccatgggaaacaggcagtgccatccacttggcatccagttctaagtagagtctatcctgggccccaaattgccttttggacagttgatgtacacagtgtacctctagtgtacctcacacagtgagtaaggccccttgttttgaccatcatatatagtcttatattccatttgcctatgttctttcttagtaaagaaaacaggcaatagtaatcatcacagaataatcctacccaattcctgattgcttatgcacatatttaggagagtacgttctcaaatttatcaagagaaaatgagcactaagaggctggcttgttttcagtgcttttccactcaacggaagcatagaccagaattagtgtctattctgggcaaaatatatctgccaaattcacaaggagaaattccctgacaggagatgacaggagtacccccgcccagcacagagtacgaactggctatgacaaatattcttttaagttgatgaagttagtggttctcaattgcagaatatcccaggaatctataaaataggaagagactgacataactctgtttaattgtgaggaattttaggtctagtcatcagcaaaccttgtttctggatcccagttgcctgaactacactgcaggaaatgatgccctaaactttcactcattattccccacagccaagctgagccccagcaattaggatggactctcacccagagttgtctgtcaacagtttcctcctattggggagataattgctgggaaaagtccctaaacctgtgaagccttcagatggaattatctgacttccatttgtgtgctgtgttgataaatatgccattagtttcaccaccactatcttttctggcaaaccttattaacccaaatttaatggcaattctctgctaatttcagtcagtctcctttgtgctcagatgtagttaaaaggaatatttctccccaaaccacagtgagtgtagtcatatccaaatctttatctctgagaggctcctcagttttaacctctttcacaaaaatatcacaaatttaaattgtgtgtgttgtcagcaattttgagggtcagaataagtttaatggaaaatagtcactttcaagatgattgggacctctatctgtagagctgagataagcacagacaagctgattatcaaataatcaatatactgattagtttatttaaaacacataggtaatgaatgctatagtggttctcgaactgcagcatgcatcagaatcaccgtggaggacttgttaagacactaattggtgggccatagccccagactttctaattcactggatctgggatggggcccaaatatttaaatttttaacgcattacaaagtgatgttgattgctgctgccctggaaaccaggctgtgagaacttctcttttatcccaacaactattaatatcattttaaaattgtagtttttggtgataaattgatagagacagatatttttctctttcattcttaatgctgcttctcaaagaatggcatagggccaaatacacccaactcacctggatgcttgtgcacaatgagaggggtctatctcagatctatgaatctgaggccttgagtgatgaacaagcttcctagggacacctttgaactgccctgtgatgcttattctcaagccttggctccctgttggaatcacttgaagagctttaaagaacacagattcccaggtttcagctacagagatggtgatataattgatttaagtgcaacctggacatattgtgtaaaagcttcccagagattctcacatccagccaaagaatcactgctctgaaaggatagcctatgaacaaactcttcccaatttcttctttcttaaactatgttccacaagagaatttgtggtccaccagatgtttataagtggatttttctaatctaacacagccaagaaatactgggttaaacaaagttactaggttgtttgacaccaagatgcctcagggtccttaatatatttcttcacatcacaattttttcctgtgagatttcccaaacagtttcaccagggaacactttttctaagagcactttcttgagtgaatttcagagaaccccataaaattgtgtgtatgcttatatgtgaatgtattaacgcgtgcacttatgttttctggaaagaaacatattcatcagattttgcaaccagctctgaatatgatccatagatacctaggaaatactcacctagactgtcagatccatttggagtgctaagaagatctataaggagtatataaaggaaacagaattattccttcattgtctgagacatgtattagtccattttcatgccattgataaagatatacccaagactgggaagaaaaagaggtttaattggacttacagttccgcatgactagggaggcctcagaatcatggcaggaggtgggaagcgaaaggcacttcttacatggcagcagcaagagaaaaaaaatgaggaagaagcaaaagcggaaacccctgataaactcatcagatctcatgagacttattcactatcacgagaatagcatgggaaaaaccagcacccatgattcaattacctccccctgggtccctcccacaacatgtgggaattctgggagatacaattcaagttgagatttgggtggggacacagccaaaccatatcacatggtatatccaccaggttatctttacactaatacgtgctagttcctttctttctttttttaatatctttattgatatagtatttactataaaattcacttatttaatgcatacaatgtaattgttatagtatattcaccaagttgcacactcatcaccacaatgtaagttcacaacatttttgttccccaaacagaaatcccatgcttattaaagagtcacctcatcctctctccctccccagcactaggtgaccactaatctgtttcatataaatggaatcatacaatatgtgatcttttgtgactggtttctttcactcagtataatgtttttaaggttcatccatattataacatgtgtcactacttcatttctttttattgttgaataacgttttatggtatggttatactacatcttatttatccattcatccattgatgggcatttggattgtttccacattgaggctattatgaataacactgctatgaacattcatgtatgagtttttgtgtggatatgtgttttcagttctctaggagtggaattactaggtcacatggcaaccccatgtttaacattttgaggaactgacaaattgttttccaaaatgcctgcataattttgcattcccaccagcaatgaaagagggtttcagtttctccacacccttgccaactcttgttagtatttgtcttttttattatagccatcctcctgggtatgcagaggtatctcattgtgatttctatttgcatttccctaagggttaatgatgttttacatcgtttcatgtgtttattggcctttgtatatttcctttggagaaaagtgtattcaaatcctttgcttattgttaattgtatttaactttttattattgggttgtaagacttctttatatattctggatagaaatcctttatgagattatgttgttcaaatatttcatatttcatcctattttgtgtgttgtcttttcacctttgtgtgtgtgtttgtgactgagtctcaccctgttgcccaggctggagtgcagtggcatgatctcagctcacttcaacctccatctcccaggctcaagcaatcctgcctcaccctcctgagtagctgggactacaggcatgcaccaccattgcccagctaatttttgtatttttagtagagatgttgttttgccatgttgcccaggctggtctcgaactcctgacctcaagtgatctgcccacctctgcctcccaaagtgctgggaatacaggcgtgagctaccgggcccagccatcttttcactttcttagtgtaattttttttttggtgctgtattatatgcagcacaaaagcttttttcattttgctatagtcccagtccaatttatcctttttttgttgttgttgcttgtactttttggtgtcataggtagaaaatcattagaaatcattctaatccaagatcatgaagctttatgcctggtttttttcctaagaattttatagtgtatctctcacacttattctatgattgatttgggggttaatttttatgtatagcataaggaaggagctgaacctcattcttttgcaagtggacatccagttgtcctagcaccatttgttgaaaacactatttttccccccattaaattgtcttggcaccctcctcattcttttgaaaattaagtgacatggcctggcacggtggcttatgcctgtaatcccagcactttgggaggccaaggtgggcagatcacctgaggttgggagttcaagaccagcctgaccaacatggagaaaccccgtctctactaaaaacacaaaattagccaggcgtggtggcacatgcctgtaatcccagctgctcgggaggctgaggcaggagaattgcttgaacccaggaggcggaggttgcagtgagccgagatcgtgccattgcactccagcctgggcaacaagagtgaaaccctgtctcaaaaaaagagaaagaaaaaaaagaaaattaagtgacataaaaagacaaaatagtaatattttcattgattaaaagattcactgcaaactagataaggtggatatgtatgctggacactgttaacatcctagagtagtttaagagcctaattcagcctctattggacactgatcaagtagttcctgtgttctggattctaggctagaaaggtgaattaaccataatttctatccagtctctcagtcagataaacaaacaaaaaaaattgcactatagcaaatgttctaatagagatatgcacagacaaaactgaaacatattagtagtccagtgattaattctgccaggggtgcaatttgagctcagcttggaaggtgggaaagacacttctgagagaaggaaatggcagtggaatggagggaagcgaccctcagggagttccactggactggaggcttggagagtgagtggatggtgtaaagtgtttggagaagagacagacaggcaatcggattggaaagagctctgcatgcctcctgtggagtttaggccccattctatgggcaagaggaagccactgaaggaccatagggaaggagtggttttgtgaatttctgggaggttgctaagccctctttggacatctggctttggcaagaagtgatcccagatctagcatcactgaccaagaatcatagaactttcattgtttccaacccatatttatggtttggtgtcaggtgttaatatgttaccccttaggaaatcttccaccctaaggatcccaatcacagctcaagcttccttcattatacagagccctgataaaaccaaagcctggggaagataaaagaatcacttctcatcagaggccaaccaactctcatcaattggagagtcagtccccatattagttattctttgtagaagggaataacagcccttcaaactataggagcaccatagctccagaaatccacagcttatgcctatagctacagcaactaaaaaatatgccttcatcagcagtcatgggatagcccagaaaacaataaaaagtgtttttcttgtgcagatggagtcagcacacagacacctacctgtaattctctataccccatgtgccatctgtgtccccaaagactgtaatggtattggatgatttctattattaagacataggttttgtgtgtgtgcttaattgagaagacctcttaaggaaacaatttataaggtccaatctgagctccaaggaggaaagtccaagtgctgttgttcataaaacagagtaagaaaatgtccctaaacattgcaagagagaaatacagtcttcaaaattagcagtgaggagggtagcatagcagtgaagtattggagcatggtcatgctatataaatttaaacttggtgtttgtcacttaccggctatataatctagggcaagttacttcctaggcaacatttccttgatctctaaaataagaaataataatgacacctatctcataaagctgttgtggggattaaatggaataatccatgtaaaaggctttgctacccagcacaaattaagtgctcaataaatgatcactattattattactaggacaaagagagtttgtgttttcacttcagaaatcaatatagatgcagtatactgcaaataattatgtgtattcattgtgtataaaagcttcagaactgagtcgatagccaaaccacacagctatgcacattcaccttaagcaacatacattaacttctgggcaaattgcactgttcttgtattgctccaaatgatattttaaaaacattccattgtgataggaactcagctacatttgtgtatgattatttatgtattgtcgcagaaaaaagctcccagctattggctaagaaacatgacctggagtagctcaagctgaagtctgtggtttctccagaaaaatcatctgaggttgcaattactacaccagatatggatgtaatctgtataattaaggaagggatacattaaccaaaaagttgtgatgataaaaaggaggaagatgatatgtaattaaccttttcaacagttaacatcagcggttacctaagcctcctttcacagaactgctcatttgaaaagcagggagttttgctgtggcattttcttaaatatttaatttgcctgcctgcagataaagtgatttcctttttatatattttttatttcagctatggagttctgctttcatcacatcaactttcaaaattgtattttattaaatgaattgattttgaaaggagctgattattctctggattctttaaatagaaactcatatctgataaatattaattacggtgaggtcagcctactgtttttatattaggttggtgcaaaagtaattgcagttttgccattaatttcattaaataataagtttgagaaggggaattttaggttctgtgatagccaagtctcattgagtaggtgacaggccaggcaaggagcaagtaggcgcagagaccaaggaaacctctgggatcagacaagtgcaagcagagggtgtcagaagatttggtatgagggaagtcttgccagggtcaaaagccaggtattcaaggagctggaaagagcagaccttttgatataatattataaaaagaaagcccaggccttgaaatttgagaggtaagcatgtttattcagtcatcatagggtcttcaggaaggcctaggagcgggaaatgaaggagatatcctcagcacagattagttagtatcaagaagattccatggaaagccacagagtgctggcccagaggactagtaggtgggactcaggacttcagttgctgaaggagtcaggaagaaagctaagaccacagttggtgatgaacccaccaaaacaccagttaggaagccagcagaggaacacagggacacgggatggagaggaggcaagagccaggcacagtggatcaaaggcagagcagtctaagttgcaaggctgattcttcagccagaggcattggctggaggaccctgagcagggtcacattatcctcgatatacagcaggtcgtacccacaggcgtgagttaagccacagttgtccaaactcagcactactccattttggaccagataattctttgttgtgggggctttcctgtacatcataggctgcagcatccctggcctccagccattagcatccagtcatgacaatcaaattgtctccaattggttaaatcagtcattgctaaatatcctctggcgggcaaaatttcccctgattgagaaccactgggttaagggggtagctccctgagtttgaggaatcccgagatgaaaagccaagtataggattaggcattcagagcttctgttttgctgttgttgctgattaaatttgtcttccccaccctttctatttggacttcccagaagaccttcttattcttaagcaccaggtcttttctggtcatgtttgtcatttttctagactcctctgtagtgtggtggtaggaaatatctacagtattcagtgttttccctgaaacagttatatacctacatgtgatttacaaggtgatggttacaaaatacaccggtctgtccatttcacataaatacctggatgaaagatgttctgttccaaagcatcagtggcactatgcaaacacaagtatgacctgtggggaactccattttaggttaggtggctctgcaatactggtttccagtcaatgcctgtctctgagatgtcagctaaggcattctaaagcccttaggcacaaaaatatccctcttgctggctagtcattaatgcttaaaatggccaagggtcaggtggcaatggtgacaagtccagctcaccctgcccagtagggggaatttttcataataatcctcctctttagtccatcctctcaattggccagaatctaatctggaagagtgacacataagatcttaacagcattagcatctttcttggcccggtcatgttctagacagcactgcttagcatctgtcgtgtgaattatttgatagatgagaatcagtcactcagctgcctccctgctaagctgcacgtcatgaaaactcacccagcctgctttgtattgcccaggtctgccaactactcatatgtcttcccccatgtggtgaaaacaggttgagttttttttaaggtggaagaaagcagactctaatccagtcatgtcaatactaatagattgtcagagatctacatgcaatcccatagaaagccctgtagaggctgtgtgggtctcctgaggagaacatgactcaaatttgaccattcaattattccttcatcctcttactaacatagattacattaggctggctccagaatttctccatggtgggagggagatagtagaggttttgctcagattatttttggtgtgggatagatttaagggtactgatagaaattgtggggaggggcctaaagtctgcccaagctgtttttggctgtattaaattttattactaaagtattatctgtgatgttaagtaaaatctttcaacttatcaaatattttgagctggtcaggttttattttcctagagttcatttaccttcacaattaattttgtacctaagaactttcagacttaaactatagaactatgtgctaaaatatttgtatgcaactacaagttgctcattcattgtaaggtctgagctgtggttgatatgagatataataattagtgagaaattcaagaacctagagtgaaagtcctgtgaactcagattcttaaaaagagtatcattcaagtcaagttattaattatactacatagtaacaataataacaataattttaaaatatcaagggcttattatatgctactggaccaagggcttttacatgcatttctcattaaatccattataaccctttgagattgttactgttattaaccccattgtataataaggaaactgaggcacagaaagtaacttgcctatgatgagtcatggggttagtgggtggcttaaatgctagccaagtattgaagcccaggcaacctgacttcagagtctgaaccatcctgattataccattctgcccatttttcttataaatgaaccaaaggagaatatttctacagttttacttcccacccttttaaaaatattttgtcatcttctgtcatcttaattattattattattttttgagacagagtcttcctttgtcacccaggctggagtgcagtggcgcaatctcggctcactgcaaactccgcctcccaggttcaagcagttctcctgcctcagcctcctgagtagctggattacaagtgtgtgccactacgcctggctaatttttgtatttttagtagagacggagtttccacatgttggccagactggtctcaacctcctgatctcaagtgatcccccaccttggcctcccaaagtgctgggattacaggcatgaaccaccgcacccagccctgtcatcttaattatatatacacatatataaaatttacatatataaaaattatattgatcaaaacataaataagaattctcatgtcctactataaatttatattaccctgagttatatacactgcaatatgtttagatcagtaactacaaataaaataatgtgaggatctagtattaattccagtgcctcctatttagagacctgctagaattctttatccgtgtagctcaggaatgaaatctcctgggctccagagacagacagcaacccaacccggtttgcattacaaagagaaaggagagcagcccattaacaattggccaggtaagaagcatttaagcagctgagatcaggatgtgagagaggtgtcaagggaccagagaagtcacagctcatccctgatgccaacaccaaaggaattcttgacacagaccacacctcactagctcctcaccttccccctcccatggcctctgaggcagaggaaggacagtgagaccagctctgcccttccggtcagggccttccacagcctgcagtccttccctggaacagacagtgactgaaaaacccaaccacccaggggctagcccagcccacatctggaggtggtggtggaccccaaagagaaggagaaagagcaggtaaagtcaagcaacactgacattctaatttttaaaaatactgtgcctgcagagcaaagccatctgcggccagattgtggacccaggctgccaattttgagccctgttagaacatcgcagaatgagaaggcccaaggaattccttcagaatagagaacagtttgacctaagaggaactgtggcgttcccttcaataataagatgtgtgcgcgtattttttaaaagcgtgttctgtattctccctttaagtaaatatatattttaaaaacacagatgcgtgacttgacttcgtgactcacagtaaacaatccaatggcaacacccctcagccttggagcaacagcagagaagcactttgcctcctgaccctccccccttccagccttctattataaacaggggagattaagtggctatatgaatgagctttaaaaaaaaaaaaaaatgacccacaggtaagaatagccaggtaggccacatttttgggttacaaaatcttaggctgtgcctttctttaaaaatcataaccattgtggaagacagtgtggtgattcctcaaggatctagaactggaaataccatttgacccagccatcccattactgggtatatacccaaacgattataaatcatgctgctatgaagacacatgcacacatatgttcattgcggcactattcacaatagcaaagacttggaaccaacctaaatgtccatcagtgatagactggattaagaaaatgtggcacatatacaccatggaatactatgcagccataaaaaaggatgagtttatgtcctttgtagggacatggatgaagctggaaaccatcattctcagcaaactatcgcagggacaaaaaaccaaacaccgcatgttctcactcataggtgggaattgaacaatgagaacacttggacacaggaaggggaatatcacacaccagggcctgtcgtggggtggggggagggaggagggatagcattaggagatatacctagtgtaaatgatgagttaatgggtgcagcacaccaacgtggcacatgtatacatatgtaacaaacctgcacattgtgcacatgtaccctagaacttaaagtataatttttaaaaaatcatttgattatttcctgtgtttttaaaaacacattgctctttatttatcctcctgttctaatttacatatgtttggtttgtgtgggcattgggatctcaagaggatgctatcaactctgctggtgagtatttttggcgctttcagtgtgggatttcttgttcacagcatcttatttgtgtttctatgattgctgctaacaagtctcctttacacacatatgtggggtagggacttgagggctaggcctgaggcagatgaatctttaacatggccaagaaaagggtgtagggtgacggttatgacacacacgttcggagatcggcatgcagtatccaggtgctgtgaatcagttagttgtaggttgtggcatctccttgaccatctccggagcaaaggtctttagggagagaggagaccttgctgcctgctgaatcagctgagcaacgttggacctaagctctccacctttgattggaaaatgagagggttcaatgacttttgaggttccttccagtttgacattctaggactttatgattcattactgtattcttttatctagtgctatatgatgatttaaatggaatagtcccccagaaaatacacaggaaatgtaggcatcatcttaaagcaaagaagatgaatttctttatttaatttaatccacattgcaccaagactttaaaaattctcatgtgacttaatttaagcagtatcttctctcttcctctttttgtagtgtactgatataccaatgaatcaagtgtctagaggtgaaatagtgctatctaaacataaagatcaacagactggtgaataatattgtcaatttgttgtgatcttagccttgcatatttgtaagtgctactaagacatttcatgaaccagtatgatgtggcacttggcagatgagaggacaagacccttaggtttgttaggtatgggggtgatgacgttttcttgaagctcttccaatttagaaatgatagagactgtgagaggactgaatagtgtctcagcaggccaggtcatccaaggtaacccctaccacaggaagtcaggggcctaagggttcaatgtgccttagaaaaatcactctcatttggtctccagttcttggtttataaacttggtgtgagaaaaagtattgtcccagttaattgttgccaccatgttttttctaagaatttccagaatcccagatgtttacaaagtgataaatgaatgtgcaatatggttatattactaaatatactctttaaaaattgtgtttgtgtcagtatgcttaaaatacctaatttacttcttacactcaggtttagtggtcattggagagaaagaggaagtagtataatacaggacattctaccatttttaagacaagaaacatatatatcactcttcaaaaaagttggctggtataatgtttttggaatttatacatttcttgctttgctatagagcatgcaatttgttactgcttctgaggaaaaatccagtactggattttcatttgaagttttctcctatactatctgtcccattattccagacagcctgtttagctttcttaaagtcagcctttcttcccgtcttttctttagcatgggatattagaggtgctgctgtttccatgttttgttataaactaatgttagactaaaaatgaattgtctaaaatagcatccatgagagttaatagctcctgtgggtggaccatataacactaccatcacttgctgtgtgatatttataattaatactctctcctttccagccaacagttctgcagcttagatttctaattatggaaacaaagagtgagttttcacacagaggtattattgtttttactaccctggaaaatgaggatttatgaaaagaaagttatttccattggcccctggcttcctaccaatcctttcggtgcagcagttacctcaccttccttgagggaggggaagaagatacacctctttattgggggaatattaaaaggtggctcaaatgattccatgtctcctttctctagaaatttttctgggccaggcacggtggctcacatctgtaatcccagccctttgggaggttcaagcaggcagattgcttgagcccaggagtttgagaccagcctgggaaacatggagaaacccggtctctacaaagaataaaatttactgggtgtgatggcatgcacctatagtcccagctactaaggaggctgagacaggaagatcacttgagcccaggaggtcaaggctgcagtaagctgtgatcacaccactgcaccactgcattccagcctgggccacagagcgagcaaaaaaaaaaaaaaaaaaaaaaaaaaaaaagaaagaaagaaagaaaaagaaaagaaaagaaaaagaaaaagaaagaattctttccaattaaataaagttcgagatatcagagtcatatattatatcccaacacaacctcgtagcctcatttcctgctgggtcacttggaaagccaagtatagcatttggctggcgtgttctcttttaaacatagctgccagtgctacctgcagagcaggtggtggtaagaagccaggtcgcacctaggcagccaattggaagttgttggattgctgagctctgtggtgattccctgtgccccagtcacagcaagtacacaaactgctggaaaggagccagtgccctcctgacctgtggctcagtcacagcttagtctgtcactttctgagtagatgccgatcaaggctttggcatgagagactcgagaagagaaagctggactgcatcctcagcctgcaaagccaaaggatagtgcagcgtttctttcacttctctatcctatggtgcagtcgtttttgcctccattaaaggaaggcattggtctctcttcaatttcacctagtgctgaccatagcaacaaaggataaaactgcagccacccaaatatttgcatgcaggacagcttcaacacagaatattcctatttcttgggcagaatgtccaggcaggctggcatctttatacttcaggctgaattaaaaccagatgccttcctgccagaaatctccccagccagctgaaaactacttagaacctgagttcaccagtgaggacatgaaaagaaaagtttaaaatatatctgacatggttcttcaattctgatcctattaattttcattttcccatttctggaattattgcaaaactcaattagtgagttttatggctctgaaaatcttaccgtctggctagagctcttcttttttaaagcaacttgtcaattttagaatagaaaattactgataaatgaggaaaaggtgccaggtcagtacatgtaaaactgtggcgattgaatgatattgagggtaagtcagctgaatattattctcagctcagcacaaaactgaataatgagagctgtataaaaatgactgctgcttcccagtgactcggtattcaatatccaccactgcgtttcaggattattcctttagtttgacaatgttactgagatttatctagcacctgtcttccaatcaccatggacagtgcttgggtgatggaatagacctctccatttattctgggtggttgctcccgataaagctgtcctgcaaagctgccttttcactataaatcaaagcctctatgtctaaagtgttatttaataatgttcaaagctgtaagtggaatctagtggttcacactcagagctaagagccaaatactttacgctgccctcttagcccagacacttttactttatgtataacttacgactgtctctgtgcttggaaacaactgaatatctgaggccaatttaacaaatgaagaccaagatatctgcaagaatgtgatcttgaaatcattttatcttaaattatatggttaatatatgctttccacttcactttgcattattcctcttctatttcctctatcaaataagtgcaaatatcatttagctattgaaaaaattttaatattgtcatgtagaaagagatctgaaaaacaaagtattcaagatcagagagctttccaaacttggaaccagattttaagtctgttcctaagtatgagttaattgcataaatctcaaatcattaacaaattcttattttttttccttcagtccaaagtttcttaatgattaatattgtgcttaaatcacattgaaagtccactcttttctttatctagtctatcattgatgggcacttcgattgattctatgtctttgctattgtgattgatgctgcaatgaacatatgtgtgcatgtatctttataacagaatgatttatattcctttgggtatatatccagtaatgggattgctgggttaaatgatatttctggttctaggtctttgaggaatctccacactgtcttccacaatggttgaactaatttacattcctaccaacagtgtaaaagcattcctatttctcaacagcctcaccagcatctgatgtttcttgatttttttaataatcatcattctgactgaagtcagatggtatctcattgtggttttgatttgcatttctctaatgatcagtgatgctgagctttttttcatatgtttgttggctgcacaattgtcttcttttgagaagtatctgttcatgtcatttgcccacttttgatggggttgtttttttcttctaaatttaagttgcttgtagattctagatattagacctttgtcagatggatagaatgcaaaaattttctcccattctgtaggttgtctcttcactctgatgatagtttcttttgctgtgcaggagctctttagtttaattagatcccatttgtcaattttagcttttgttgcaattgcttttgatgtttttgtcatgaaatctttgcccgtgcctatgtcctgaatgtattgcctagattttattctagggtttttaaagttttgggtttcacactgaagtctttaatttatcttgagtttatttttgtgtaaggtataaggaaggggtccagtttcaattttctgcttatggctaaccagttctcccagcaccatttattaaatagggaatcctttccacattgcttttgtcagttttgtcaaagataagatagttgtgggtgtgcagtcttatttctgagatctctattctgttccataggtctatgtgtctgtttttgtaccagtaccatgctgttttggttactgtagccttgtagtatagtttgaagtctggtagagtgatgcctccagtgttgttctttttgtttaggattgtcttggctatatggactcttatttggttccatatgaattttaaagtagttttttctaattttgtgatgaatgtcaatggtagcatggaatactatgcagccataaaaaggaatgagatcatgtcctttgcagggacctggatagagcttgaagccattatccacagcaaactaacacatgaacagaaaacaaaacactgcatgttctcgcttataagtgggagctgaaaaatgagaacacagggtcatagggaggggaacaacataccctggaatctgtggcagctggggagagggagagcatcaggataaatatctaatccatgcagggcttgatacctagttgatgggttgataggtgcagcaaaccaccatggcacacatttacctatgtaacaaacatgcacatcctgcacatgtatcctggaacttaaaataaaattaaatttaaaaaatttaaaaaatgaaaggccaccctttccaaacagcatgttggtgtgagatgtcatgaagtttttattatacttactcccaagatgtctattcctcatatagtgttactaagaattccagggaagtccacttaatcatttagagttgcttagatatagggaaaaattgtagggtaaacgcacctgatagcaataacaagcatatcctgagacggcagacacatctgaatgtgtgttccgagctagagaatccccttcgccaccacgactctctcccctctatgaaaccccctaataaaatcccatgtctcgtttgctggctctgggtctcttctttggcctcttgaacttggtgccttacctactgaggttaatagaggtttgacacaacaacagtgttcaaggaatgccttattgcttcattttgattattaaaacatctgagaagaccccaagcctggagctccttgttatgacccactgcttttatgagacccccatccttctaagctatccattctaagtggctctttccatccactttttctgaataactcctgtgtaagacccacttccctcaaataattttcccaatatttgtctcgctggctgtgagtgaagttcaacttgaagttcaattccattttgaaaaatttctgttgaccttggcagagtttttgaggacagtatttaactattaagtttttctccctctgggccttttttctttttctttttctgcatttgattatactacaagctttagtttaagaacctttcaagcaattgttaccattataatataagagagagattgcttttactattcataagaatggtcatggattcagagctaattagagttgtaagtaactttaaagtttaccttctgcaacaccatctgatgcttcaatctactctacattatagatacatccaatcttctgttttacagaactgttcactgcaatagttctaagaactttacagataccttatgggaatccttttgtttccacttcacaagaaaatagtcaacccaccattatttctagcttcttcaaggggttccaacttctactttcaaccccttccctgtaatttattccttacataatagccatggtgatctttttagagcataagtcaagtcatgtccttacagtgacttcctgtgaaatttaaccccttaccccaggctacaaggtcttgcaagactgacctcaggttccctctctccagacttttttcatgctgcttctcgcctcttctctctgttcttcaaactgctaatctctcaggcccttgagtatgcaggtttctcttatctcaaagcctttgcaattgccggtccctctgcttataaatcccttcctgagtctttggatgctcagggtacaattcaatgtcaccttgtcaaagaggctgttgctgagccactatctgaagatgcccatcctccccacaaatcttcatctctatcccattaactgttttgtcttcttcacagaatccatcactatcagaagtcacttacttgtttgcttgcttgctgtcatccactaaatgtaacctccatgggaccagggacctgccttttgtttcctgcgtacaccaggcacgtagccatttggatgaatgagaaattatgatccaagtttttataaaacttacatctagtcacacaagaatggaaacaagctcctgcttctgtgaacatgccctgatattcatgattccatgacctcattcctatgcttttctttacctgaaaggctgtttgttgttttctggttaaatcctatcatcctttaaaaccagtccagctgccttgccatttaggatatccaacctcctcaggctggatacataaccagttctaagcgaatattctaatattatcatgctccctgcaatctctaccactgtgttttaaaatatttaattgggaaatatttaatatattcaagatatacaatgggatgattggatatattatatatatacattgtgtaatgattaccacctaaatatccatcaccactcatgctatgtatcatatccccagaacttcttcatcttataactaaacctttgtatcttttgatcagcagctccccaaccaccacccacaaccccctactcaacctctggtaaccaccattctactctctgcttctgtaagcttgacctttttggattccaaagtgagatcagacagtatttgtctttctgtgtctggcttacttctcttatcacaatgttgtatcattatttgtttggttgctgggtgtgttagtctattctcactctgctataaagaacttcctgagactgagtaattttaaaggaaagaggtttaattgactcacagttccacatggctggggaggccgcaggaaacttaccatcatgatggaaggggaagcaaacatgtccttcttcacatgatggcaggaagaagtgcagagcaaagggagtaaagtcccttataaacccatcagatctcatgagcactcactattacgagaacagcatgggagaactgccttcatgatctaatcacctcacatgaggtcccactcccaacacatggggattataatttggactacaattcaatatgagattttgggtggggacacagccaaaccatatcactgggctcttccaggagacagggatctactgaaggccagggactattcgtctttattttcccagccctgagcttgcccctcatcccctgcacaataaaagtttgttgaaggagaaaggaaccttaaacttctgactatagttgactatgttgccaagttgtattgtgtgttctacagatggcagccattaatattttagtccacatttcattactaataattatttagactttcagattttttaaaaataacacctttataatctaatgtctcaatttaaattattttcaacataaagggaatgtggcttgctgctataattttaaaaataatttgagtagataatttgagtggttgctagggataacctaaatccacaaataatccacaaaccccattttagaaattaattacaccaaacattggatcaaagctgctaaccaataaggaattaaattgatatgagtttaacttctgtacatttgtcttcctaacaaaatatgagagaaaggcagggaaaaaagcaattataaacaacccaaataagctcctgaataattgggaattgcctacgtttgtgttatccatttcttatatttccctaggactgtcaagttcatccttgggagtgatgagagccattgaggaaataataaaatacactctgctatggttctttcactctctggaaagaaaataaagttaatcaagttagcaattcagataaaatcagaaagaaaaatgacagggatttaataatgctctttaattgaaacaagttgttttgccctaagagagatgataccatttaatcagggatttttttttgacatcctgttttatatgattggagatatctactatgaataataagtcatttgttttgttagtgtatttctaaaatttctggtatattgtcttctcaagcaaagtaactttgtctccataaatccgtttttcctttggcaatggtttaaatagattcaggaactaaatgtagaagatgagattccttcattcagtaactactgagtgcctgctgtgtatcaatcactggtttaggtgctgaatgagacacatcatgggtttcatatttaatgatatatttccccataaccagcatactgaaaaggccaattccatttttaaattcataactatttccatattgaaatgtgacttgaagacacagaaaggtcaatagttctctgcaaaaataaagttgtttataattaaatgtgaagggagaaaaaacccaaaaacgaaaaaaaaaaaaagcaaaaagacttcactcgcattttcacatttagtatgctcactgcttatctgtttataaaattataaattatactagcttttcatgtcaaatcctacaagcacaaaaataactttacagtataatttgacctagccgtattatttaatatatgtgcactcatttctgatgagacccagagcacattttgctcatgaatacccgtaatcctttaggcattttatgacaaatctcttattagccacaatcttagcatgagcaatatatgataaatggcccagcaaaggttgttcggtgaatttgaaatgctctcaggaagagtacccatgtttaagaatctacccaatgctttattctttatactttattctcccttgtctgtgtatttgattttcaaacaaccatcctaaagtactttgtaagactgcaatatgagattggtttctggaactgcaggattttccatgggatattttctcctcttcctttacaactaggtaaattcagctggggttcagctctgaggctgtgaattatcactggagcattgctatctcaatacttctctgtttgattcattggacagattattttacatgatcagacaattcggttaatcatcttcagggccaggagaacttgaggatatcttctgatttgcttaattctgaatatttcaaactgatgatgtctatctcaaagtaaaaacagtctttaaaggcactgtaataaaaatgggtgagaataataatcattggaaaaagagactcttaaggaagaacagacatctcattttccattttcttctcattatgtctgcagagtaacactcccagggctcagggatatcaaatttgatataaattcacaaatgaaagtgacaataaatcaatgcctagagctcttatttcattgcttcatgctagtactttccccaccaatcatttgctgactatgctactgataaagtactcatcatttttgcctctgattctagttagaaaatgagtctacctttcccctgacacagggagtaaactgtgaaatgataagcactttgcctaagaacaggaaacactccatgaaaacactgagatgaaaacctcaaatatgacatttaaatgaatgggtaagcctgggcaacatagaaagatcccgtctctataatttttttttttcacttagctacccatggtggaacacacctgtactagatacttggggtggggctgagctgggaggatggcttgagcccaggagtttgaagctgaagtaagccttgatcatgccactgtgctccagccagggcaacagagcaggactctgtctctaaaataaataaatacatctgaattttttttttgcttttatgtaagctaaagtgagtgctttaaagatattcaggaagagtgtgtggctgaattttttttttctttttaattagtataagtatggcagttttaaaagattggggagaggaagagtataaaactccagacagatcttcacacaaattgcttagcaagggtctttaaggactcttttcactttgaaggaattacaactggagattggaaatggtagatttcagagtaaagttttggaagaaagataatgcagaattctaactgtctatatcaaagaaatgagagttgccttgcctcttccctaacccccaccccagtaaaatattggcaaatgaatgtcttttatgcattttacattaaaatgacatttttaaattatgtattatgttttttactgattttctcactttaaccaatttttgctttaattactactattttcactcatgtcagataagtcagctttcctgcatagcaaggtggttgaatacataggctctgtagacagacatccagatctggtgcttcttactgtttgtgactttaggcaagctgcttaactactctgattttctatgtcactatttgtgaaatgatgatggtaatatatctacttcttaagtttgtaaagaggattaaataagatcattcatattaaggacttggcattctgttcatctctgacaacacagtaaactcgtaataaacaatatcaatttagatattttatagcgaaaattgtaacccaggtgcattggtctctttggcctgcataacaaaataccacaaactgagtggtttaaacaacagaagctaattttctcacaattctggagggtggaagtccaaaatcaaggtaccagcaggattggtttctagtgaagtgtttctcctcagtttgcagatgatgtcttctcattctgtcctcataaggcattttctttgtgcgcacataaagaaaaggagtcctggggtctcttcttcttacaagagcagcagtcctatcggattagggcccagcttcatgactccatttcacctaattaccccctgaaaggccatttttccagtatagtcacattagggcttcaacatattatttttggggagactcaagttggttcaaacactagtacatttatactctacttataaaaagtagagtagccttgggaagcagaaatgacccgtcatgaaggatgaactccaaagagttctctccaaaaagaggacaagtttcagtccacagtgatccaaattgaagagaattagagaacctgaactccatacttaaatctaccattcactatatgaaattgcaataattacgtaatttccttctttcttagatacacacattaaatctaattatagatgagcccatcatctacttgcttcaaaggatgtataaaggactaacataacactgcttaatacaataactagtctgaaatttctggaaagggtaaggtaaattccaaggagcaaaaacaagcttattctccttggttttatctttattgattcttccatttgttcattaaaaatgtattgattacctaccatgtgccagacactatgggtacaaaagaaatagtttctagaacatgaccttaaatgactcacaggccactgggaaagggagacatgtaaagaagtaattgtgacgagccagaaacatagtacacagttgcaaatttaaatgccatgaaaatgtaataatagctatcacttgttgggtgctcactatgatatcccagttaccatggcacatgctttatattcaccatctcatctaatgtttgcaataatattgagttaaatactgttattaacaacattttatgggattagagagactaggtgtcttgttcaacggctcataattgaaaagcaatagaccttaggtgagaattcagttgtgtccaattcttgagtgcattttcataaccacagtctccactgtctccctgctctgggagcacaaaagattatctaaatctttttgaaccatggaagatctaacagaagacattactgttgagctggctgttgaaggatgaagagaagttgaccaggtagagaagggggaggcaggcatgcaggaagacaaagccgtgaaggaacacagcttactcaggcatggagagtaggacttatatcagggaatggccctgtgtgagatcaagaacacagagaggaccatgctttatcctcaagacatcaggggaccctggagttttttgagcaggagagaaacataaaatgaaataagttttgtattttgttagggcactctgatgggtgccctaacggggtattctggcatggagagggcagtatatcagaaagttgcaccatattagaaagaagaataccagttcaccactatagtaggccaagcaggaggtgatattaatctgaattcaggaaatgggagtagaactggggaggagaatgttgaaaagatatacttaagaaagagatttgccagtagtttgcagttaattagagatgagaaatgaattgagtgagaaggtgagactgactcccaggttcctagttcaaagaattgggtgaaatatgatgctcagaagcaatagaggggaaataggagaagtgggttcagagtggatgaaagaattccatttagatactctcagttgcttgtgtgatatataagtaaatgttgctgtaagacaacactaaatgcaattctggaagcccagggaaagaagtcagggctggaagtggtgatttggaaccaattatccataggccttgacctcaagtcaaggtagtaaatgaaagaccccaggagagcagcttgggaaagagaaccctgctaaggtcagcacccagaggaactcgagtaaatgaagagacactaaccaggggagtcagagacacaggagagaaccagggcagagtggcattctggaagtcaagagaattcaacagggtaacaggactcaatgccacagaggataagtgaggattttttaaatgtccactgaatttgacaagtaggaggtcactgatgacactgcagaagtggcgtcgttagaatgtggggacagatgccagattatagtgggtaatgggaggaggaaatgcaggccttgagaaagaatatgtttttaagaactttggcactcgaggggaggattgttctgtgacagcagccagcagggaagcaggacccagagagaacgggtggttttttttctcctactacctcttatatttctaacaatatcctaatttttcaggtctttgaaaaacaccttacagatactttttaaagttttcatttgctagtgataaataaaatgtgcttgtatgtgtaatttgtatagaagattttcttatacttactctatgtccagctgacataaaagtcttaataaactggtctttcctgaggagtatcaagttcagaatgctttcatatactctttctctgttggttttcattcaaacatattctaaatctgttaatgttatttaatttgtgtttactgtatgatgagaatgaagaaaacaacctatgtgagcatttccatgaataaacagactggcttggggaaaaaacagtcagcaaatgactcttcccaaggatttgcatgttcagagcattgacagggagagattcttaaaatgtgactgaaatgttcagagtgattagtatgaggcaagatgttagagactcaggcagttttctaagcttcagacaagagagatctacagttctaagaaacagggatgtaccctttgcaagtagcccattttggcatcctatggggatgccaaacagctgtaaagaatgcttggggctgggtgcagtggctcacacctataatcccagcactttgcgggaccaagttaggtggatcacttgaagccaggagtttgagaccggcctgagcaatatagcaagaccctatctctacaaaaaataaaaaattagccaagcatggtgatgcatacctgtggtcccagccacttgggaggctgaggcaggaggattgtttgagcctaatagatcaaggctgcagtgagccatgatcaggacactgcactctatcctgggtgacacaggtgagactctgtctcaaaaaataaagaaagaaagaaagaactcttggatccaggcttcacttactccttagaggaaacacaattaattaactggattagaaggccctccttggtgaaatacagagttccctttgatgaagcatcttcatcagttcaaactgaaaggccacctctcttcatgaaatgccaactgaaaatcatttgagagcagccagtactctccaatttttctggcttggttatctgttccagaggccccaaaactgatccaagcacctttgcaaagtaaagaaaagaaaagacctcaagtaacatgttgagataatatcttctagggcttgaagtaagatttgtccatgttaaaaatctattagtaacaataggcctacttctttagtacttattatatgccaggcacaatcctaccagtgagtgtacctacagttcagagagagaaagagaaaaatcacaaggattgcctggggctttatagacatggttcatgtttactatagcaatccaatgaggaaggatgtcttcatcccatttagcagcagtaaatggggctgagaaactcagtggtttgtccagggtcacagagctggcaatagcagagtgtccaatgtagggctctgggcctgaggtctggtctccgccttgctccaggatgccttcttgtagccagatagttaagctaacaaaacccctttgtgcctctcagtagattgcacatcccacatttctctggcttaatcagcattttaaaaatatttttccccacctcccaagctgtgtgtttactttttatgaccactaatagcatttgtgactttgtaagctaagatgatgaagtaaaaatcaatttgtctcaaggtaaaaactaaccatctttattatcaacaaaagatttctcttgttaggaatattttctacctgtattaatgtatttatgtatttaacagattttccccttctccccaggccaaattgtattgaccgtcagtggcatttaaactggttgcatggtacttgggcagcctagggaaaaaactttaaaaaatactgatgccaggatcccatactcagatattctattttaattatcctgtggtggaatccaggcatatatatatttttaaattttcctagagggttctatggtacaactagagttggaaaccactgacgtccacaatctgatagctctactgatagcctgaaagctaaatcatgtgtttataagacatccaagcctacccagttaagtatcttaccttgatcttttatataatgtcagccatatggaagatagcatagtgaagaatcaatagcacttatcaataaaaccataggtcccggaattctttttatccttctgattaaatatcttagaatttaagttgttgaaatgtttaagaaaaatgaacaataacaccctttccctctcccctcttcaaaccaaagaatgacggtttgaaacctgtgactagctagacaattctaaatgttcttgtttgttaagcaactaaaatgtcctggattttccagtacagcatcaatttcaaatatcctttcgtattctgatgattacacggataccacatttatgtgttcattcaagtatttggtgagaacctatcagattctaagtactggggttggtttctgcttttaccaaacttaacatcctagagggaggattagaaatgaacaaattaatgaaccagaaaaaaactagtgctaggaagaaaaaaacaagtgtgtcacagatactaatgggtagttacttgagatttagtgattagggaaggcttatctgtggaggtgacaattgagccaagaaacaaatgacaagaaggagccagccttgtgaaaatctaaggagaacacatttggagcagaaattccctaagcaggaatgggcttagtgtgctaaaataccacgaaggaaagcaagaatcagaggagacatggatgtggaggtaggcagtcaaccagtcatgtaggcaatgtttctatagtaactctgactgcatcttccagatctctttaaaaaaaaataccaaagcctaggcccaccccagtccatcaattcagaatttttaggattaggggagtaactccacaaaatgaccccttaaataaatgatctgaatgttttctgctactacttttaaaagttctgttaacagttgtgtactgtgaatagaatggtatttttaaagcaacgttaaccagtttaacagaaaatacactgcatgaactaatccatgtgccacaaaaagggccaaatgtttcagtgacacaggaaatccaattacagttgccttgagcttagtcatttattcatcagagagtttcaacatttgatttctctaggtgttccccatgtgcagaaaggactgagccacttaagtaagcctttgaaggccagggtaaggacgtaaggaaatggagttttgttttatgtataatgagaattaactaactgaatggctttaagaagggaagtgatgccactcagtggaaaatggatttgggccaactcagcaagatcagaaatgaggaaagcggttaagagacaactgcagtattctagaagagaggcaatggtggtttgtcctagtttggaacaagtagagagaagtggtcaggtttgtcatgttgcaggcatagttacaagtgtagagtctacaacatttactggattggagatgggatgacttctacggttaaggttaaaaaatggtggccggacacggtggctcacgcctgtaatcccagcactttgggaggctgaggtgggtggatcacgaggtcaggagatcgagaccatcttggccaacatggtgaaaccccgtctctactaaaatacaaaaaattagccgggcgtggtggcacgtgcctgtaatcccagctacttgggagggtgaggcaggggaatcgcttgaacccgggagacagaggttgtggtgagctgagatcgcgccactgcactccagcctgggcaacggagcaagactccatctcaaaaaaaaaaaaaaaaaaaaaaaggcatggatggtgatattctttaccaggatagagaaggctaggagaggagtaggttaaaggtaggtgactaaaatatacatatgtagaatctgtcattcaacttgctgattggtcagttaagtgacaagatctaataggcaattgaatagataattatggagctcagcacaagattgaggtgagagatacaaatttagaagcccccattatgtagaaactattcagagtcattgagatggcttaagagtatctggagagaaagcagccaaaggagaaagtatttaaagcagaaaggaatggccagctgggccaaatactgctgagggtctaatagagaagtaaccactggaaaaaaaaagttgtgtctccattttagggtttaggaaatatggtcaccataggaaatactggtaatgacaataagattctttctacatgttaacagatacatttggcaaaatagccctggactgaaaatatataggtaaaaatggtaaagatgtgtgtgtgggatcggtacaagatcattaagaggtagtaagatttagagttttaataccactccagacaaaaaaagcatatggatcacatttctttctaaagtagaaaaagtggatgtgttacaaagtagacaaatagtgactcaataaattttacgtattttctacttgcctatttaaaagaaaattccactggacctagagttgatatgtaagatacaacagttgtgggctaggctagaaatttcaatccgtaaaatgacctattctgggactaggggagcaactccacaatatgaccctttaaataaatgatttgaatattttctgccactactttaaaagtgctactgaaagttgtataatgtgaatggaatggtaagctattttttaaagcaacctgaatttgtttaaagtaaaatacaatgcatgagcaaatccatgtgccacacaaggagccagatgtttcaatgacacaggaaatcggattacagttaccttgagcttagccttttgttcatcagagggcttcatttccaaaaacaaacaaacaaaaaactaaaattagaatttcacccttcaaatgtcctaaaatgcctcatacatattagtgtgaactgggaaagggagctgagacattgtaaaattcctgaagatggctctaaatacataccaaacaaagccaaaaacatttgtgcaaccattgttcatactgatggtaaagaacaacatattcctgttattcttcatacagcacgcaaacaagcaagcatccctctcagagaggcataaaattatgcatcaaaaaccaaactagcttctataatttgaaagagtttgaaagcagtaaagtctttttccaaatgactgatacatgaatatgtggcccccagaaaccattgtccaacttgcaatatggtgtgtaacgcccagaaaaaagtatacccaataaagtaaagctcctttcttacataataaatagatcataatagttacccttttaaggctccatctggcatgccttacattaggcagccacatttatgacccatgatctcttgtatcaccaggaaatatttactgaaggaaatatttgttcaggtttgtttgtcgtggggtgaccacctggttggagccgatgtgatagtcagtgtttgaattatcacagattcaggtttgctctttacagccaaaatctggcatttctcatatctccctgggttttcatcacaaatacagaagggtgaaattaaagacatgatcttatgtattaaaggatataaagataaatatgtttgctccttttttattgaggtaaacagctggctaatgttaatcatacagccagcgatttggtaactttccaaatatataaaaaataaatttattttatcattatttctgtgacttttagatggtttcagaaaacagattcatgtcaaatttaaaagtaattatggttttcagcttcccactggtgctgtgggagaatttagaaatatataggtcatttttttgagataataagattgggattaatgtacctatccaatcaaatcagagttactctaacttactaaaaagtgtaaatcaaaatgccctaaaaactcctctggaaatgaatcagggaaacagttttggcccattgtcacagaataaataagccaaacaaatattttcgatcttatagtagctaaaataattgtatgagaactttggtttgtcaccaaaatgatatcaactgaatactgaaaagtatactctggggtgcatgtcttatgtggaaaattttagttccattttgcagtgtctgtaaagttattttctgataattcctgagcagagaaagcttgctagatactctcagaaatgtttttaggtgaatctgataaccaattaggatcaagtgtgtgaaagtgctttgtaaattacaaataattctatttatttgagcatcatgacctctccaggtcaataacgatggtacgatatgacatttgatatgatatgatttaataatgagagcctcagattctactgggctccttattttatgattcaggtgatgctggggatgacatttgtaatctctaaaagagaatccttgtttgcctgaatttgcaaagattattgttaaaagtatcttaaaagatttttgaagagtctattaatacagtcagctcaaagacttctggaaacgtactatatactaaaatgagtcttcccattttgtcacctcagaaaccagaagttccaacttccatggcttactaataaacataatcctgccaataaattatctcccaacctgtttgtgtaataaaaaattgacctcatttaaattaacagcggaacacctccaggccagggggctgctctccccaccctagaggccacaagagtttagcttttacctcctgtcagtttgatcagtttatttttccacttatatttttaactttatcactgagaaaatgtgctacaaataggagtagcttaataaagtgaaatgaagtttgtgagattcaacatctagcacctgccaggtttagagcattttctcatccatctgggataacccatgctgacaaagcttagctctgtgaaaccaattatccacatcgcttacagggacatggcctgaactagattatgattatgcccactgctgtgaatacatgacaactcccaggggttgcgtgtaatgccactgtggcataccccatggatgtctttttggagggtgggaagggtggcaaacagctgaaagaggactcccagtgcgttgcaatttttttaatgtgttttcatgaccaaaacttttaaaattttatatctgtgtctaaccatgtcttagatcccatttcctatctcacttgtcctttacaacattgttttcctatctcatttctttccctaccatttcccttcttcatatacaacactgaactctttccttcaaagtattttcatcaggatggtttatgatgggtcaaggttggaaaacacatagcaattctgcatttgccgttgatgctaagcagcaacttacatcttctgcatttttatgacttttaagaaaatagcccctagtttgaaaatctgcaagctctgcctagattagtgatacccataggaactttcctgttatgttttaagactagcctacaaagattgagttttatcccaaatctctgcatctcaatgattttgtaatccaaaacaaacatgcaattcttcagtgacacaagcatgaatgccctgacacgcctactggaaggtgagctttttctgaaggcaggctctgtgtatatttcttatatcatcctaccatagcactcagcataatgccttgctcacagagtggttcactaagtgcttgtgaaagtggcccttctacttctaccttctgcccttcgactcctgggaacccccaaatagctaaatattaaaacctacctcccgtaacttgggaatcctggtcaaatttaaacacataccaatagagatgttgataaagagtggtgtctttttggtgggagaaaacttcccctggctcattcccacctcccatctcccaccaaacacattggtattccatttctatttccttacttcatcaaggacccattctcacagtattactccccctaatggtagagacagtctaccatgtagtacagatttgtaggtttccagtggattaatacgaaaagcccgattcctttaagaactggtgttttaggggaggaggcacaggatgagcaagttaccagataactatctggtggggcaaggaagtgacaaaaaagtgaagagaatctctcgctatcttttttcttcttgcagccccttgactgccaagcctctccaggaccacatttgccaacagagcaccaccatctctgggggcattatcactgtgaagtatctcaacgggagtctcagagcagagctctcttagttataggctttagttccaaaatgcggaagacacccaagctatgtccctgtgtgaagaccacatgagagtgccccatcaccatcttctcacctctatagatggccccttggtcacatcatcacacttgttttgcacaattcagagagccaggtgaaaagtactagagaataagtttttcctacattctagtgtagtgctgtctccttcagcaaatcaatgttagttttcttaactagaaaattaaaataacactttcctcctgacccccatctaaaaaactaaataaataaccaataaatacgcattaaggactcaactctttttaaataaaatgcactgttcaagagcacattattattttttattattattattctccaatacaggtttggttttcagaactccacaaaacatagcgatattcacacttttaaacaaaaataatttacattcaaaacactgatgaaacaaatttccttagcacttttctatgtttctagaagctcgaaaaccacattgtggattttaagaaagggtagggaatcagacaagacaatgatgtccatgaccatagagttacaatgtttggtctgtcaggtatctaaaaagataggaaaagaaggacaagtgacacaaaagtagcaaatacgtattcagtacctgcaggctctgtaccagataccgaaagatggaggtatctgaagacgtggacataaaaaatataattgaaggagaaatttgatttgtgggaggacccagattaattttagtcagaaaggcttctaggaagaggctgtgttcaatatgagccctgaaggataagagattttcagtcctgcttagagcaggacagtttacctgttggggtgctttctggcaaggctgcggtccatttccctggtccatgtgcaaaagggaagataagagaacattgggctagctggttgaggccagagcacggtgggccttgaaaaccaaggcgaaaaccaatttaaatgtcatctgtaggccttaaactttgaaaggttttgagcatggaactgaaacgatcagaattatctgtatttaagtatagaagcaggcatttatctagggtcccatgaaatacatacgtgtgtaaacatattttgttttgcttcttggaatggcttcataggctggagaggataattttaaaaatagacctttagaaaccaaggttggcagaagcatcatgtcattgaatataactatcctccttcaagaaaacagtccgatttattttgtggaagatacaacaagctgcagctctgtatttcaactacaattcataaatgtttacagcgttcaacacctgactcttgactatagaccactgtgtctcttggctaatgatttttgttattaaataaatttgaattttgtatgataaaaagattcctgaagtagtttgtttattcttcaacaaaagcctctgtgtttgtaaagaatccccaatgaggccaatagctcacttgaatcagtgcctacctcccttaggctccatatttgaaaaaatatggttattacccagagctccataaaagattcaatatctaatttgtctgttgggagtcaataaataacttttgccaatgacacaatctttactatctttttatagagatttttgtcccccagaccctcaagggcaaggaggcaattggctgccgttgtgtttattattataacagatagaatttcagattctgtttctgaagtgacactttgtggagtgacactgcatttacagttactgataataaaaatggctcttaaagtggtagagtttggcttccaataagaagaataccaactaagttaaaacttccccataggtgcagagtcttcctgaaagagtgaaacttcagttccaacctaggttgatgccagaactcacaagtgtccctcacattatgtttgctctgtttcctgtatgagatggttcactagcggctcaaaatgtgagcaagaaaaattgacactgagatctgagtgtttttctgccccctacccccactccagggaacataatgcaagctaaacccctgttagaccttgagaggatgggggcaacactaagttttactagagtcttttgaattaaaaatatgccattacttggtttaaatagtactgttttacagcatagtagtcatcatatacccatttttgtagatgcttgtcctaaacacctaagatatctttattgctagcagtgtcctttctttctaaaagaataaacataacattttaattctgtaaaaagaatagaacatgctcactgatcagctctgaacacttttgtggtgagcccccttgggaaaatgtatattgtacccattgtagttcaggttttagaactgaatcctttgaaggtcagatagcaagatgctttacttttgtaggtcattttgttgtcataatagtttccaccatacctaattttttttccgaagcatttcttcatttcaaaatacatttattgagtgtgaattgaagcagtggataaatgaaaatgaatgacatgttccattcctcaagcctagtgaggaacagccattgagtaaactcttcgctataatacgatacagtgaggactgtgatagaggtagaatcagggtgcaataagaccaccaaggaggaggttctttaccttggcacatctgagaaggtgtctgcaaagaggtggcctgtagaagcttggagggggagtagaagttccccagatggactaaaagagggctatgtgacagaaaaagaaaaaaaaaacaaaaaacaaaaaacagcaacctgccctcattttcaattttacacatttgctacaacaaatgtagaatcacttaagctgttcctctaggctctaagaagggaaaaacttaacatttaaaataaaatttaagtaactgatttccttatcaaacctctgtaaaagataagtttattattagtcctgttagcctgcccagatctcaatttgaataattacattcctcctacctaattcatccctgtagttttaattggtttcagaacttgacttgcttcttttcaattgttacgtagtattgttatttggtattaaacagctgttacgttctaccacagagctgaatatttttcagcaactgatgcggtgatttcagtcctataaggcagataaaacaatttgcgagggctttgacatgacaaataacccctaaatggatagacgtggcattaattattggtaacaatagttaccatccatatagtcactgctcttagaataacacagagtattgtcttcagtctataaagtcacacatgcacagaaaaattcttgtttccttagatattgtctttagatatacactcaaaagtattgatgttctttctttgctgatattatattagttttaattaaatacaagttgtagtatactaaggacagatgcttattttgttttttaatcaacttagaggaagtttttttgggtcatttatgtgtttggcaatgtgctatgtaaccattcttccttccatcacttgtttgtttatatcttactggggatgacaatattgaaagtctgcaactaaaagctactctgaagcctgacttcattcagcatgttcatgaattcatcatcttagggagccaccttattgctgccactgttgttaagggccctatttgatacccctaatggagactagcattctctgccatccattatggttttcatgtttggttaaagttcaggcccaggataagcaataatgacctaattagtagaaatgtaaacagcttccttctccatctctttcacatcaataaaaggttttcttcactcttttgatgaatgctgtggaatgtctgaaatatctgtctctgaaaactggtgttcagtgaaagatttatttctatctaaatgtccttaaaatgtaccacccaaatctttgaaaagttgtgcgacctagaaaaatgatcgccaccatgagacacatcctcactgctgacaactgtagctctgtgtccatggtctcgacctgtggaaatgaagaaggcagaaagcacttccttcacgttgcggggtgtataaggagcaagggcagcacagatagacagcatcagcatcagggagtcagagcagatgattgctgacccgggctggacccccaagagccagccaactccctgtcctctgtctgttgtggacacagcagtccaccctccataactttccctgtattgcctgctgcttccactccagaatggtttcagatgcccatgtcttgttttatagcatctcaccaatatgttcccaaacttccctgatggcaggaatgttccaaaagccattatagtcactctagaaaactaggaactacatcaccaaagtagcctcctacctggaccaccaacatcacatctctatacactggacacaatagtactttcacatacccatggtaactaaaatacatatcaaactcccaaagaagtcctggtgtataagactgtgtagtaaatatcagttccctccttcactcctctctataatcctgtgagattacgggtctgaaagagagggagttaacactacctgcagaaagtgacataagaatttagtatcccaagattagttttggcctaagggcaggaggatgcaatgctgagagaaatgcaaatgagtgaagagatgtctggcaagggcagagagaagccagaagcatgaacgagggttacaaactgtgcttcttctgggctgctgggataatggggttggaagaacagagaaagcaggaaggaagaggtgagtaggcctgaccttgggcaatagctttacctttccattccaggtagagaagtgtatctgtgcaggcaggaaggcactttacaagggtagcagaaagtggtgtgttccagaaaagaaagtggttcagcatgccagaatgaacgcacgtgagtggacatggcgggagagggtctggaaaggaagttgggtctgcttgtgaggacttgcaggccttgtacagagtcacccctatccccaaggcagtgggaagcaatcaaaggactgttaaacaaaagggcagtttctgttagcacaagtacagccaatatactgaagtggggagagattgtagagaagcaaaaaagaaacaaaataaggaagcttcttcagtagtccaaggcaacggctaacaagagcaagtatacctgccttcctcccggtttttttttaacctccgtgttactacatatccttctctttactcactgctgtgatggaatatggagcctagaaaatctagtctattttgcattataaagtatcatcaggatatgaaaactgctaatggtcatttggaaataggatcacaatggggaaagattgaacacctaggaacagaaaaaagaattaattaaattaaatcttgtgctgatgaagattaatattggtatttgattgcacctccattaaaggttttccaaatcaaaagttttaatcaatgtgtttcttcctggctttccataccaccccaactcccctgaggttaagccaaattaacttctaattaaaacatagcatttgaaaatgacttgtggggctttgccacataattaataaaatgaaaagaatggcaattaagttctgaaaattcattacctcattgagcaaacactattggaacacctgttgtctgtagtattcgacttatatgctaactgttggcactaccaagatggaaaaagctattcctgcttcttagagctggggcagaggcatggaatgggtacgtcaggattggactgagtgagagaaatgaaaaggaaatcctggaccccacaggtttcacagaggagtgggtcttttgctcctttgagtagatgttgcaatgagaatatcaacctcaagtcattaggttaaagatgagacatggctgcgactcttccgctgggcactggggtcagattgccaggttcaaatcccagttgctcacttaccagctcagtctcctcactggaaaaatggagagcctcacctcacaaggataattctgaggatcatgtgcgttcatacacacgaagtgctcagagccgtgcctcacacactgttatcattgccattaatattaagatcagtagccaaacactttacaataatgaagaggaaaaataaaataaacttcagcaagatcaaatatgtcaggaaagaaatatctttccccaatgtctcctccctctacagaagtatattttctccctttggccatggttctaatcagagagttatcatttctacaatcagacaaccacaaaaaagatactgttgctctcactttccaaaattctgcctggcctcctcctgaggaaagtgtgatatggtgctgtgtggatcccctaagggaattagaagatggagttgaagaacattatcttagactataagtctgtctgcatacagctatgttctcaaagattattcctgctgcaaataaagatcttgggaaagagcaatatagagttatcacagtctattgacccaaagatgtttaaaattagccctttttacccctcattaaccagattgattcatgctcctctcacccctaaactcattttcagtctggttttttaaatggtataaccaaccaaaatgcttacaattgttctcgaggtatgtgaccctaccaacatcattatgcccctttggccacttcatgaaatgcttctctgtagtttgttggcataaaacctgcaaaggtaacctttgtgcaaaaagagacctgactactggaaccatgtattaataatgtccttctctattagcagtcaaggtgttgtaggaagggcattgggctggatgaggaaaagagacctggctctagtcctggctgtgaccttgagaaaccacaacttctacagcttcaatttattcattgcaaaggggcagcaatagactttgtaaccccctattgttttactttacttcatgctctcaattcattaaaaatgatgaggccagacatggtggctcacgcctgtaatcctagcactttgggaggccaaggtgggtggatcacgaggtcaggagttcaagaccagcctggccaacatggtggaaacccatctctactaaaaacacaaaaattagccgggcatggtggtgcgtgcctgtaatcccagctacttgggaggctgaggcaggagaatcactggaatccagaaggcggaggttgcagtgagctgagatcatgccactgcactccaacctgggtgacagagcgagactctaagaaaaaaaaaaaaaaaaaagaataatttggccaggatcaggagatccagaccatcatcctggctaacatggtaaaaccccatctctactaaaaaatacaaaaaattagccaggcatggtggcacatgcctatagtcccaggtaccagctactcaggaggctgaggcaggagaatcacttgaacccgggaggcagaggttgcagtgaactgagattgcaccactgcactccagcctgggcgacagagtgagaatcagtctcaaaaaaaaaaaagatgaataatttaatcaaagatgtaattgaataaaatccttaatagaaaactgtaagattatttcatttcttcattcaacaagtatttattgaatgtccagtgtgcacctgaaccaggtacagtgatgggacaggtagtggacaaggatgggtctttaatggagcatatattttaatgggcagaacagacaataaacagagaaattagcaaactaatttcagattgttggaagtgctctgaaggaaataagtgagtgatgaatgagagaacagcagaagggggctcacacagctaaagaatgtatcacagatctctctttcttcttccctccctctcctcttctcctcaccccctttggggcagatacatcttaatggtggctagaatgataaagattggcatgaaggaaatggcacgaaggaaaaggaggagaggtttcctagagagggtgcagcccactacaaaaaccccaaggaaggaaaataattgggatttttaacaaaactaccaggcctaagtatgcacacattaacagccagtggaagatatatggctgtttttggaagctgcagagatatggttcacagcacgcagccatgtaggttatgtcctatatctcaaaacatgtctcctcccaaaagagctcttgagatgagcatatgaaccatatactgtgtgaaagccaatacaagcaagctgttttctgggatacaaggttcttgtgagaatcatatgagatgctcttgagtaagcctttgtaaacttgaccaccctgcaggtataagttattactgtgcttcctgctaatatagatcttgttgatggcttctgaaagcaccattcaccctaagtagacattcggaatggctctgtgggcagctgtgttctttcctgcttctatctgcctttgcatgtatcagactaaccttgcttggaaccctactcagagcatcacaaaggtgaagtctgacctttcattatccagacagacagatttgtgtttgacttgctcactgtgtcccaaaaaactgctcagcagcatgaatcagaaaacaccatctagatgacatctgggcaggggatagccagctacttctgtgtcacacaaatgaaaagccagaataagagtctcatttgggtcacgcatttcttcaggataataaataataataaatgaaagaaagaaatgtagataaaaacgagcacatgtaaagaagtgagcatttttctaaatcctctgatgagttagtaagtgacatactaatttacttactcttatttctttggtttaaataagaaattaaagataaggaaacagaagggcaaagccagttagtaaaggtgaggtatgaaaagagctgaaatattgccagaatatcctaccatgacaatctcccgatgctaatcttgccaacagtttcaatgcaagttatacaagaaccaagaatcttcatgttgcaatgtttcttggtttgcccaaatagaccttcaatttgatttcactgaatcttatgctgacagggatcagtactgccctgaaacatggttttctaatatgagctccaatgccatgaaataggatggattttatcaataatttcctgcatatcactgataaattttaaaatctatactttgatcagaagtcaatctaaatatatataataatctcataatattttttgaatattttttgaagcttcatactatttctaaataaaagctttagatttttagatgacaacatacgaatgaactactaaatgatctgtttcatgtcatagtttttaaaagcacctaatatagtgcctggcatataatggacaactcagtaaatgtttcttgaatgaaaactgttcagcacagtctatttctaacaagagtcaatgtaatctagcccccatacaaaccttaagtgtgatctagaatccatatccttcatttataaagtggattaaagtttcagaggatgcttgcaattagaaatattagccatgaagcttttagtgtctttgcggacatttttctaataccattgaggattagatcatttagtaagaaaatagacaaagatcccatgtacttgacatagtgccccaccccacccccaagccagctcttcagctagttgatgcctccttatctatctagttcagggtcatgtcctaagggaaccttcctgaccctaaatctgcatcaaatcttttacacacccatagtacacattcattgcactcataattctagccttgttaaggatctacttggagttttgtgaagatgaggtccctttaattgttcacacaattctaattttgtatctatttagttcattactctttgcaccctagaccataagatccttgaggacaggatcatgaaaaatgttgcttgccattttagcctggtgcctggccaaaacagagtgttcaataaatatttgtttacttcatatatgaagtatgacatggttttgtgtgcaggacctgtgtggcccattaagttatcttagcaatcagaaaagctgcctttagatctagtaaggtactctcctgtgttttcctttaaatgcccagatctaagtagggatagtacttcattccacctgaagataaagttcaaacatcatgtattctttctcttttctaagacaaacactttaaccagtttccctaaccagtttatcttctaatatctgaaaatcagctgtccttcctcctataaatctcattttctcccaatggcatatatgacatttacaaattaaaattaaactttaattaaaacacacaaaagagacaatgttgaacttggagtagttacagctcttctccctggaactccttgcagcaactatcattaccctggagaattaaagagaagtaaatttgattagctcagggacattggtctctgagataaagaaagacttctgctttcaactttattagagaaatacatctttaaaacgaatccatagtgttaatattccccccaaatatgacttctattacttctctggcaagggtaatcagtttgtaagaatgcctcttactatggaagccccaaagatcccaaatgctctcagttctccagtagattcagtataccatggatggaatcagaccttccaccttaaaatttagaaacaaataccaaactgaaatcctatcctgtcctctttttaaagaaataattgcttaatgccttttgcaaaggtacttcatttttagccttttcttattagcctttgtttcttattattttatttgtatctcttagttttcagtcttaatacccatcactctaactataattacctcacacttctacatactgtcaatgggaccagaacactaaaaccccattggcttaatatccctctcacctttgctcctcctagaatggtttttacctgtacaaccaagaggcctcctgcctagaatgtaggtgggtgtggtgggtgcatcacttgtacttaagatgccatggggaaagaggaatgtcttgagaaaatgccagtcaaaaatcagaacaaatcatccagtcaggctgaaggaacttaccgcagagggttcagcaccaagtggacagaggtgagaaaacaggtgggacagaaaggctgcaaggttaggagcaggaggctcatctaatttatcatccattttattttgagaatgaaaggcactataaataataagaggcagaaacctggactgtcgctgataaacagagatttgtgatcactgtcatcagaatgggaaaggaatccaaaacaatcctgcaggctctgctgtggtggaggctttgtctctgtccttctttgtccaagtgtccattgctgaccagccctcctctgatgggcatatgaatttcttcctttgtttagataaggaaataccatccatcagatatggcaagtcttgtctttcactgccagtgtccttaaggtgatatgcctggatgtccctaatgggaccaattatgtgttaattttatagtatagctattagaggaggacagacttatgtcctttattctcaagtttttgaaggagttcctccaccctcctttagttacttccaaacatttcctatattcattagaaggacttctgtttaaaaagaggtatttttcaaagttttagtgtttggcatcaagcaatcttgatgtttggcagaggaaaagcatccttaacatcccaacctaaaatccacatgttttgggatggacattcttatctaaaatgcaatcaaatcagtcagaagggcagggcatctgttatgtcagttatggtcatatgaatcatggctgaatttattgtacaagtcacagttatcaagctagaacataaaagcaaagagaaacaagcatcacttcatgaaaagacaactgtccaaaccatatttatgttatcttttatcctaccttctcgatcatttcttttttagctgatatcttacatagaatgtttcagttacctggaacaagtcacacaatgccagataccagatatggaagggatttcttttttttttttttttaaccttcttgaaattaagtcaaatttttaaatggcttttcccattctgagattctaaaagtattttatccttttcttctacaacatatatggtttcatttttttaaaacatgtaaatctctggttcatttgaagtttatctccaaaaatttaacataataaattttgagagggagaattgatagctttctgttgccacatattttgatctaaaaatatgggacatcttttcacgtgtccaagtcttactttttattcttccaagatggcttaaggttgttacttccacattctcattgttttatctttgagaatactatcctaaatggagtcttttcttcgattatgtcttctaacatgtatttatgtatacagagactattgatttctattaattgatgtcttactgaattctctcattgtttttatgcatttctgctgattctcttgggttttccaggtaaacatttcctttttttagtttggaaaggaaatctttctttctcataaagggttgcagcctgcagtgtggccattccaacaggctgggaagcacagcctcctgtccaaagccagaaagaaacacttcaagggagggacaaagggaacaggaattaatgctgaacagggtggccaaatgtatatattcaataaggtataggaggagtcatgaatatttatgagaagagaaacatgtgcatgcgcaattgagatttatgcaccttcacgggtcccacgtacaaaaaattgtagcattagcatgatctgaaggtagagcttccagccctctgatgtcaaaaggtgaagcaggctgggcaccatggctcacgcctgtaatcccagcactttgggagggcaaggtgggtggatcacttgaggccaggagttcaagaccagcctgcccaacatggtgaaatcccgtctctactaaaaatacaaaaattagctgggcatagcagctcgtgcctgtaatcccagctactcgcgaggctgagggaggagaattgcttaaaccgggacctgggaggcggaggttacagtgagcagagatcgcaccactgccctccagcctgggctacagagtgagactctgtctcaaaaaaaaaaaagaaagaaagaaaagtgaagcagaggacactttgggtattctttcttatctaaaaatagtaccagatttactttcttctttccagtttttacacttgtaatttctttttctggtctaattttgttaaatattagtggtagtggtgggtatccttgtctcatttgtaacagcaggaatacttttttgtttctccagtaattttgatgccagtttttgactaacacagatgacaaatggatagataaaaatatagatatatatttattacatcaaggaaatatttatcaattcttactttaaatcatgtttttttaaatagaaatagttgctggatttaggcaactaccttttctgggtctatggagatgactatatgttttacctaagtctgtaaatataataaattatattaataaatagtctaatatcaatccatccttgtatttctgaaataatctctacttggtcataaagtgttattataatgtgtgttgctagatcttggtagctactattttatgtagtatttttacattgatatgcataagttctttgaggctgtagttttcttttttgtgcagtgcttttcagcttttggtatcaatgttgtgcagacatcataaagaaatttggaagctttccttattcttctgtgccttagagaagaataaattgtggggaactagatgctctttaactatatggtaaaattcccagcaaacttgattgattgcctgctctgagccaaacactgtacttggttgctagagatacagagatgagtgagggatggtccctatcttcaaggaactcaccatctaatggaaacaataatatattacaaaatggggtattggtttctacagtgaaagtatgtaggaagtgctaggagaatacgaagaatggtttcataaagagagtaggaaaccgtgcccaaccagtgttggtgattctcatgagaagggcaagcaaaagcccaaatgaagttatttcagaagctctgttccacaaacctgcctctgctgctgaagttcctgttgtagtctgaagacttttttttttcaattagaaacatcgtaagacttaaaacgcagctgcccctgggagatatgaaactgccacttaagtttacacccaaaaaaaataacttacagacatctcccgaagatgattttggtacagaaacagtaaagattgtaaggtccccagcatgaaagtgagactaatgaggaagttctaaaaggggaagaaagggccgtcaaaggtaaactttgtcaaatttactcatttacctgagtctacccaggatgcaatcaatgagtagattagcttgtctcttcacaagtgtctctccctttctctgcccccagaaagttttattgaagaattatacacatacacaaaaatacacaaatataaagtggatagcttaattaattctcacaaattaagcattcccatagaaacatcagcccctttaaccacccccaaggggtattctcctcacttctatcatcataaattagattgcctgtttttgaactttatgtaaatgaagtcatgagtgcatgcttttttcttcttcttttttattatactttaatttctagggtacatgtgcacaacgtgcaggtttgttacataggtatacgtgtgccatgctggtttgctgcacccattaactcatcatttacattaggtatttctcctaatgctatccctccccctacaacccaccccatgacaggctcctgtgtgtgatgttccccaccctgtgtccaagtgttcttattgttcaattccctcctatgagtgagaacaagagtgcatgctttttttgtatctagtttcttttgtttgatgttatttttgtacattccagccttgtgaatacatattaatttaattatcattgctgtataagtattgccttgtatgaatatatcacaatttatccattccaatactgatgagcatttaaacagcttccagtttggagctattgtgaatatcttgtaccgcttataagcattcttgttcatgattttttgttatccttcctttagggtatatccataaaaagtgaaattgacacgtcactgaataggcaaatgttcagcttttacaggtacgaccagttttccaaagtggttatactaatttatattccctccagcagtatgtgagagttctctttgctccatatcttcaatggtatttgttgattcccatctttatcgttttagccatgctgtgcaatccacaaatgaaagttagtttagtgctttgtaaaactttggctaattttgattaaaggaataattttttaaaaaaagaaaaataacagaaagtttttaagtaggcaaagacttcattattcagatgataaaagtccgctatttaaattaattttcatttagattgatactaggcaaagttctaacattgaggacttgcccttttaaatgtttccattctaatattgctactttattctgcacaccatagctctaataaatgacattgccaagtgtgtgtaataataattgctttgaataaataatgcaagataatgagccaaagaatagtgttttgaattacagagaaaacagtgggctgagctatgataataactagaaaaattaaagaagtcaatcagaaggtcaatacagttattaaagagaaacaaagcagagccaagcaaagagatatttttctactgaggttgtataattccttgtaaaatgatgagttaaaggtcatgaagaagaagttgcaaaaatatgctttttaatttttaggatgttttctccaccatgattcatgagctctttaacaaaagctacccaggtaaaagtggcaggcaattgtacccattaatgcaaatactaagcgcatcctccttttaatattaaggaagaaaggaaatggaaatggaaggagtaaaacagagaagtgggaatattctgaaacggtttctgggaagttactttcatgagatacggatattttaattttttactgcaaactctatccagaatgtactcagacataagtgctaaaaaaaaataaggaaagcctattttatacctttctattcattcttaagtataaatttttaaatatacataacatgtgctttctcctgtagtagcacttatcagtgttacaactgactgtttgtcttcattccccatagactatgcactcaggaaagtcagagacctttgaccatttttctctattgtatctccattgcttatcatatcatctaaaccactcaataaatatttgctgaataaatgaatgaatgaacaaacagggaccgagactaggttaatactttccttagtccttcactgactaactcccaaatctcatctttcataccttacatcttaaaacaaagggcagggagttgaatctaatccattacactgaatttctttactaaaagaaaagttttgcatgcaggattctacagcaagagagagaatgagaagaccaattttgtccttgaggaaggtcaggagagggcatgaagcattccctagaactctgagagcaaacccaaaaattgaaaccttactatgaaaagcttgtgagaactacatgagggtatgaagaaatggtgacataatataaaagaaaaaatattcaagtgtaattgttttgaaataacaacaaatgatagcaatgagagaggagagaaaacaagaaagattaaggtttttgtaattaagtgattctaaatcacaccactgtaagtaggacaaattttagaatactgtattttataaagagaaaaaaacttgaagtcagcaatgctcaagaccaagaagggaagctggggtagcatggatcgtactaaaatgaaaatagatttccttaaagagggaagattgaacagatttctgcaaaatgtgatgaatagtaatgctcatcaccatgagacgttagtgaagataagcctctcaaatttaagctagatccctgaacctgggtcctttgcaactcacacagctgccaatgcatcagccaggttttattttaacaacatttacaatttccctttcagttgaagcaaggctgagggaccatctgaacagataatgaaataactgtgaaagttcagagcatgctgaacaaaacaaaatatgttttgcctgatttatgcaaactaaacatattgtcaaggttttgaagcagttagtccaaaatatgcacaaaatacagcaatttctcaagtagcctggcagcagatgaattcaatggtaatatgtctctgaaacagtttaatcagactatgtagatgtgctgaacattttgatatttttgtggtatgaattcatgaataatgtcttttccttaaagaatgccctaccaagcttaccctaaaacctcaactcttgacctgtcgtagtgcagttcttcccttaaggattctaggagcgtcttcatttttgaagcatctgttaaagaagaaatggaattaaatgttaattgctcctttccctgttgtaagcaaaccagatcaatggtgggcctccactgccgtttcttgcacactgtgactcatcccgaggcctccagatgtggaacttccaaagccaattggaagaaactgttctttgatagctcagaaaacgtccaggtctttctgtgtctgtggggagtttttctactcccaaatatggctgcaatgaaaagatcattgaattctgcaaatatctgaagttagagaactctgaaatccaattttttgtacaccctgatgtgttaggtactggaaaagaaaacagcctttagaaaaatactctttcaaggccaggagggtaggggggcaacattgtccttagaaaatactttaaagggttttgaatgaatcaaagagtgtctgcttatgacaacttatcaatggttttacatttctgaaagaggaaattgtgattcacagggcaaagccttaattagggttgtggcaagtggtgctgaaaaaaatcttgtccccttctcgccgtacaccccctcaccgagcaggttcatccaaggcctcccctgtaggactgaagaatagacactgcctactgcctacttcggatgtcactgtaatcagaaagagacatagcaaaacagcccagatagtcattgatttttctgtaatggctttggagcaagcaaaataatcaaatgtttgactcaatattatctcggattttggtgtgaagagtttttgctcttatgaaaagccaaatgtcatcatttctcaacttctttgagggtgactgatcagatttctaagacctttgtttttcacctttcctcattaaactctgcagtagtcagtttcattccacagaatttaacatttctttcagtaactttctcaacagaaacccaataaattatttctcctaggaatttatgggtgagttgcctaacctgctggatttattgttagcaatttttaggggattccttagtgactgaaacaagtgaaggcaatggcttgcaattctctcctcacagaaatcttccattttctcagaatagtacctgtaaatgtttttatgctcattctcagtcgttctaaaatctaaactaataacattaaataaataatttctactacacttcaaaccaataaagtgttttataaatatcttcatggatgtctgtcatcaaatgggaaatctgagttggggaggaaggattagctaacaatactgtcatttcacaagtaaagaattatggaaagaggcatttgatggatatatacagatttacccaataggatttcattcttaaaatgtgctactaattctaccacaaaatggaaaaaaatcctgcaatggttctatttctaggcaagggaaatttatcctccaacaacaacaacaacaacaaaatctttaaagaaaaaaattatggcctatcaccctagtatgtaacaaaaatattatataacttatttagtaatgtcaagatattattttctgatattcagacaactagataaattcaaatctattactcctattacaatgcatccaaatccaatattgtttgtaccttaggagagaacttgatttggagtaattatgtaataggcagcaaagaagaccaatacaaccttagttccaccattaacttgatctgtgaccttgagactgtcactttaacttcctagggctcccctggaaaatgcacagtcgtacctccttcatacactgctattttaagaactaagtaatatgaactaacacagtgccatgccaggtgggttggagaatcttctaggtaataatgatgtaaatcttaaaattaattcatattgaatgaatatattttatgatgctagttaagagaccatctagttttattttcttattcatctgctaatttttaggctctgtatttcccttcagtagcctaaaataaaattcttcctcttctactcctcctgatgccctccttggtacacctacaggatgccaagatacactgtattcactgacttctctctcatttctcatatttaattaatcaccaagtttttccaattcttttgttcacagcacctttcttttccattctgtctgagtttagactctcccaatctcacacctaaacaactgcagggttgcatcttggttctactgcttaccagttgtgtaaaaccattctttcgtgtctcagattcaccattatttatttgtagaatagtgagatagtaaaacctagaactgagaaagtaagctcatcctgctagcaatcaggctgtgatagcaggtaggtaaattcagagacaaagccaacacaaaataatgattcttccaaggtcacgccacaaccacaaaacatcttacaccctttcttttgaacaagtactgcttttttatcaatgacttcccaagacccattttgttgctctgctttctaaaaaaaaaacattacagcactacccagtcactaagctacccccacttcatggcagcaaccggcccagagctaatgcccatttctgctaatccaaattcagaaatagcacccaatccagaggtgatccccattcacctcagcacccccttagaaatattcagccaatcccaaaacctacaaaaagcccctgcctacttattcttaccaagacacttgacaagttctcattagtgtaggctcacctttgttgtagcaagttgaataatccttctgggactacaggtgtgtttcttattgtctctgttgcatgagataatatcaataggaataggaatcaataggaatgtgataattatagggaattataataatataattcccttaaggatgctgagagaattctatgagataatatatatgcagcacttagaatgctaggtggcacatagtaagccctcaataaatactagctgctatttttatttttgttgttatcatcataatcattatcattctaacaccttccttattgatatatgcttccaatctcttccctcccaagtcactctgcatgggacttcatgttattctcatctatgtattccactatctgaaactcagcagattctccactgctatcaaataaagtgcaaactgtctaaaatctaacacctgttctgttgacaccaagtacctgtgtcttcatattctcctaccagatgcctccactctagttggctggttttttcctggctcccaaagcacgggttacacatggtctgtgtgcttctactcaagacaaactcccatcttgtaggccccctgacttccttcccatctctccagatacccatccttcagcttactgcaaagccttcctcctccagaaagtaccctcatcaaccgctcatcccctttgagcagcaccaagcctgaggtttattccactgacttagcacaaaagcacaaaatcatatccttctttgcatggctacttttgccacaaacacatttttatctagacagtaagcccaccaacaagtactggatcacatacctcttgtcatcacaaataattttatcataaataaatgatatcccttgaataaagagcttcacaaatcaacctttccattttcctaaatagtatatttattccaatgaactttccaattaatttgcacaatgaatttctctaagcatgcagggctgtcagggtggcctcctcaatcatgttcagagtgggattttcaattcccaactgcaaaacagatagataatttgcacatagttacattgcctttatctgtctttcataaaattgtatctagatatacttccctgtatctaacctatgacttttttttttgctctgtgacagttctcctttaaatttttcattttcttactttgtgaaatagattgtagtgaatcttatgattatttctacctcaattctttccctctaaattaatttaatattactttctttgcctcttgaatttttcaaaactaaacttatcctctctaaatttcttatcccacttctgatcctctctgtcagatcattttataataaactttcattttgattctgattcattcagacagaatcatcctatttccataagttcactggttctgctagtgtcttctgaacattctttctttcctttgaggatttcctgctacaaagtccagggcatattttcatacaaaccaaacacatttttcctagtctccttcaaaagaactgtaatctgctaaagttttttttacagtattctgtaacatgttctggtattcttttcatacagatttaaatacttcaaaatgctgaattaagattatattttcttcttcaattttcatatctcaaaaggcgatattatccaatagacaaaaacacagaagaggttggggaatttgtcccactgcgactttcttttgctcctaacctttcactgaaccctcttgttcatatgcccatcaggcatcaaggaccattttgctggcccaggggagtctgatctgctttttaaaactgttaaatatatagtgtttattattaatatgcctgattattagaaagttagtctgctaatgtgctaacgcatgactaaagaagatctgtacaacatttgcaggggttggggcagcactaagctcaggtgtaaagacctaagttcaagtaccagctgcaacctcttgtagccagatggccttggatgatgcttagctgctctaaacctccgtttccactatgaagtagggataataatagctatgtaatggagttgttacaagttttgcaaagtgtgaaatatcatcatagaatttgttaaagaatttgaagctagtgatctgttttctggtatactcattcaaagtaagttcctacacacacacacaaaaaaaaacaaaaaaaaaaaaaaaaaaacacacacacaccaagcccccacagtgtgtggaactggaaaaaacagacagtccttaattaaatgtggtaccattcaatttaccttctataagcagtcacaggtaacgaatgaaagggtttgctttgtttagtttgtgtttttataacaaaggtgaagggaaggatggagggagggagggaaggacggagacagagagacaaagggaatctgcaagtcatcctttcttcctgcctctcccttagcctaccactccccacacacatccagtcagttaccaagtccagtggattccgccacctcaatatatcttaccctcatcccctttcctccatcctcttccccactaccaccaccaacagctcatcccgtgctacttgcaactgcctgcaaaccagtgtaggctcactccaatccatttgctaatctgatcatgtcactgtcttgcttaaaaccctttggtgacctcccagtcattttaaataacctttcttcaggaattagctgtgtgttcctgtggctgctgccctctccttcaacaagactgatatttttgcctttatggtacctgccagatgctgtagtgtttgctggttaattgtatatttgctttatgtttcctcccttctggaaagttcctagatggggagggccagtgtcacacacagggccagtgattggtatctatgtatcgaatgacgtgacagtctagttgcaaagacaagacacagataggaaagagtggagaatgcatttgagacaacatccagtcatcatgtgccacaggctctacgcttaagtgttgagtgaggtgttctgatctttcatagaaagaagcaagcacagtcagcatctctcactcactgtctctccacctccaccaccctagtccaggtgccatgattcatcattcattctctttctgcttacctctcgccaccctggcccccacctcctagccagtttaatctccaatagcagccacaatgatcttttttaagtgactataaatcagcttacctcactcccctgtttataactctttaatggttttctactaaatttagaataaaatctaaacttaggatagggttctccaaattcagagaccttcctagttctctgacctctggctggaatctttgccaggatcttcccaagatggagatctttcctttctttcacatctcagcttaggtacaccacctcatttccttgacctcctaaagactgtccatgacaggtgtcactgtgggatcatttatttgtgtgcatgatctctctctcactgtgacccctccccacccaaccccagcagctccctgagcaaaaggcacccatccacgtggctcaccactattttcctagtgcccagccttccctggctcctaagaaggaggaagggaatgtttgtcaaattaatgagcactccctcatgttctgagcaggtcattttgcaaatccttcatctctgcttttatcaacatgctctctgcctcatctgggatctctgtaacttaggaacctcttgaatagcgtatgtttgctaagcatttatgacccagcagaagccagaaagagaaagccaccatgagtcatgctgtgcaattttgagtaccttgagaacaggtgatatttttcacagtgtcagctgcagtgctctgtaagtgcttccctgttgccatggtaaaggttttatgaagcaaatccagcctggggaagcaggttatcaagcactggagtctgtgcacagacactgtctcccaaaaggaccctggacccagccaagggtgttgttcatggaaggtccttcattaatcgtgatctgagttcagtcaaactgggatttgatacctgtcatactctacttccaagctccttgtcaaatgcaagtttccaggatttcagatagaagattcatgatgttcaagttgttgaaactaaattctcaagaggcaaacacctgtaatttttctacccataacaataattatagctcacatttattaagcatttactttcattgtctcatgaattctaagaaccatctagctagcagatactataattagctccattttacaaatgaaaaagccgaggctcgaagaggttaagtaaatggtctcaggtgacacaggaaatgcaaagcaagctaagtgttggagctgagagcagaccaaagcccaggtgtcctgtcaccccgagggccacaggctttacttacacctctaagggctttccatgaaagcctataccagttcttcaaggaccctgggagccccatcttgtagctggtatacccaacaagcatgggaggtggttgacaatcacaataagccttttttaaatttctcccacccctttgaactctatacagtatgagtaatattgttcttgtccacagaccccataatttttcttctcactcagagggagctatttcatgtggcaaacacagtcttagctgtgcaattcaaagtattagtcaaaacttggaacttgaccaaatatcaaatctctgccttctcagcttggctcactttaggccaccttcatgccacccccttcctgtatccgttctgcaggagtagggtgagacgcaagggagtaagactgctcttatgtgaactagcatccctgtaagctggcttcctgctcctcagcccagcaggggtttggaagctgactctgtgccatgtgtctctgtactctggaggatccctgctgggttctgccccctacagttccccagcccccctgtagtggccaggtgtcacttcccaggcttccctcacctcccaggcatctcgaggtgtgccaccagaccgctgctgctgagaccctcttacctctaaaacaagcctcttgggtggtatctaaggaaatctgatgactctctcctgcttcaccctaggcacactcatgttcctcatctcccgaaactgcaaatgcaggcccatcccaaagaagcaattttaatgtaatgaaaccaaagcaatgagtccgcccttctctatagatactggttaatgatgtcccagttgcagagacaaagctgagtgtcccacagctgcccccattccccatcactagacctgcaatgaaggagggagctgccctctgggaagagagagagtggatgggatcccttgcaaggcttcctccgtagacctcctcacagtcccccactctctactctgcactctggctcctttttgaaaaaatggtggtaaaatatacataacataaaatctaccactttacccattttcaagtgtacagtttttggcattaagtacattcacattattgtgcaaccatcaccatcatccacctccagaatttttttatcttcccaaactgaaagtctgaacccactaaacactaattcgtctttcctctctcttctcccagcccctggcaaccactgctctactttctatgaatttgactactctaggcactacatctaagtggaatcatacagtatttgtccttttgtgaaggagttatttagcttagcataatatcttcaagtttcatccatgttggagtatacatcagatttccttcctttttaaggctaaataatattccagagagagagagagatcacattttgtctacccattcttccatctatggcatttgggttgctttcacctttttgtatgtgtaagtaatgctgctatgaacatgggtgtacaaataactctttgaatccctgttttcagttcttttgggtatttatccagaaggggaaatgctgcatcatatggtagttctatgtttgattatttgaggaatcactgtaccattttccacagtggctacaccatgttatgttcaccccagtagtacacagggctccaatttctctacgtcctccctgatgcttgttattttctgttgttttgataatagtcatttcaatgggtgtgaagtggtatctcactgtggttttgatttgcatttccctgatggctaatgatggcaagcatcttttcatgtgcttactggccatttgtatatcttctttggagaaatgtctgtctaatttctttgcccattttgtaattgcattgtttggtttttttaattgtcgagttatagagttcttcatatattctggatatcggtcccttatcacacacatgatttgctaatatattctcctgctccatgggttctcttttcactcttttgatagtgtcctttgacacataagcttttaattttgatatagtccaatgtatctatttttcattttgttgcctgtgcttttggtgtcatattaaagaaatcattaccaaatccaatgtcataaagggtttccattaccttttcttttaagagctttataacatttgcttatgttcaggttttggtctattttgagttaatctttataaatggtataacgtatctgacatcctttttaaggtcttaatctgctgtggatcctagcatcatggattttcattggaaatctcatatgcaactttctcttatacttactttggtatccattacgtatcatatcagtacctcagtcatagctgaggctggaagagtctaattctaacatctgttgatgggaagtatctacaggaagtaggaactgccgattatcaacagtcttcccgtaggatcccatagaacacaaatcctactgcagtagcaggtctacatgttggtgttttgcatcctaatgaaagtgcattaggagtggaattttttatgcctatgaacaataaggaaggggaagaggagtattcaactggaagaagagaaggctgcgggggataagaatagtttgcaagcatatgacaggggttgtggacagctgttcccgtacctcacggaggaaagaataaaaggaaataggtttaaattgcagcatggaagattaatttagatatttcctgagagtgtgtatctaggttaccaaggatggtaaatcttttcctttagagatttatctttttaaagaaaataaaagtgaggttgaatggaggcggggatgaagtaattgactccttagagtcttccctattgggacatgatattgcagaagaaaatccatattttgaaaagaactaatttcttcactagtcagtaattttgaacacaaaggattaaaatccaaagcactctcaggtataacttccaaatatgttgctgtctattgcctttgcacaatttctgtgccatttatgatggctaaatgtaagcagcaggaatagctacatagcatctttgtattgcttttgcttctaagttttctgccatatttgttttaatttgaatgctgcagagaaaggatcaaacagtggtaaacatttctttgctattatcgtcatcttttgactggccagtgtattgaagagggtcctggcttgaatttctgtaatattagataattcaataattatttatgtttagttttagaatatatcatgtgacttagcagggagagattgaccttcatatgatggctgagggctggggaagctggctattagtaaaactagttttcaccctctgagcatctaccagctgctcagaagaagaaaagaaaggggagaagtaacttggatgtatgctaggaagtcaatatgacattgagatttttttcccacaagaaatccattaaatagatccttgatgtgtgagggaaaccaaatctatcctttaaaatatatcagagatattttttaaaccaatatactctgccatggtgaaaaattccaaccaaaacatttccttagccatgacctttaaaaaaaaactgaacaataaaggacaaatgagaaaaatgctttaattgctacatcgggacccaagagttgtagacagatcctaaactccaacttttattcactcatttacatagtcatttaacaaacctttatgaatgtccactctctaaataggtcacaggccaaatattggaggtacaagcctcagaaaggcctcatttttttctgtagctgggctccctttctgttctgtgccttcaattttaatgaatattgttctttctacaacaaaatatctttctaattgcaatcatatagaaaaagagaaaggttgatgtaagggataatatgaaatatatgagaggagaacaaggttaaataatacaagtttctttcttttttttttttttgagatggagtctcactctgccgcccaggctagactccaatggcgtgatcacggctcactgcaacctccacctccggggttcaaatgattctcctgcctcatcctcctgagtagctgggattacaggtgcctgccaccatgcccagctaatttttgtatttttagtagagacggggtttcaccatgttggccaggttggcctcaaactcctgacctcaagtgatccacttgcctcagcctcccaaactgctgggattataggcgtgagccaccacaactggcctataagttgatttctaaccacttctctcatgaggacccagcttaagtattaataatcaaaaaaataataatcaaattgtaaacatggtcttaaattactatagtatattgttaagtaatgggctgagcgcctatgagaaaatagcttagtttttatggaatttcaatatgattctgtttcatctaatgtcctgagtgcttggattgttaaagtaataagcatcccataagtacttatacatatttccattaataaaaaatgggttaatgttcatgctatgaggccattcatcatatggccctagcagagaagttggcaggggtacctggattttttttaatgtgcacattttattacagcagctctcctaatctcataggattttgtctgagaaaggacagatttgccgctgcagggtttcagtgtttatccaatttgaaaaccctggacatgttacaaaacagcacatgggcttccatctgtttgctctttctatggatctgttttttgaaaggattgaaagatttattatgctaaaaatatattctattctatagttttcaaaccaagctaagatcattcattttccaagccgtctaagaatgaggatgctataatcacgcgttctttaattctttaagcctagaaagtcctttacactacttacctaaaagtcccaaagtaaaacacacactagtagtaaggctagtgcatttcccttctagcactcaaagaaagcttaacatttttgacagtttgcaaataccgccttgtatttctgattcagccttattcaaagtatcataataaaatattattaaatgtatgttgacctgtgtgcatttatgatctccagattaacgttaggcttctctgttgggccctaacttggaggtgctttttggatccctcctcccgtgattcattgtaatttcatttcccttgtcatggctctgaccagagaagattctaaatatctgcccccaaagccaaaattatatcttttgaaaagtgaaatgaagagttgagtcagtaatttattttagatattactgcctaaaacaattccccaaaatttatggatgttggaggcctgaattatgattcctgaagacactgtcttacaggacttatgtacatgaaatactccacatttaactgaattcagtcatcatccaacttgccacatcactctagaagagcagcctagattaatgaaactactttatcagtaaatggtagatacactggacccaattgaaatcttcagaatgaatggaaatctactaatattgtcagaaagttgttctttgattcagtgataagacagcttctgtataaagagtagatgggataacaatgagggggaattaatatttgcacaggcgttcatagttcccaaagaattttttagaaatattttctcgtaagttctcaccacagctgtataaggaggatcctgtttttactacctcacagatggggaaagtgaaaattgcagaaatgaggtgatattgcttcaggtcacattactactaaatgatgggttggaactgcagcctgggtttggtgcttctaaattgcactttctttttaccatggtacattccaatattaccctttaacatattgttctatttggctttgtcaacccttttctaggactggatcatttgaaataagccaaaaaaaatgtgtctgaaattaaaatgtcttactgattctttttattatgtgctcggccttcataaccatcaatatatgaatactgggagacaaagtgaaaaattgtatccgaaattattattctctgtgaggataaaagggtagtaagaagggaaaaagaaatggaggaaaaaagctgctgcttcaaaaaaaaaaaaaaaagccaactaggttttccataattggtcgctaaaaattgctactatttgtcaactgagaatatccagtcttcttcaaaatcgtatttcttctcctcttcactatgccttcagcttttagtgtaacacagcccacttcatcataatctccttgccttcaaatgacatactcccacatatgttgctgtaacagcagaaattcttggagctgaaaaatgtcttcatattttccaaaaaaaaaaaaaaaaaaaaaaagcagggagggaggggaaaatagagtgagagaaggagagaaggagacctcagcttttctatccagacgattatcctcacctgtggaaatgtgctcacttacccacaggtcctgctcaaccaagatggacccattcaaagattcagggctattcaaaacccatcctagtgctaattcacacttaaagaaggaacccttggacatcatatactaaatagaacaagtcaacccactccttattcatgtaagaactgcttgtcgagttctcattactatccatcccacccatcccagaagtaacttgtttcatgtttcatttaccctcctaaccatagtgcatggtaacattccattttaatatctatggattggattatctttcatggtttatggaatgcttttcagtccatctgtgtacttgatcatgcttctggctcatcagcaggcagacatgcatgcctgtccttccataggcacaccagaactagtaatcaacacctggtctcttggttttgaatgccattttaacctcacccaggtgacatcttttatctctgctttgtggcactgggcaaaagaaagcaataaaactttgagtgacacgaggctcatgcctgatcatttaatcttcatttggaatgaggaggagattgagatagtctgtggcttcacaaaaaatcccaggtttaccaaagctttagctcaagtcttaagccacttatgtttgaattttgagcaatttctgttttgttatcctgctgatataccaatgccataaaataggaattaattttaagtacattagaagccctcttaaccttctgctttaacaactactcagattggccttgcgcctcatgccgtgggtagtcatgctgactgggcctcctcccaagccacaggcttaggctgcgggctaccccaggatggtcttgcacttttacccccacagcaagagctctgtgctcaccaaaatcccattacattcatttacctcatttatacttgtattataattatgttatttaagtaaatattacatctgccaataaaatatgaatgcccaaagagaaagagttgtttctattgaaactaaaatgaatgccttagaaagacacgatcaaagcaagttttaaaaaatcaccaacaaaccagatatgggttataaaagattaagaaaagagagtgtaaaactctagaaggactgtagattgtttgcaaagttttaagccactttagggaaagttaaatgggacactgaagattacactttgtgggtgtgattcaaacagtggacacggaacataaattggcagacatacatgcatatttatgaggcctttgcctatatcaaaaggttatcaaactaatgtacatttatatgttttcaattaaaataaaacattgcaaatatgttcatgtcaacttttatgctttcccaagttgttgaaccaatttttggtcccaactatgtggaaatacttcaagaacccataacaaagatatgaaattggagtgaataactgttcaatactttgtctgagaaaagatgcaaggaattagaccttatatattacatgaggtatttgaagagactatccttcacacaatcagatcatattatacttgatcttagccaaaaggctaagaagcaatcagattatattttaagtggtcattttagaacattgtcttcacccttttaagagtcagattttgaaactatcttctagtaatgccataaaggttaggaaaaagaattggggaaatcttcaaatataaacattatttggctgatccttaaaggcttaagagagataggaaagacagaatttgaatcagaagaactaacatggaaacatatttttacaggaatgtataatgtatgctgtaggagtgaaggatataatccaagttgtcagggaaaaggtgtacatgtgagagaaacttggaaaattacattataaaaggatggcctggaatgtcagcctaaactctttggactttattttgcagaaaatgagttatgaaagcatcctagcaggatataatatggtcagggttatattttcatataatgaggaccaataaaagataattccctgaacttagtaattagaaaattatgggtgactcttggggaacagttttagaaggattggaggcaaaagtctagttcaaggtaataatgagtacatagtaagggaaatttgagaaacaacatagacattacttttgagaagttgcacagtggatgccagggaaaataggactaaaattaaagcagtaccagagctgagggaagattatttaagggtttggagacctacattatttgtaagtgtcaagagctgtaaagggtctgagacttaacccgcttccaagctatcaagttagcatgccacagttccacagatgctggcagaagacggagcccctgagtcagagacaaaggactttattactgcaatagcagtaaccagagaataagtgttttctcgtgctatttcccgtatgtccccgtcccacagggcaacagagagaaggccaagtgacacctatatacacagtgggtttctttataggagagaaatgctgggtttagagatcccaaatcttttataagtgagacagagagcgagatactctctgtcttccaaggctatttgctatataaacatccttaggatactagtccagaacaaaggcagccatgcctctgctcaaagacagaaagatacataggagacctatggagaactgtttcccaatagtaagtaaaagagatttggagggggaaatattgaagatgataaaatattatcagataatttaatgcataaggtttgacaaggcgttaaaagagctagaatcaagagcattgaaggtaacgttggttttggaaagcagaaggaactgtttctatctagaaaaggagagatcaagcaagtaatgagtatgttacaataaaattttaaagaataaaaataggaagcttcaggaactttgatcagcatgaagagatgaggccaactgtgaagatctaccaggatggttcaaggctgggagtagggaaaggtaagatggagaagacaggaaaaattttctaaagttttagatacctactatgaaaaatgtgacacaatgtcaacaaggaacagataaaaagactgcaggaaatagtgaggttctagcataggagaggtagattgtgtgacttcataatcaggcagatcagaccagttttgtgactttgaccagtaactctctgctctatgaaaattgaaagaggggaatcaaatgataggaattatttagggtgggagatagcagaaggcctagggggtgaggaattctaaactaatggcatctttaggagaaaaaggaaagttaatcattaaatcaaaaagtgtggaaagcaaggagctgtccagcagaagtgtggctgatagctgggaagtacagatgttacagttgcagagggagaatgcagttccacagaggagcatttctaaatgaagaagggccttcagagttgagaggaagaaaagttagaagtcataagaaggcctgtcaatcaattgactcagaatgaaggcagaagaagacagcatggacaaccaaggggtccaccacccttcctgttaattttgtttctttttgtagacttgcatttggctcttgcattttcttacatcagcaaatgtgattttgcccaagtgacagcagtgatatgttgatacaaaccagatactgttttctccacaaaagcatttttcttcccacaggatttttaaaataatagtacactgagaaatatattcattctgtttttcacataaattaattatttctaattatctacttatttatgcatctgtgtgagacattatttaacctacacaggaatcaagtatctcacattttaaactttgcattgtttccttagtgtccttaacttcctccctctatcaagtctcttggtggcaaaaatatctcattatactaataaggaaacactgaaggaagaaacatctgaccctgcagattacaagctatgagatgactctagagtttcgatatatttggagaaccgttgctacagggggaggaaagcaattcataggagaaaataatagctgaagcagacagggcatgaacttgggtcagttctggagcgatgtgagcatcagccttcacttaagcctcccaggagacaccattcccaaggactccttctctagtccaactgacaggaactcaaataatttcaaatctttgacatggagtggaaccaaaccaaaattccttgctggaagtcctgagccacaaacctgagccaggcctagagcaggcttccaaggaactagaactttcctgaggcaacttcagtctcctgtttggcacaagagtaggggagtgatcttggtgtccatactagtattaattgatagaaaggatgcacccaacctgggcatacctttctgtaaaagaaatgaagtgatattctgcttgtcccagtgacatttcagggaaataattactacgaagatacagaaaaaaagccaatcaccatctttgagtataatttcggaagtcatgcctgaaatgtatatagtatcgccttcttgtttttgtcactctgtgtggaaccaggcaaataaggcaaatgatttctccaaatagtgccagtgctaatgattggaaaaccagcaggaggaaggggatagggtgattcctttagtgaatattcctctagtgaggctcattcctcctgttccaacaacaattttacctttgtagagtaactcagcttatacattactgagggggtggaaattaagcaaatggagcatgcatgtggaacagaagctcatcaggacaaattctgaccaaaaccactttgtcagagtatttcagatcctgaggatgttcctgagacttcacattaatgcagaatgtagttgtgttttcaagcattttaatttcatctacaaataatgatttttattttagaaagaaataatatacctcaccaccctcaaaattaaactaaaaccagctgtagttttatgggatatggtcactttgccttatcaggaaagagaaagcaatagacaacaggaaggtaacaagctaagcataagctccaagatgccaaatgaaagatggagagttctcaaggcagagttctgggaatcatgttttctttattacaactctggcaggataacctataagtgaatcgcctctatcttttaaggttggcactgagagctacgggaactggacttgacaatacttactgtacttcaaaataaaaatctgcacttattctgaagttttgtgtgcaaaaagctcccagatgtgtaatttgtaaggaccccaggggtgtaagcaaactagaaagtacaaatcacatatggcacaagttgaaaattcacaattatctgattaatgggatagtatggagagccaaactgagtaaatcagattgaaaatctacctctttccctaaccattgcaaattcacttatagaaaatattcattcattcacactcccattctctccttccgcaatcctactgatgctcattacattcaacaggtgctgcgctagctgtgaacctgaacagacttcagagtacacaggcctcaacatttgactttcccaacatatgtcagtcttgctctcactgcctttttccttgtctttttgtaataattcatatttaacatttcgtcctttactaattttggaatgtaacagcaaaattttcaattgggatgttttgctcaaagaattctctagattttaagttaaaatgtcaatgccacatctattccacttctgttcacctgcccttgtttctcttttcttgaatttgccaagtgcctatcacaggattaacagaaaccagcgttcagtaaaaggttcactgcagagatgttactcaaagtgttcccatcacagctataactttggttttattttaaactggctacatttaaaagtaaatttcttttcaaagaaggctattttctcatcaacttatggtaaatgaaacaacaattaaaatgaaaagtcagatatgtttctttgaaacaagtctccaatcgactgaatagaaaatggaagtatttttcaagacctgtgacatgcctttactggcaacagcagacagatgcttgttgcaagtcatggtgccagcctgggttgactcctcttggagttttcatggtttcctagaaatgtaacaagataatgtgttcctttaacaaatggctaccccatgccaaagagtagaaggttgctccatattactttttatctttgtaccttcttattctactttcattacccaaaacactgtcaagaggatgggcatagtggctcacacttgtaatcccagcaatttgggaagcagaagcaggtggattgcctgagctcaggagttcgagaccagcctcagcaacatggtgagaccctgtctctataaaaaatataaaaaatagctgggcatggtggcacatacctgtagtcccagctacttagggggatgtggtaggagaatcctggaacccaggaagttgaaactgcaatgagccatgtttgtgccactacactccagcctgggtgaaagagtgggactttgtctcaaaataacaaacaaacaaacaaaatattatcaacagctttctccttttgtgcaggtacttcaaattaaaggtggacttcaataaaacacttcccagtgggtacctccacttaaggtctgaacatttctccagatgatggcatctaattctataaaaatgtgtttaagccctactttttcaattcaatatatttagaattagacatactgttcctggaacaagagaaatctttactgataactactatctgggatactgtctagtgttctcataattgccctttattcacaatcaaaagcaccacactatgtctgtagttccttctcagagcagccacatccttcacactacctggaggtctccagaggtgccacctacagttagaagctcttgtgcctctgttcattgactgaactaccattatgtccatgatggctgctgggggaatttgagccctcttgctctccagagatacttcttagaaacctggatttttaacaattaccaacagcttttcacattaaaacgctctgatactttaaaagttcctaaatcagatagacaggcaccatccttagttgtgccatgacattttcatcgatcagattacttctcaatcttctctggacttaggttatttgagcaaaagctattaattacatacagtgaaatctgtttacttcaaaatcccaccaattaggaatccatggtttttaggaaataaagaaaataagtttaaaatttattgtctcattagtcaataaaatattgttgagccaattaatagcatagcaagatctgttaatcccataataatcaaccccatagcaatgaaaccacagcaacgggaaatgttacagacttttaaaaatgaaatttttcaggcactttaaagtacttcctatgctaacttcaatcctttttttaaaaaaaaattatttactaactaatttattaaccaacaaagtctatgaaatatgttagcaaaagttaggcctgcatgcatatttaaacaacacagatatatttctagataattatttatggagttttatttacatattcatactggtattacctttttatattaattaggttttgtgccattaacattatttttaggaaagtactcatcattcatattctcttaaaatattcattaacaaagtattttagagtaaattctataggtattatagctattttcttttattttttattatactttaagttataggttacacatgcacaatgtgcaggtttgttacatagctgtatatgtgccatgttggtttgctgcacccatcaactcgtcatttacattaggtatttctcctaatgctatccttcccccagccccccaccagccgacaggccctggtatgtgatgttcccctccctgtgtccatgtgttctcattgttcagctcccacctatgagtgagaacgtggtgtttggttttctgtccttgtgatagtttgctgagaatgatggtttctagcttcatccatgtccctgcaaaggacatgaactcatcctttttttggctgcatagtattccatggtatatatgtgccacattttctttatccagtctatcactgatgggcatttgcgttggttccaagtctttgctattgtgaatagtgccgcaataaacatacgtgtgcatgtgtctttatagcagcatgatttataatcctttgggtatttacccagtaatgggattgctgcgtcaaatggtatttgtagttctagatcctgatatggtaggttcacattacagttactggatctaaattgtagtatatacaggtctatgtgtgcaataaaatggataataacatgtaaaataaagaaaattttatacatgtagtttttctgaaatcttggttaaagaatataaaaatccttgattcatatgaaatttctaggtgtttgaagccaataagtgtttggggtattgaatgagcaagacaatcctcactctacttttttatttgcttattgtaatttcttttctaaaataacattagccacgaataattttcaaagtaattgaacttattttctgttattttagaaatttttaaaattttaattcacaaggtaatctaacatacactattttaaacaattataataatagtaaaaatcaccccattagaataagacgctcattatccaaatacaattattttccattttacaatttcttctgcttttctcattaccaaacgtataccttttctagttaaatcatggtgcacataatattttatgttcttttctctgaattctgtaataaatattttctacatttctatgtagtcttatttttaatattaaatgattagtcattatttaagtggcaagaaagaacacaaatttacaagaggtgtgtcttctgttttttagaaaatctcagattcaacttccattcagccaatatcttttgaacaccaattgtatgccttgccatgtaatgtgttaggcatagcaatagaaagatgaataagacaccatctcatccccaatgaaagcagagtctaataacgaaacagcaaaaccacacacaaaatatgttcaataattcctacaggtgctatagaatatgcatttcactccagcgggggaaggctagaaaaagtaaagaggagtgccccttgagctaaactttgaaaggcttctttttttttttttttttttttttttttttttgtgacggagtctcgctctgtcgcccaggctggagtgcagtggcgcgatctcggctcgctgcaagctccgcctcccgggttcacaccattcttctgcctcagcctcctgagtagctgggactacaggcgcccgccaccacgcccggctaattttttctattttttagtagagacggggtttcaccgtgttagccaggatggtcttgatctcctgacctcgtgatccacccgcctccgcctcccaaagtgctgggattacaggcgtgagccaccgtgcccagcctttttttttttttaatactttaagttctgggatacatgtgcagaacgtgcaggtttgttacatagttatacacttgccatggttgtttgctgcactcatcaacccatcatctacattaggtatttctcctaatggtctccctcccctagccccccaccctgcaacaggctcaggtgtgtgatgttcccctccctgtgtccatgtgttctcattgttcaactcccacttatgagtgagaacatgccatgtttggttttctgttcctgtgttactttgctgagaacgatggtttccaccttcattcatgtccctgcaaaggacatgaactcatccttttttgtggttgcatagtattccatggtgtatatgtgccacattttctttatccagtctatcattgataggtatttggattggttccaagtctttgctattgtgaatagtgctgcaataaacatacatgtgcatgtgtctttatagtagaatgatttataatccttcaggtatatacccagcaatgggattgctgggtcaaatggtatttctggttctagatccttgtggaagcacactgtcttccacaatggttgaacgaatttactctcccaccaacagtgtaaaagcgttcctatttctccacgtcctctccagtatctgttgtttcctgactttttaatgatcgccattctaactggtgtgagatggtatctcattgtggttttgatttgcatttctctaatgaccagtgatgatgagcttttttccatatgtttattggccacataaatgtcttcttttgagaagtgtctgttcatatcctttgcgcactttttgatggcatttttttttcttgtaaatttgtttaagttccttgtagattctggatatttgccctttgtcagatggatagattgcaaaaattttctcctattctgtaggttgcctgttcactctgatgatacattattttgctgtacggaagctctttagtttaattaggtcccatttgtcaattttggcttgtgttgccattgcttttggtgtgttagtcatgaaatctttgcccatgcctatgtcctgaatggtattgcctaggttttcttctagggtttttatggtttcaggtcttacatttaagtctttaatccatcttgagttaatttttgtataaggtgtaaggaaagggtctagcttctgttttctgcatatggctggccagttttcccaacaccatttattaaatggggaatcttttccccattgcttgtttttgtcaggtttgtcaaagatcagatggttgtagatgtgtggcattatttatgaggctctgttctgttccattggtctgtatatctgttttggtaccagtaccatgctcttttggttactatagccctgtagtatagtttgagtcaggtagcatgatacctccaactttgttttcttttcttttttttttcttttttttttttttttttgcttaggattgtcttggctatgcaggctctgttttggttccacatgaaatttaaagcagttttttccaattctctgaagaaggtcaatggtagcttgatggggatagcattgaatctataaattacttcaggcagtatggccattttcacgatattgattcttcctatccatgagcatggaatgtttttccatttgtttgtgtcctctcttatttccttgggcagtggtttgtagttctccttgaagaggtccttcacatccctcgtaagttgtattcctaggtattttattctctttgtagcaattgtgaatgggagttcactcatgatttggctgtctgtctattattgttgaataggaatgcttgtgatttttgcacattgattttgtatcctgagactttgctgaagttgcttatcagcttaaggagatttggggctgagacaatggggttttctcaatatacaatcatgtcatctgcaaacagagacaatatgacttcttctcttcctatttgaatacgctttatttctttcacttgcctgattgccctggccagaacttccaacactatgccgaatagaagtgagagagggcatccttgtcttcagccagttttcaaagggaacgcgcctagcttttgcccattcagtatgatattggctgtgggtttgtcacaaatagctcttattattttgatatatgtttcaccaatacctagtttattgagagttgagagtttttagcttgaaggggtgttgaattttgtcaaaggccttttctgcatctattgagataatcatgtggtttttatcattggttctgtttatgtgatggattacatttattgatttgtgtatgttgaatcaggcttgcatccctgggatgaagccatcttgaacatggtggataagctttttgatgtgctattggattcagtttgccaatattttattgaggattttctcatcaatgttcatcagggatattgccctgaaattttctttttttgttgtgtctctgccaggttttggtatcaggatgatgctggcctcataaaatgagttagggaggattccctctttttctattgtttggaatagtttcagaaggaatggtaccagctcctctttgtacctgtggtagaattcggctgtgaatcttcctggtcctggcctttgtttggttggtaggctattaattaatgcttcaatttcagagcatgttattggtctattcaaagatttgacttcttcctggcttggtcctgggagggtgtatctgtccaggaatttatccatttcttctagattttctagtttatttctgtagaggtgtttatagtattctctcatggtagtttgtacttctgtgggatcagtggtgatatccccctttatcattttttattgtgtctatttgattcttctctcttttcttctttattagtctggctagcagtccatctattttgttgatcttttcagaaaaacagctcctggatccgttgattttttgaagagttttttgtgtctctatctgcttcatttctgctctgatcttagttattatttgccttctcctagcctttgaatttatttgctcttgcttctctagttcttttaattgtgacattagggtgtcaattttagatctttccctctttctcctgtgggcatttagtgctgtaaatttccctctaaacactgctttagctgtgtcccagagattccagtacactttgtctttgttctcattggtttcaaataacttatttatttctgccttaatttcgttatttacccagtaatcatccaggagcaggttgttcagtttccatgtagctgtgagcttttgagtgagtttcataatcctgagttctaatttgattgtactgtggtctgagagactgtttgttatgatttccattcttctgcatttgctgaggcgtgttttacttccaactatgtggtcaatttttgaataagtgtgatgtggtgctgagaagaatgtatattctgttgatttggggtggagagttctgtagatgtctattaggtctgcttggtccagagctgagttcaagtcctgaatatccttgttaattttctgtctcattgatctgtctaatgttgacagtagggtgttaaagtctcccactcttattgtgtgcaagtctaagtctctttgtaggtctctaagaacttgctttatgaatctggttgctcctgtattgggcacatatatatttaggatagttggctcttcctgttgcattgatccctttaccattatataatgcccttctttgtctttcttgatctttgttggtttaatgtctgttttatcagagactgggattgcaacccctgcttttttttgctttccatttgcttggtaaatattcctccatccctttattttgagcctatgtatgtctttgaacgtgagatgggtctcctgaatacagcacaccaatgggtcttgactctttatccaatttgccagtctgtgtcttttaactggggcatttagcccatttatatttaaggttaatactgttatgtgtgaatttgatcttgtcattatgatgctagctagttattttgcccattagttgatgcggtttcttcatagtgttgatggtctttacaatttggtatgtttttgcagtggctggtactggtttttcctttccacgtttagtgcttccttcaggagctcttgttaaggcaggcctggtggtgacaaaatctctcagcatttgcttgtctgtaagggactttatttctccttcgcttatgaagcttagtttggctggatatgaaattctgggttgaaaattcttttctttaaggatgttgaatattggcccccactctcttctgacttgtagggtttctgctgagagatccgctgttagtctgatgggtttccctttgtgggtaacctgacctttctctctggctgcccttaacattttttccttcatttcaaccttggtgaatctgatgattatgtgtcttggggtttctcttctcgaggagtatctttgtagtgttctctatatttcctgaatttgaatgttgccctatcttgctaggttggggaagttctcctgaataatatcctgaagagtgttttccaacttggttccattctccttgtcactttcaggtataccaatcaaatgtaggtttggtcttttcacataatcccatatttcttggaggctttgttcattccttttcattctttttctctaatcttgtcttcatgctttatttcattaagttgatcttcaatgtctgatatcctttcttccgcttaatcaattcggctattgatgcttgtgtatgcttcatgaagttcttgtgctgtgtttttcagctccatcaggtcatttatgttcttctctaaactggttattctagttagcaatttctccaaccttttttaaggttcttagcatccttgcattgagttagaacatgctcctttagctcagaggagtttgttattacccaccttctgaagcctacatctgtcaactcgtcaaactcattctccatccagttttgttccgttgctggtgaggagttgtgatcttttgaaggaaaagaggtgttctgttttttgggattttcagcctttttgtgctggtttttcctcatcttcttggatttatctaccttaggtctttgatgccggtgacctttggatggggtttttgtgtggatgtcccttttgttgatgttgatgctattcctttctgttagttttccttctaaccatcatgcccctctgctgcaggtctgctgtagtttacaggaggtccactccagaccccatttgcctgggtatcaccagcggaggctgcagaacagcaaagattgctgcctgttccttcctccagaagcttcgtcccagaggggtacccgccagatgccagctggagctcttttgtatgagatgtctgtcaacccctgctgggaggtgtctctcagtcaggaggcatgagggtcagggacccatgtgaggagacagtctgacccttagcagagctcgagcactgtgctgggacatccactgctctctttagagctggcaggcaggaatatttaagtctgctgaagctgtgtccacagctgccccttcccccaggtgctctgtcccagggagatgggcattttatctataagtccccgactggggctgctgcctttctttcagagatgcctggcccagagaggaggaatctagagaggcagtctggctatagcagctttgccgagctgcagtgggcttcgcccggttcgaacttccaggcagctttgattacaccgtgaggggaaaatcacctactcaagcctcagtaatggcagatgcccctcccccccatcaaactccagcatcccaggtagacttcagactgctgtgctggcagcgacaatctcaagccagtggatcttagcttgctgggctctgtgggggtaggatccactgagctaaaccacttggttcgctggcttcagccacctttccagaggagtgaacagttctgtctttctggcattccaggcaccactggggtatgaaaaaaaaaaaaaactctggcagctagcttggtgtctgcacaatcagccgcccagttttgtgcttgaaacccaggaccttggtggtgtaggcacctgagggaatctcctggtctgcgggttgtgaagaccgtgggaaaagcgtagtatctggaccggaatgcactgttcctcacgtcacagtccctcacagcttcccttggctaggagaaggagttcctccaccccttgtgcttcccaggtaaggcgacaccccaccctgctttggctcaccctccatgggctgcacccactgtctaaccactcccaatgagatgaactgggtaagaacacctaggcaacaccacccaggacataggcatgggcaaggacttcatgactaaaataccgaaagcaatggtaacaaaagccaaaattgacaaatgggatctaattaaactaaagagcttctgcacagcaaaagaaactaccatcagagtgaacaggcaacctatagagtgggagaaattttttacaatctacccatctgacaaagggctaatatccagaatcaacaaataaacaaatttacaaaaaaaaagaaaaaaaaaaccatcaaaaagtgggcaaagaatatgaagacacacttctcaaaagaagacatttatgcagccaacagacacatgaaaaaatgcttatcatcactggccatcagagaaatgcaaatcaaaatgacaatgagataccatcccacaccaattagaatggtgatcattaaaaagtcaagaaacaacaggtgctggagaggatgtggagaaataggaatgcttttacactgttggtgggactgtaaactagttcaaccattgtggaagacagtgtggcaattcctcaaggatctagaactagaaataccatttgacccagccatcccattactaggtatatacccaaaggattataaatcatgctgctataaaacacatgcacatgtatgtttattgcagcactattcacaatagcaaagacttggaaccaacccaaatgtccatcaatgatagactggattaagaaaatgtggcacacatacaccatggaatactatgcactcagttggaaatgcagaaatcacccaccttctgcattgatctcactgggacctgcagaccggagctgttcctattcagccaccttgccagactgggggcaatggctcctttaaaatgtgaaatgatttcatgagttgggtcaggatttcactcaagaaacagaataaaaggacactttctcaggaagaggttggggtcagaagcaaacttcaatgttcccttaggaaaaccaagcacccaactggtgccctttacaacatcgcccccttgtggtcttcccatctccacttcaacatgggacctcccagaaggccaaccttgcaggcttttcaaatcttaattactaggattgcaaacagtgcttctacaaacaagtctctttacatcttccagcccttcattgctactttagctgtttggtttcccagatattcgttaactcatttataagttcaagtattcttatgtcaagactgtaatttgttttgcatctttaccaccaaccaaggatgggaaatcactttaaatgtgtaaaggattttaatttcatttgatggactcatctgttgctaccaacctaggaggccctggttttctgagacgtcattagaatttctctatgctcaaactgaagaaaatgcaaaaaataaaaaaaacagtgattgtccaaataaagtaaggcacaaaacaccaaatatattcaccataatatcccagatattccaggcaaatggttgagagactcactagatgaatgttttctacatgtaacccagatagtcatctcagttccccaactcattataaatagcccctcccagagcaatatttgctacagtaggaaagctagggtagaacagaaatctctgtgggaagtattttaaattctctccccctaaacactcattctcctcacagtagatcacaagccaggcctgccctattgcataaagctttcactttctgttatttcatgtgtgtttcttcctgcattgcattgtttctggcatgaatcctaaatattaatgctgctaggaggctgttatttacaccagtgaggcccaatttgcatttggaatatagaaaaacaactgctttctattttcactctatcaatcataataggtcataaagtttagcccttaactacaagatttatctgttttccagatatgaaagggcttggagctttggctccaaccaccccagcctttagtagctacttgaattgttggctttggtttccaaagtggggattttaggacatactttacagcagtgtttttaaaactctctggtgaaggaacagtttctacttttttctttgttttgttttgtttcaatttattatttgtaaagaataataataaatttattatttgtaaagaataataataaataaatcgagataaacatagtcatgttcttgactatttgggcaatgtcacaattgctgtaaaggaaactctaaatgcttactctcaattctgttacttttcttgtcttgtattaatgacagtttgcagatgggtccagtccatggaccacattttgagtaacattgccttagaggactgatctgtgacttcctgtgtaaaacaaggcaaggcataacatataataggtctaaataatgctagtttcatttcctttctcctaaaattcaatattaaattcattgattaattcattcatccatctatttattcaacaaatatttatagataacttattaagattcaggcactgttaaatgctaggtatacagtaatgaaaagaactcaccttctaccgtcaaggagcttacaagctattggaaatgttttcactagaatatctcaaaaaaatgaaattaaaaatttaacataaagttattacactttttaaacttttatatctaatattctttttatttttaagtattttcatcatctttaacattatataatgtatatatgctatattaatatagtattaatgtattatataagtatatagtatttcttctaaggcccagctaagtatttatgactcattttcttagccacaaaaagaggtttttccatcatcagccttgtaattttttttattttacaatatctaaatcataattccctttggtttcatgttctttttaaatttttttaaattaacaataattgtacatatagggtacatggtgctgtttcaatagataaaatatgtgatgatcagatcaacataattatcatatccatcatctcaaacattatcatttatttgtgttgggaatattcaaggtcctccttctagctatttgaaactatacatgataactatagtcaccctatagtgtaaagaacactagaacttattcctcctgtctagcagttttcatcttctctcactgttcctgagacattggaatgagttctaccaatctttctaatgctaagcacacatattgtatgaatataaaactcatttttcctaaatataaactcttttaatctgccaatcatcacttaaaaaagagaatataaaccagcattcttgcttacttttaaaaaaatcttccctcctttgaaaatttatagacttttaaagtgagaaagttaagtgtctttattgctttggagaagagctagccaaagatatgctttaaaagcaggagctctcctggtatccacttttcttttcagtcattcttcaacagtgcaaggtatctgtgtcatcctattatcattgctctgaaacataaggcttgggaggcagtctggaatccttctaagactttgactccaaaacctaacatctaacaattatgtgcatccaggtaatcaaagtcttgccatcaaggtacatcgagggtcagttatctacaacacccaccatttgtcaaacagaatcatgtgcattgtgagggctgggaccatatctagtctgtctttgtatcccaaacctagcactgttttgacatctagtagtggacacccaacaaatgtttgttgagtgaatattaaacacaataacaggaaattttcagggatgtttgtatatagatctaattttgcataattaaaggtatttaggattgctcttgccatttagatatttgggtgtgtgagtgtatgtaagtgtgtgtgtgtgtgtgtgtgtgtgtgtgtatgtgtgtgtgtgtgtgtaaatagagtctcactctgtcacccaggctggaatgctggggtacgatcttggctcactgcaacctccacctcccaggttcaagccatcttcccatatcagcatcccgagtaactggaaccacaggtgcctgacacaatgcctagctaagtttttgtattttttgtagagatggggtttcaccatgttgcccaggctggccctgaactcctgggcttaagtgatcctcctgccttggccttctaaagaattgaaattacaggtgtgagccactgcacccagccaccatttacgtttaataaattgcaaaaagcctctttacccatgatagccaaatgagtaattatggtgaacaactcagattctgttttacagaaagaaattatttgatggagacttttatggggtgtggtactctccacacattcctataaattccataatccagctagtgtgtagaataccagaaaagaaaatttaatggaatagttttataaccctggctgaatgagatgcagaaagttaagacatggcataaattggataggctaattattctaacctcttgccatttatatgtgtgcatgtatgtgattgtcaaataagacagacttctgtatgagtatcaatcttaaaaatttcttcttttatagtcaatttgattgggaatccaaatttgtggctgtgtctaattcggtattccatagagctcctcttatcatcctctaatatatgtctacaatgaataactctccactgtgattggcatggcataaaccaaggcatccagacacaggcactaaagcatatcccataaaaagagttgatgatcaccaaacttcattatcttcctagaagctaaagctaatgcagcaaagtctataaagattatgatcaaactggctctttctatggaatgaactagaatctctccaaaggtgaactgcagaaaactccacctctccttatttctgcttccacgtcactgccttaaatctcaagtacgtgtgaaacttctgtgtgctgagcctgaggcctgggaacaactgggtgacaataaagtctagttaggagagacgagttgtagcatctgagacaatcggtgacagaacaatacatgataaagtgactgcactgtactatttagcactgtattacattttcacattcattttgcattattctataatttgaggttcaaaatgaattttgatgtggagaatttgaaatgaccttaagtctttctaaagaattggacatgggtaccagagccagagctctcctccaaaaactaaatgcagtgtacctctcaactgaacttccatcactttctcatagtagcacgaacccttcgagaacaggcaagttgacttccaccccggacctctcactgagcatttagtcaggttccactgctctaaactgtccgatggctccatgtaaaggaagggaagattccagtactaccattggcatgatttgtttaagcaaggatgctgccactcctttggaggggagagctgatgtttacctgaattgagcaaagcgttctttcttcttcctttttttttttaatgtagaagctgtaggaaaaaaaaaaaaaaaaaaaaaacacgtactgctgagttccaggattttccctactgtcattacaggttcctgattagatataagaaaatctggtgtgttatgtgtaaaagataaaagggcacatagaggctgggcgtggtgccccgtgcctgtaattccagcattttgggagagcaagggaggtgatcacttgagcccaggaattcaggaccagcctggccagcagagggagaccctgtttctaaaaaaatttaaaaaataaaaaataaaaaattcagaaacaattagccaggcttggtggcgcacatctgtagtcccagctactcagaaggctgaggcaggagaatcacttgagcctgggaggtcaaggctgcagtgagctgtgattgcattactgcactttagcctgggtgacagagagagaccctgcctggaaaaagaaaagaccattttgaatgtatttctaaggttcttcttcccagatataacttttagaaacaatattatcctcttttcactattgtaccatgtttttcattaccatttctactacttttccactaatcaaaagagagatttatattactcatcagcagtatttcatattttatttacttttttgtgtatgcttataccactatgatacaaaccacagttgaaatattgcagggcccgtagttctattacattaatcttggttttatagcagaatatattattaaatatttatgtgagatgcaaaagccatcaatagctgtattcgacagtggataatctacaactgaatacgttcaaatgtaatcattttttgcacaggatggcagggatactccaatagaatctgatggttaatttctcagtcttatttctctatgtaaaggtattttataaatgaatgtgtaacagtgagcaagtactgaaaagttttaattgtccatcattttagaagtttataaagttgatcaggtaactttttcgtaatgtggatttttcacttctggatttctcatacatagaattcagaaaataaatctgtgatcataacactttctcattaatacaatgtaatcagtagcatcaaaatagtgactatttggagagtgtttgcactagcatatgggtaataaattctaccccttcatgtggcaatagcctctttttctggaggggagagggagtgaaatcattggtttctattcaattgtgttgaaaagagcactagatttgcaatcagtaggtttgactccaaagcatagttgatacttatttgtgttatcttggacagccacttatagtaaatattgttagctcctcctcccaatcccctttaccaggttagtgtcccactccctcaactgctcagagtgttggctccaacagaacagagctctttgcttctccaggcatggaagctcatggaaggccaaagaggagctgcccaggaaattcaggagcctgtggctgagctgacatggcacacaaaggctagttcccttgcctccaggtgggaccagctatgtggttcagcatgctccaaagctccaggagggatcaagctcaatctgacctccagctgagaccatattccttcatcgctttttccccttgcaccatcctactttcctcactccccttctgctgaaagcactcatccaatatatcattgaacaagaatccctgtctcaggctctggctctagggaacctgacccaagatactttaacctaatgtctaggcctcaatttctttatctgtaaaataagagtaatcactgatccatgatattattgtgagaattaagcaatgcatcattaggtgaaagtgcttttgtaacctgaaaagaattaaacaaatgttagccatcttcaatgttattactaaaaccaatgctaataaagtgactcttgtaattctctgagagttgatgtttccactccctcaaagtgtgctataaatgccctttttggatgcatctaaagtgacaacccttttctctgcaccgtcacgtgacttgaatgaagattttcccagtttcttccaaattctgcttatgttaaaattttaagtagtgtttttccatacaagtagatagatatttccgcaatattcagctttcttatctaccctcctcactatccatgagatgttgtcttaaaataatttttaaaaagtgacagaaactcatctgtaaatctgaaacatttccctcaattaaattagaaccatttagggctattttgcttcaaatcctatgaggtatttatttacttatttatgggatattatttactttttatttagagcatctaattgcttcctggactagtcaaacctagtcaagaaagctattatggcattccctaaactggatcttgctaccttttaaatattatgcattttttctaagcaggcaaaataaattggaatgagtaaaacctcacgttcttacatacacactgggcatatacatctgagataatacacaggtatcagttatatattttttaagtgttaggaaaagactatttaaaatttagcttttgatgttcgtttttatcctagggactgtcatgtttcataatgctaacactgggccatactttttcagatttttcaaaatgcctagaagaataaaaactcattcattcacttaacaaatgtttaccaagtatctgctaagtgcagaacactgtgccaagaatctgtgggtacaatggtgaggagaaacatatacgacacctgccctcttcaggtgcagtgtagataatgagactgactttaatcaaagaatgagcaaatgtagctaacttgtgctaggtgctataaaaatagtgaaagttgagcaactccaagttgtcagaggaagcttcccaaaaaagtaatcgttaagctgacattggagaaaaagtgggaggaagtagagggggaaagagcattccaagcagaaatagtagcatgtgcaaaggcaccgtggcaggaggggacatggtcaaatgttacaggtcaggttagaaggcttaagataataagacaagcatttaaactaagagcaataatccagacaagctatgagcagaattgaaaagggaaggtccctagctaagatccatctcagtccagtgaaaatgtattttgtgtcttccacatcaagcgactgtgcccacgttagttctaggaggccttcccagtggggaccccaccaacacctttcagcactattgcactctgtcctccacacacctgcctctgaaaaatcatccttccttagccctgaatggctggctctcacacaaaggctactaaaagcagtgagatccttatcatacagttatatttattaagtctgaatccatcgtccacagtagcttcctgggttatatgcccaacatggatgtgctttaaaccctccagaagtttatccttgcttgtagaataaaattggttttgcatagagagatcttcaagactgcactctcttcacccccatctcacattttttcctgtatcattaaatctgagaaattccagacagcttttgatatcaagttttcagcaaagttggtgcataccataatgtttcagtcttctggcctttcttctgtttcagtgctcagctcaaacaacccctcctcaaggaagctttttctcacttcccattgccccctcccaaacaagttatctgtcctctgctgtgacccagtatcatctctccatattctttgttatattttccatattattaagcttattcaattatgtgtcgatcaatagcccccactaaactatgagttccacaaaggcaaatacatgattttttttctatatctccaaggactagtatagcttctggtaaacaaaaaagattattagactaactgagctggtggcaggtcagtttgccttccagaccctttaagtcaactgtccaggaatctagaccagcactgtaaaatggaaatacagttgcccctcagtatctttggggaatggttccaggacctcccacggataccacaattggtggatgttcaagtcctttatataacgtggtatagtatttgcatataacctatgcacaccctcccatatactttaaatcatctctagatttcttataatacctaatacaatgtaaatgctctgaagatagttgttacagtgaatcgtttagagaataacaagaaaacaagtctgtgcatattcagtacaaatgcaatttttttgaacagttttaatctgcaggtggttgaatgaacagatacagaactcatgaatagagagtgctgactatataatataatgcaagtcacattttaaatttactagtagccatatttaaaaagtaaaaataaataggtgaaattaacattaataatatattttatataatgccatatagccaacatatcatttcaacatataatcaatatgaaaattaatatatacatttttatactacatatcataaatctagtgcatattttacacttacagcagatgtccatttggactgatcacctctaaaattctcaagagtcacatgttgctagtggctgccatattggacagtgcaaatctaagatagttggcatccaggtaaggtcagcaaccacaaaaaaagaaaaaacctgaaactaaattgaacagaatcaataggggcctcatcgaaaagaccttgaagaagtcaaatgataatttagacgcttatgtaatctgatttggttttctatgttgatgggatgaaatatctctacttgtttctacataatatctgtagatagtttaagtattgtatcattattacctgaaaaaataagtcaaatcagcgtttcctctgttttttatgaatccctgttcttggttctaaaacctcagattcatttgaggtagttggatgcagtgggttaaagaacattgtgagatgatattttaaattctggaaaatactgtattacggaagaaaaaagccaacaactggaatactgttgcctaggaacatttctcctcttgccccagaatcagtattttagcttttctcgattggtcaatttgttaatatcacagagtgagtgagaatcaacaaagtatcctgccccccttcccccaccacagaaacatatggaaatgcagaagtaaagtatatgggcggaaagaccataatcctccttagtatgactattcagcctttgcatctagttcaaggactagcagttatttcttgagaaatataatcttacttcattcattcttttagtcacttgttcaatgaatatttattgagcatttattatatgccagaccttgtgctaggccccacagccatacaatcactgtctttcaggtacatgagcctcttgagggagtcagacttgaacaatatgcacagtgaaaggtatgagagcttttagaagcaggatggagcctggaccagaggttcattaaggaagagtcattgaggtgagaactgaaggggaagcaagagttgactagttgaatggaaaggggcagagcattccaggtagaggaatgagcatatggaagacacagatttaagattgcatatagttatcttggcttccagaagctagcccttctaggagtgagaagaagctcatgaagagtgcagggtagaacttaaggactaaaatggcagttagtgaggctggagaagtaggttggaggtcaagttcacaaagagctgaaaatgataaaaccccaggtgcctacgagatgttgtttgcaatgggttaaaaagagtggcagagtgcctgcctggagatggaggttggtagatgaagtggaagcaatggggcaaggtggcagacaagagtggagaagaagaatgaagagtcagaaaaaaaattagaggacttcattaaacacaatagatcaaaactgcatttgaaccaatgatcatgatgcaataaccttggaaaggcgatccactcatcaaaaacctattattttcaggctctgtgcatatattgtcttatttcattctcccgacaatgtattttgcaatagagaaactgaagctctgagcagttttgtaactttcccacgattatttcttaacaagtgggtgcacaggaatataaaatatgatctgtcaagctgcaatgtctacactctttccactaggccaagaaaaaagggaattttacttagctgatgtttaagagtaactttagagttaaaatagagttagtctctgacattaaaagttatattggaaaagttgttaaaccttatctgcttggccttaaatgttaaaactgagcattttctagtttcattacctttctacatgcataggtagtcataagatgatatatttcagtactttgaactagcagacagaatggtaacacataaaaatccacatttattacattctagttcagatagataacattttttaaagtataatattttaaaatcattaaaaagtttaactaaattaaattgctttggtccaataatattttatgagatttacataatttcaagatatgtctttagaggaaaccataatcaagtccattaacagcactattgtaactttttttaaaaaaaagatgtgtggttttacaagaaaaaaagatatatgtatgcttagatcaaggagtaactttgactctctgctataatgtacaacttagccattttctactgaagtttgttaaataattttttcatacctgctttgttttgtattaaggcactaagcagttttcctgctttgcagagctaaactggcagcacaaacttgcttttctctacagcttgacgctgtagtcatgaccctctcatacaatgaagaatatcaagaaaagatctggaaatgaggagggcaatacatgaagtttcaagatagttgtcgctataaatctgtaatagaacctgccatcattgccagtggccttgcaattgactatggaatgggaccatctgaaagtacagcttttattgttgccttctctcttcctcaatacatgttgtcttatacaataagggttgctcctcttcctggtaactttctctgaataagtgtaattctccaagggtaataatgttctctgtttgctgtgccatttatgtcatgtaaattagtcttggcttcaagaatggagcttctaattttgtttgcccccatcacaaatataggattacacaaattctaagatgattgctcctgcaaaatgtcctcataggttgaccctacgaaccttcagttttcacaattaatgcctccaatttttaaagcatcagtctcagagagagtagtacctctcagtgtgaatctgggacacaaatgtttggtctctctgggcccctatgaggaagaaaaaggatgaagtggtctgctgtggttattggcatctcacagatggggaaacataagaaggagttgacttgagattcctcacgtatagcaaacaaagtggggaagtgtagtatggaatattaccaagcagcagtgtcctataagttatcaatacattgatgcctatttcaaataacatcattattgaaatataattcacatcccatacaatccacccatttaaaagtacaagtcaatggttttcaatgtatacagaggcctgcattcatcaccacaatccattttagcacattttctttaccccgagaaaggaactctgtatcccttagccatcaccttgtcatcccacctctacactttcccaaccctaagcaagccactaatctactttttgtctctctagatttgcctattctcggcatttcatatatattcacagtacagtatatggtcctcttggattggcttctttcatgtagcataatgatttcaagattcatccacattgtagcatggatcagtacttcatttcgtttttttttttttttttttttttttttttgagatggagtttcgctcttgttgcccaggctggagtacaatggcatgatctcagctcaccgcaacctccgccccctgggttcaagcgattctcctgcctcatcctccagagtagctgggattacaggcatgtgccactatgcctggctaattttgtatttttagtagagtcagggtttctccatgttcgtcagcctggtctcaaactcccgacctcaggtgatccacccgccttggcctcccaaagtgctaggattacaggtgtgagccactgtgcccggccttcatttctttttattgcaagcaatatgccattgcatagatataggatattttatttatttattcattagctgatgggcatttatgttgattccatcttttggctattaaggatactgaggtcaacatttacgtacaagtttttgtctggacatatgttttcattttccttcagtatacgaggtagaattgttaggtcatatggcaccttctgtttcaccttttgaggaaccatcagacttttttccaatgaggctccatcattttacattcctaccagtaagtagtatatgaagagtctcaatttctccacattcccatcaacacttgttatctttttgtttcttgtcatcctagtagatgtgaaatggtatcttattgtggttttgatttgcatttctctaatggctaacaatgttgggcatcttttaatgtgcttactagtcatttgtattaaagcctgtttaaaagaaagtttctctgctgacttttaaaagtaacaccagttgaataccaggtaatgggcagagtccttcaaataaaccattggctttttggcctttcctgtttctgctcacatctataaagctgcagctccatttgaatggagaaggagcatctcatagcaagcaggccctttactactatctgaggaaatgcacttaaaagaagtcatttctacccctagcataaggaaatcaagaggcaaaatgcattccactgtccttttttcaaactatatttaaatggtcacaagaacagatgagtatcccttcagatatttctcaaatgcatgatgcatcttcttgaaggatgaaccaaaaagacttttgaaggaaaagtttccaatttacacagaaaatatttacaagttgtttttaatgtgtgtgtatactgtattataaaccacttcatatcaagagctgtgtcatctctttaataccactaaagttctttacaaaatataaagcatactgtagcttctcacaaattagtacattactaactgaattatctggcttagaagaatccacaccttaagcctcagtaagctaggaggacaccggaagtttcttttctgtgtacattcatttatatgttctcaagatagtaagatccataatgagagtgatttttcttgcttttcagcttaagtgtctgaacaaagtccatttataaatgttgagctcctacacatttgctaatgtccccaatggaaagaaatcaaaatgatcaaatttgcaaattgtgatttttctgtgtatttccaacctcaaaaccattatgtcatttgttataatgcaattttggcaaaaataagaatttgatcatatccacacaatttaaaagccaaggaatgctgtctagttcctcttacctgacagtctttcagaggtaattacagcaccatttcccgaggctggtcttgagagataaaagctcacgaaagaagcctgatggttcaagggtgggcagcagcacctgctgtaaagtacaggcagaagcaaactcctgagactcagctgttgagtaccaaggcttcctttgtgcagcagaatgtaggaggaggcccgagctggttttggcattgacccttcctggtgggccgctcacccagcctgcctgcagcaggactggaataaacgttccctgccaaaaggaaattctcaatcggcctgcctgaccagaaaaacaaagcaaatgaaagactaattcaaaaaagttcattgatcttgttaaaattaatgatgggcttaaagtttacttactgttaattatggtggcctcctaatgtcccatgaatcctctgtaaaatagggatagtttacgtctcctgtggccaaagactttctttatcagagttgttaccaaggccaggtgcagtggcgcacacctgtaatctcaacactcttggaggccaaggcaggcagattacttgaggtcaggagttcaggagcagcctggccaacatggtgaaactccatctgtactaaaaatgtaaaaattagctaggcatagtggtgcacaactgtagtcccagctactctggagggtgagacatgagaattgcgccactgcactccaggctgatggacagagcaagactgtctcaaaaaatcaaacaaaaagagttgttaccaacttaagaaatatttggttgcatcttcatttcattgagaaacactagcaatttgaaactcaaagaaacttgtaaaaaaaatggccaccatttttaatttttgcaagtctagagacaaggcaaatttaatctttttaattagttaaacaaataattagttttcagatataaatacagatgtaaagagaagtaaaagtcatgaacgcactagtatttttgccagctgtggctattagttaaaagtggccactaactgtatagtccattcctttctacaatttttttttacacaaaacctaagaattacaaaatttttagtagttactaaacatgaagtttttcaagatatttatattaaagagattttatggtttctaagatcacttttattgagaatcttttccttttgtaaatctaggtcattggatttaacactaaaattataaaggacaggagtttccagtttcctcacctatgaaaagggggattcaataatagctggcactcagtaaatgaagctgttatttttactgttactatcattactcaggtctccactcttgttcatgttccagtttgtgggcccatattgtatttctgtgggactttcatttttacttctcaatccgaaggctgtctaggtagaaacactaatgagcccttattatgtgctaggagtggttctggcagctttacaggtaactgtggtatcttcatagagactcacaaaggtcagcatacactcttcactttatctatgagaaaactaaagttcggagacattaagccacccaaccaaagttacaaagatggttaaattaaaaacctgtgatacaaattcagacttttctgatttcaaagcccatgttttttgccctattccaagtattctttttaattacaatataatgttaagaagtacagtttcattctctcaaaaaaccatacaataactcaaaataatccaattcagttctgcctagtagggaagatctgatttaattaataaattctaatggtttagaagcagcatgtcatttgtttctatgtaaacagcactcctacagggcttgtcagagctgaaaacaatttgtcctgtaagtattttaaacattccctctgcaatctggtttgcactattaattttacactattaagaaagcatttaccaagcaaaaataagccaacacagcttgagcctatcaaaatgataataaattttgaattcgtggaatttttattaggtttttgtatattttagtggatttcagaattcacaccagattattatgcaaaaacccaggtcaactaaaaaatcctttaaaggaaaagaaaaaaacaggtatatatttgtatcagcatccctatcagcagtgctgtttgagctgtcttcccacctgggccttcaccattgtgtcatcattagtggtcagtgatctaagagttggtgtctgtacatacacaggacattcctttacaggcctccagcctctgagacagtaacagagcccccatggcagcccgccaacttgtgaaaatgtgacaaggtatgtaaaaaggccatagccactgctggacatggtggcttatgcctataattccagcaacttaggaggccaaggcaggcagatggcttgagccatggagttcaggaccagcctgggcaacatggcgaaacctcgtctctacaaaaaaaaatagccaggtgtggtggcatgtgcctatggtcccagctacttgagaggctgaggtgggaggatcacttgagcccaggaggcagaggttgcagtaaaccaagatggcatcactgcacttcagcctgagtgacagagaaactgtctccaaagaaaaagaggggaggtgggggaatagtcgctttttgcacacttacccacgtgacagaggagggaaaaaccactgatttctcaaaccaaactccagactgcctcacaattgcctcagttgtctcaactgattccctaatcctgattcaaaccaattgtacttcctggatagaatgactgtgtggtggccaaggcaaaggatcagagcttaaaggacacaaaagtcattaaatgagtaataaacatcaggttgaagagtccagtgcccccagtgtccacccagaagacaatggtggccctttcatgctccctatcaaggaaaatatccactaaatagatctatgaaaatgcaaaattgtttcattctaaagtctatcttttatgtctttaaggtgggtcatttattctaaagctattctcttttatcctggttctttgaaacaaaaaccaaagcaaaaaacctgtgagttcccttagtagacacacttctgcctgtggtagaggaggtataaataatttattgcatttccattaaggtcaacctacagtgtacatgtgtcagaggagtatgagctctgagctaatgattaaggatcaagataggtgaggtttctgatgcattctgtgaataccgatgtgtgctgacatgtaatttgccaatagagatatggaaagtagcagaaagacgaaggtgactgtaataggattctacagacagcatgttatatagagtgcattccagcactttctcctctttccttgcacggcttgattagccatctgatgtttcttcaagagcatttgtgaaggaataggaattgctgccggccaggctctattagagccctggttaattaaatctctcagaagggattctgtttggtttaatgaagtgggtgcgagaaggaatcagaaccagcattagatacttatatgtttgtcctgctgacacctaacaggtttcatcttctcccccaacctcctgctgggcctcattcacctcccacctgtctcacctgtgtctctctcatctgcctgtggccactctcctgggagaggcctttggtctcttcccagaattattgcaacaggctcctggctgacctctgaggattattctgggcctttccctttacttcatcctgctgttggctgagttgtagccataaattaagcatgcctggcctctgctcagaaacgcctgagggtcccttgccactcctgttttcattccccatcgcttactattgtcctttgcttggcccccaaaggcttgggattctattccctccaccaggaccagatacccctctgctaactatagaaatactctgccccaaagcatctagtgcccaggcctatgcctcagtttcctgtctgccccatcttattgttcttttccgttctttctctctctgaaaaaagtcccctggaactccaaggacatattttgtttggccgatttcatgagaaaatgtattttgaatacatatagcacagtacttgacactcactaaataattaacaatggtgatgataatcattataaaatcacttagaatagtcccataacaattgcttaatattagtcttcacccctccttcgttgcttacataagagccattcgcagaactccgaaattataaaagctttacttcttaaaagcttttgactttcagagttgccaacacactaaactctttcatgccttctgtattcttgtcttcctgctcttcaactcactgcctcttacttatccttctggtctcttctgaatgtcacctcctcagcaaaacatcccctgaccatcctaaggaaacaccctgacccccatccactctaacttcactttgtccctttccttttggtgttcagtgctacttgtaatcatctatgtgtttgcagtaatctgtttgtgtgataccatctgtctctcaccctatactatgaggtccacaaaggcagaggccgtgatgtatcccagctcctggcacaagacctgccccattgtggtcactccataaatatttgttgaattaatgacccatttcaactctttgcacattgtcattcagatgttggaaatgaggaccacaaagagctatcagtaatggaaaaggccaacaaaaacatctgagtatgctgagcattctgactttggagaaaaactgttctcattgtgaaacttctgctgtgttactcctggaacacactcgcattgctcttcccaatgtgtgtgtgacttgacaagccatccttcccagttccactcaatactgagagcattctactggaaaacagaaacattatctgcttcaaacattggtgatatctgaattcagtaaagtgcccatagggacagtcaatggagcaagctgagaaaataggaaactgtcctttaagtgtgtttgcacagatttatttcgacctcagcttcaattacccaacttaagtttctactgaacacctttgcctaacaggtacaagataggcacacacaggatcccaaaattatcaagttttccactccaaaagtacttgattttgagagttaagcttaaaattcttgttattgcagttgctctgtttgaacacatttcagaacaatccttttgggaatacacgtttgtcaaggtaacattcttgaacctctcaggacccacttgcaggagcattcagagaagtgggtgtgcttcctacaagcaacccaacaactgctatgggcacctctcattttactattttttaaaagaaaatcaaaattctcatctcatttattttaatgctttagcacaggaaggtaggtattttttttaagttagggactcccaattaaattaatcacaggctttgaaattaattcaggtggaagtgtcagcctctccagggaggtatcccagaacccccagtgtgtgcctgtggcccttttctgtgctctcacagcatcctacacatctcagtattgcacactgtcccaaaggacttgcccccttgaggacagggactatgtctttcagctctgagtcccaaggaatttctaaatcccaaactatatcttgcactttgcctggcatatagtaggagtttaataaataatgataaatgaataattagccaatgacttggagatatgggtcaactgtccatccctttataaccttcttaattttcctgtattttagacagtatctacacaagtaacacctaattaatatgtcaccaaataccatattgtgaagcatatggcttgatatgagaaatcaggtagctccagatgtgaatatttactcatttataaaaaaagttgttacctatattgtacaataagtaccgtgttgagcatgtcttaaaacagtgggccagaggccgggagtggtggctcacgcctataagccctgcactttgggagcagaggcgggtggattgcttaagcccaggagttcaaagccagcctggacaacaaagggagaccctttctccaccaaaaacaaaacaaaacaaagcagtgggccagagattaccttgttgataataaacaatggctcttgtttaaatttagtcaaatgagtgtgtgatctatagacctatgtaaaaagtagtccacaatgacacaagctacatttgtcatgaatataactagtgagttgagacattttttgctcctgcttgttgaggtttcgagaaggcatgcccaacaaatccactcacacttcaggttagttattagcacatactagacatggtatgacctgaaccattcatccagtgacagcagccctatttcaaaatctttttttcttttatgtcagatgaagatgacatcactactatcactttctagactagggcggtggagcaatggccactcgctgtagatagattccaacattatttggctgttatcttctttctgcgttttacctcataaggatgacatgaggattcacaggaaaaattgtatccagttctttgaaatgattggtaaacatggcagatactcatttcattggccaatgaaataatagtctacaagccagtggaggttgattttgggtttttttttttattatttatttttttttttttagagacagggtctcactccattgcgcaggctagagttcaatggtgcaatcatagctcactgtagcctcagactcctgggctcaaggaatccgcctgcctcagcctcccaaagtgcttgattacagacataagccactgcacccagcctattcttgctctttaatcatcacacattcatgctttccaattctaataaggaccccgttactggccgggcgcagtggctcacacctgtaatcccagcactttgggaggctgaggcaggcggatcacgaggtcaagagatcaagaccatcctgaccaacatggtgaaaccccgtctctactaaaaatacaaaaattagccaggcgtggtggcacacacctgtagtcccagctactcgggaggctgagacaggagaatcgcttgaaccagggaagtagaggttgcagtgagccgagataatgccactgcactccagcctggcaacaaagcaagacactgtctcaaaaacaaaacaaacaaaaaaaaccccaaaacaaaccaaaaaaaacccaaaaaaggaccccattattaaaagcaactccaaagtttaattgtctactttaagtgaacatttttataatgctaccttagttgcctgagttatagcttaggcagcaagacataaaatgtgttgttctaaattgatttgttcataaaagtagaaatactcaaaatagagaaaaatggctgagtatcagaagggcacgtgtgggccataggtgcacatctttgtccatgaaaggctctaaccaggacctctccatatcccaatatcaccaccacccatcacaaagcaaatgacccttcaacaggaaagtctcttccttttttccaccaaagtcctcatttatcaaaatcagaactaggcagatgactataaattgggggcaaggtaggggatagttgttggtaagagaaattggtgccagaccccaagaagatgaccactccatacaaagccagcaccagttctttcactaacataaagaggaaacgcatctagctcaggaagctgcacagagataagaactggggtatggttgagttacctgccttgagcttgatgacagcaacaggtttaagtggccttgagaggcagagaaaagtagatgagtgcatccagaccagatagaggggtttgaagggagaagcaaacacaaggaaaactaaactcacagaccctcctcaagggtttagatacattaggaaggggacaagggaataaagctgcatatttactttcatgggcctcaggcacttttgcttttgtgggatccttcctttattaaaaccatattaaaagaataggagaaaatatttgcaaggcatatacctgataaaggattaatatccaaaatatgtaaggaactcctacaactcaatagcaaaaaataaaataaaataacccaatttaaaaacggacaaaagaattaaacagacagttctccaaagaagacacacaaatggccaacaggtatattaaagatgctcaacatcactaatcatcagggaaatgcaaatcaaaaccacaatgaaatatcgcttcacacctaacagattggctgttatcaaaaagacaagtgttggcaaggatgtggaggaattgtaatccttgtacactattggttgaaatgtaaatgagtatagccactatagaaaatagtgtggaagttcctcaaaaaactgaaagtagaactaccatctgatcaggcaaccccacttctgagttgatatccaaaagaattaaaatcaggatttcaaggtggtatctgcacccccctattcactgcggtattattcacaatagccaaggcatggaaaccacctaaatgtccagcagcagatgaatgtataaagaaaacatgctatatacatacaatggaatattaccagccttaaaaaaggaaatcttaccatatgcaacaaccatatggatgaacccggagagcattatgctaactgagataagccagtcacagaaggacaaatactgaatgattccatttatatgaagttcctagagtagtcacattcatagagccagaaagtagaatgctggttgccaggggctagaggggagagaaatggggggttgctgttcaatgagcataaagtttcagttacataagatgaataagttctagagatctgtgtacaacgtggtgcctatacttaacaatactgtattgtgcacttattttgttaagagggtagatctcaagtgttcttactgcagtaaaaatacattttaaaaaaacatattaaaattgtataattgcattgagaaaaatatgaatataattcaggctggattcattactgtatattacttgtatcatagtcatttttcttctaattctaactgaacttgagttcaataatgcagaactggaacattcctcatgttatgttctcatctgaaaggaaacagtgtgtcccataatgggaaacagtatagggtaagggttcaaatgtcacttttttccacctatgtatgagcttaagcaaattaatatatgtgagttttggcttccccataagttgtaattttgaggatttaagtgaggtaatgtatacaaaatactttgcctactgcctgtgacaaagcactacaaaaatggtggctcttaataaggatagcaattttgtgacatatagaaaaactaccagcctggacaacatagcaaaactccatctctataaaaatacaaaaatttgccaggtgtggtgccatgcacctgtggtcccagctactcaggaggctgaggtgagaggatcacttgagcctggaaggcagaggttgcagtgagccaagatcacgccactgcactccagcctgagtgacagagtaagaccttttctcaagggggaaaatagagaaaagaaaagaaagaaaaattattgaagtggagtcaaaatagatggcttctagttctgttccccccaccaacgtactagctatgtgaccttgagccagacaattaaattttctgaatcttagtttcatcatctgtaataatatccacctgccaacctcacaggattgctgaaaggaatgaaataacagatgtagaaacacatgtattataactgaaagtatcatacaacaggaattattaccaaagaaattgaaaaattttgtagagaagggaagtatatagtgtctggcacacaaaagctattcagtagatgtttattgaatgaattaacaaatgaatgcatacctcacaaagttcccaacactcaaaataccaaaatcttgattggtatacttcattgtgaaaagcattataaagacatccctagaaaataatatcaaatttcatgagaaggagatcacaactaataatccataaatataacttttgccagcatttaagtgtcttagattgcaggcttctgcaagatacacattacttgtagttttgtatccccagcatttcccatcccagtgttgacatgcaataggcacccagcaggtacttacaaattgaacttatccaataacccttgctcttgtaaccaatcttacaataatatctcttcataatgaatcattcttaattctcttatttcctccaaactctcccttgttctctgtgtcagtaaaactctgaaattaaaaagggctttcaaggtatatgatttaaatggataaattgccaactgcacttctattttaaatttacgttgttacctttacagctaaaaagtgcttgagaaaacatactttgtattataggagatccagtagaatagtttcaactcatatggtatcttacccaaatcaaacttcagaaattcactagtgattcttgctagtatgaatggcttccatcatgcaagtccattacaccttggagcataatcatgaccaaatctaggagtttctcactgatgggaccagttcttcatgctcttttctcagccttagagagtggcccttccatgtccaagaacaatgtgctcaaatgtgaaatcttaagcagcttgtcagtttcacacagcctgttgaatccttgaagtagtgaccatttgcttgttaaaatagagagtgactttggagaataagcatgtggtgcattttatggaaattgctccatttggcagcatctgagtataaattggcatctcagcagtgcagctgtgattgtaattgactaaagttctcagcagaaagagctctgaccatctttctcaggcaaatagctctgtcagaaaagcttcatccccaacatttcccagtcagcctttcaaagttaaatctcataaaccggctttctttgatgtggtcttctgcagttttctcccttccccatcacttctaatgtggtggtggtttgtgcattgcaagagtccctggatagttgtttggttgttaatcagctttagttctgggaagaaacttcccccagaaggaagcttgtagatttctcttacaagttgaagaggtttctgtgactctaatttctgtcctaaaaatcaccagtgaattgtcacgagtggtacataacagttaatgagagcaagatattctacacggaagagagaacagtttttcaaaacagaaatgcacctttctataaacgaagagcatggagttagaaacatggtctccattctttgtctaagctgctctcattaggataaagagtacagccatcaagaagaaaagtaagttctagaacaagtctaaaatatcctgaggggttagcttatctgcctagcacaacttttacatttctctgtgtgggccagctctgtcctactatcctgaatctcctcaaagaacggtgtctcccccaaataaagactgtgtcggaatattcctcgttgaattcccagtgcctctccatggctggcacagagaaggaactcagtagatgtttattgatgaggtgaatcacctagactccactgtgtgcaccgatgcagcagcacccatgcttagcacagtacaaagtcaggttcttctcccagactcccagccacttccttgtcccatcatggcacaactgagcatctcagtggtgactttttgtcttcaaatccctcattcattaaaatccaaacttgagagtaagccagaatggccagcctccactgtagtcatttcctcttgtgccgcagagaggagaccacatgtcacatggattaaggctgcttcattggtgaacggcaaggcagtacacaaatgcaagtccccaccctttcactgtttagcagggccaacagaaaggacagagtctgagagtcaacatgactttgaaacctggctcagacacaagccatgtggcctttgactttaaaaacagcaatagaaaacctctttaagtttgggatttttcataattagaatagtgaaagcagtgttccttaccccactggggtgggatttggtgatgtacatgaaagtgcctggtgcaaagtagcttctcaatgaatgtcatttgctatccataagggcctctggcggggccaagctgaccaacaggtgaacaagaacccatactatagttgttgagagtgtggcaagagagtaagacatacataatctggtcttctgtatttgtgtgacagcactggggacaaagagaatgacacagacccatggtcctacacaatgtagtgggcatgcctgtcctgaagagtctttccattgagaacaaagggtaattcacatcttctgctataagtcgccttgcagttccactgggattgggtgactcgcagcaagcagcagcatccacctattagcccatttacctttaggtgaacagagctcctcctatggacttcaacttctcccttgtatgtagaaatagcatgtcctgaaactcattttctgatagcagatagagtgtcatttacagttttgacatgatttggcattccatgaaatataagcagtattttccttacttctgaaagaaatatcagtaggcaactgtggacttacattctcctgctagttcagatcttcaatttaaaatgaattgggattatttgctctcgtatcagttggagactattcttttactttaactcatttttcttaatttgagtaagacatcattctaattttttaaaaaatctttaccattaccaaaattattttggaaaaatcttagctgtaactttgtcctagggactgatccgaattagttggagatattctaaaaattttgaagacattgtacactgagggctgccggctttattttactccagccatgatgaacactgacgagccagcacctctatcagggtgtatgagagaggtggtgagtgggattcaccagctgcagcatctggacagtcagtgagtctgctttccccctaagtctgtatctaaggccttctgcaataaagctaagtgacaagcagggcaagctttggaaatgcatcacagcccctgcccttcggtaactaaccagccaaagcctggacaggtggacacagacacctctaggaaaggagttgttcaaaggcagagcagcaaaataactggctgagccaatgaaatgtttacattgcagccgaggctcctgctcagctgccggaaccaaacaacatctgttgcagtcctacaaggcccaaaggccctcatcacctttgtgtcaggagcaggaggagggctggcctaactgtgacaccatctgtgtgccagggactcgggccaaaaggcctggcacttgagagcttaatttcactccatccagtctgcgacaaggaaaaatcttggagcagactaatagcatcctcaccctctctttcaattacctagtctgctacaacctcaaaacaaatacaactgataatttgttgctttcaagagtccacagagcttctttccactaacaccctctgatggcaggctcacctcctccagcctcagctgctgctctggaatcctggagaatatttgtcaggggagctgaagaaccagagctgctgttctcagaacaatgactgctagccctgtgatcttttttcacaaagaaacacacacccccagcctcctcctgggcctttgctggtagcggaggcttcctcccaaggacgtaggcttggatgatggatgattatcctgggtgagaagagaacagacacaccctcagaacaaaaagagggaacctgcatcttctccttctcaccctcctctactgttatcctgaaccctcccttgctcctgcaggtgctgtccatgagccagcaacatcagaaccacctgggagccatagcagcctggcagcccgctccacaaacacaggatcagaatctaccttttaacaagatcccccaggtgattcagatgcatattcaacctttagaagccctggtccaagtcttatattaatgatcagatgtatgatcattttatattaacaccaagtggaaggaaatctctgctcattgcaaatcttttttttttttttttttttttttttttttttattatactctaagttttagggtacatgtgcacattgtgcaggttagttacatatgtatacatgtgccatgctggtgcgctgcacccactaatgtgtcatctagcattagtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatgtctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattacgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaaggtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcaagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgaccgtcacccctttctttgactcagaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcctgcaaatcttaaaagataaaggaattaaggcactcaaacatctgtagacagaaaagtactatcagaagttagatgttaatattggcaatcttttctaaaggtctggctacctctgccctgcctctagctcagagagggaagaagagaaaaaatgttgtacaggcacaatctgtgaagcagcagcacccagacaatgcagagggcgtgtttcctctccctggctgtcccttcaagcagggggaggtcctagccgtagcatccaccttctgctgcggccagaaaagagccagtgaaaaccactcagaacttccctgtcactgaaaggccattaaatttttacaagatgaaaagtactttttccaaaaataaaacccagcgttatcattttggtaggctgggaaaatgtacagttcctttttataactgcaaataagagcagttctgtaccaattctaatttttttcttctgattctgcaatcttctctccttagcaggaaaaaaaaaaatgtactgaagtgatcaggtgttatttagaccctcagggcacacctgtgcccgacaaagcactcatcagattcctgagataccaccagcacctccacacgggggtggtttttcgggtgaaacagtgcagtgttgtgactcatgggccgcctataccactctggcccttggtttccccatctgcagtaagctgttataaaggaactggaaaaactcacctgccttcaggggctacccttggaatgcaagtaagtgaggaagtgggaggagactgtgaagaaaagggagagtgtacattgaggtcacagttcatcacgcggtgagtgccatggctctttccagctcattcagtggtcccgtttggatttcacaaagctgacatgtcaggtctgtgctttatttttgaccatgccaactgctgacagttgagagagagagagagagagagagagagagagagagaatgtgtgtcttcattacggctctgcacttgaagttcctagcaactgggccagtagtgagacccagtcggtcgtgggattccagcagctggtgctttctctgccagagaaacaagatgatggtctgctagcagaaatcctcaaggagctctagaaatagaatgaataggaaaaagaaaaagaaaaaaaaaatccaggagaggcttgcttcatgttgctcttgttgttgttttgtgctacatattattttaagatatgttcaaattacttgaagcatttaaaaatcaggagatttcacatttttaaaaagaattcaaatttctggctccctctgaattggaaaatctgatgacacagcctcatttccatgtgcccacaatcagctaaagttgtggccacttccctctttatctgccttctccaggccctttccacttcccctccattcccggggctacacctgcccatgtctggatcctgattatttaccctcctggtcccagaagtcatttacgttctcaacgcttttacaatatgatgcgaagccaggttcccagtctctgcaaggccagatggttgagaacatggctgggggagggtccacttcactaggtttacaaagcacaaaaatgtttctttatctcagaacatcagattttaaaaataggaaagccctgaaaagaagatgaaacaactatgtggtgaaacttagaggcagttatttaatagtgtgccagccaccaacaagcatcttatcccggcgtaactacagtctctgcagaggttcctgctgtcctcagttatccactgacctggctggaaggatggtcttagtctctcagctgactcagtgacccattgttgctggatttgttgctgcatttcacttcagttgtataaaagcaactcatttgttgctgtccctttacttcaatttattaggagttattccagatctatagaagagaactgagaatagcataacccaaccacttcccagctttattggaagctaacactttgccatatggctctaggttgtttttttctaaggaataaaacagtagtgtataaggatagctgaagctccccccagtatccctccccaatcccattctctttaactttccagaggttagcagcagcctaaattatcttttttgtgcattattttaaatatactttttagatttaaccatttgacaggcccattttgaaacgttacgtagtgttccactgtgaaacacatcatgactgattttaatatttcttttcttgatggacatataaattgtttctgactttttgctgttaccaacaacactgcgatgcatgttactacatctgtctccctacacacatgtgtacgggtctctttacacacccagaagtggaattgcaaatcacaattgcagcacttttttacctttattttgttgccaattcttctccaaaataattgtattgttttagctctttgagcagcaatatatgaaagctttcattcctctttctcttttctagtacttggcattgtcgaggcttctaatttgggacaatatgaggataaaatgacatcttgtcattgtttaaatttttgttttttgatttctagtgagcttgagcatctttccatgtatttgtggaccacgggcatttctcacaccatagattgtctattcctttattttcccctttttttttctcttgggttgtcttctttatgttgacttgtaagcatgctttttaattctagtaacaatcatttgaaggttttgtgcatcacaaataacttctcccagtgtgtgtgtgttagccgggggaggggagtgggttgtgtatgcgtgtgcacgtgtgtgtatgtgttgtgggagcttttgttttacagaagttttgattttaatggagtccagtttgttaataccttgctttatggcttatgctttttatgtcttgtttaagaaacatctccctactttgaggtcataaatatattttcctgcattattttctaaaagttttcaaatttcacttctcacatttaaatcattgatccctctggaatttgtgtgtgttgggaaatagggctttataattttccatctttattgaagactttatcttttccatgcttatctgcaataacacctctatcctatatgtattttcatgtatgtttgcgactggttttaggcactctattctgtttcattcgtcctttttaatctatcccacaccaagatcacatgtcttagtcaccaagacttcataataatgacaagtcccactatcttttgtatttcaaagtatcttagctctttttaaccttttgctcctcccaatgacttttaagataagcttgtcatgtgtcataagaatctctattgggatttcaattggaattacagttatagattaatatgcaattttattttaaaaagatatcttttagcaaattaggaagttcttatttgtactttggttagaattcttaatcctaaatgagtgttgaattttatcaaaatttttggtgtctattgatatgatcatatatggtttatgacataatctcctttatagtatattcattaatagattttaaaatattaaactatgcttgcattcttaactaaatattcctaggtcatacatactactgacctaattgactaatattttacttgggaatatctcattatattcattagtgagaatagtctgtaactttattgtactttcttgttcacttttagctactagccagatgagttaggtagctttctctttttctatcctctaaaacacattatgcaataaagagattacttattgcttgaagatttgttaagcatcacatataaaagcatctgagttttatgtattttgggtaagcttagccttttgattactgattcagtttatttaatggttgttggtatatttagattcctaacttctccttaagtcattttttaagtcatcattttctaggaaattatacatttcatattagtattaaacattggcagaagggtatgcatcaaaatatattatggactttttaaatttctacagtattagtagttatatccacttttaatttctatattatttctattactgtgtctacttctccacctctcttccctccctctttctcctgcctttttcctttttcatttagacatcacaaagctgaactctgaatagtaatttcttctgctacaattttgaaattataatttatttttgagatagcatgtagggctatttctaaatactcatgattttaagtagaatatgctacgataaagactgtctcctggtattttactctactgtttcccaagatatttttctaattctgactaaagatatcaatgttgcagctttgagtgccatcaaaccccatccctcaaccccaggacttctaaactaactgctctggaagaaaaaagaaaaaaacatgttattccctaccttcgtatcccataaattatctttccctatatcagaaataattttaattgttcaactttatatatttaaagatgatgtttagatcaaactcagtttaaaaacatattgctttttagatatcctgtgtacctactactgtgcttcacttcaacggcagcctgtgagcctcttcactcatctcttgacctgggcaccctgcagccttccccacctccctgttactccgatctgcattgtcaccttgtagaatctgttgatttgtttctctcaaagcccgtatcacatttctgttatcctaaaacctgttctctctcagtctctctctctttaccaaacactaaaaagaaagccaagccacacagaaaaaggggaacaaagaacatggcattcttgtgacagtcctctggctcctagccaaaagttctacttagaaagatttcctctttctttcctagacattctgtctcccccaaggagttagacataaagcatctttctatctgggaaacatcagtcctcaccatctacactctgctcagaaagagatattttctccaagtcatgttccttggggaagagaacagagctacttgcacccctgagctcattcagcttatccccacaaagcctagagctggcctcgacactacgtaatttcccctgatgctgccctggcaatgacgttcacagtccagactctttcagccaaacaaaatagtagcgatttaaacagatcatcagcttcttgcatcgcagtggcagctggcacattgtgaacattcagtaaatattaatcaatagctatccagtggcactgaagagagacgaaagaataatctgaaggcttaaccaaggtcacattaaacaatcgctgggccctaattttcaagggatggcacatgttccctcagctagagagacacaggccaggagaatttgcccaatgccaaaaggattttgcttctgggtgccaaactctctaggacaaaggatatattctgtttatggttgatctgtattagtgaaaggggataattaaggacaccttaagccagcttagtgagaactttctataactgctttctgagccataaagtaagggagctgagttagatcctgagtatagaccttaaaataaagccgcagcattagaaatgcctcattccatcccagaatggcctatttgtctaatacaaatgcagtccacatcacaccttgtacagttttctacatctgaaagttggtcatgagggcaatggatcttgactacttagtgaccaaccttccaaaaactaaagcaagatggaaaatattacctaaaagcacagagagagggaactttaccaaaatgcataataaacttagtgtaccaaccagttatacaggagaggagctgacatggttcctgattttcttggatggcccaatttcagataaactctgtacgagctcatcagaagatgggcccagtctctagccaggaacaggaagacaggaagagggcttctgaccaaaagccactgtgtaaactggctcaatggatttatcctggccccctacacacaggaggagctacagtttctcaggagaaggcttccttccaaggcaaactcttgttcccagagatatttcaagcctctactttcctaagtgctttatttctctgacctaactagttatgcctctcggatttttgttcctgccattcccaggtgggatccaacccaaccttgtcccaactcttctcattcagtcaactccagctctgaaacccccagatggaagccagggccctacactttctctctgcccagaaaggagcttggaatgtgaacaggcctgatggtgtgaacacaccattgcaatcctcttcagcctattccctggctccccaaagggtgttacttggaagatacacccaataaacacagtctgccttataccacctgtgtgtcttgtctccccaagattttaagctccttaggcaagagccttactgctttaatcgtgttttgcacataatcatctcttgataaatatttcttgattgattgccagtttgttgttgttgttgttgttgttgtttgagacaggttctcactctgtcccccaggctggagtgcagtggtgcaatcatagcttactgaagcctcgacctcctggcctcaggtgattctcccaccacagcctcttgagtagtgggactacaagcacacaccaccacaccctgggttaatttttgtacttttttctttttatagagacagggtttcaccatgttgctcaggctggtctcgaactcctgggctcaagagatccacccaccgcagcttcccaaagtgctaggattacagacgttagtcaccgcacatggccacagtcagttaattttctaatctccctataatcacagtcataattataaaagatacttttaagcagctattaaaattttgcttttagtacataaaattctcggagaaacaagactgaagtaaatttcttaagcccttggctcaggctgactattgtttttgacacagctatgcattttaaaataagaaaacattccataaacataaaggtaaattatattcagtactttgccatcattaaagcctgacttgaaaaacagcaaaattaagctccttgtttctcagtaataaaggcttatgtcacaattctccagtaaaactatgggatatagactgctgctgcctctcagtagaggggaacataagccagtctctctccttcataattattttatttagaaggcatagaagagacatatagaaaaataacagtataaagagtacagggagaactcatttcttggagcagattttaaatgaattagaaatgtatttttgccatctgctgctgctactgctcttatgaaatttgggattcacaaattgcagtttgtataacactaactctgggactcggaaaatctactgcaggatctgtcacctgaaggaaatgttctggattactcctggaagctgctcggcacagtagagagcacactctctgaaggactttcccaacatgtgacaagcattaccccatgcttcttaggggagagggagtgtgatagctgcatggtaccaggtattgcaccacattgcatggttggaaaacccctttgcaacacatcactgttactattcccagcatcactggatgtagaaatcttcattttacagctaaaaagacatacttactgaggctaaataacttatgatcccagggcattaaaggataaggtaggaatttaaactagaggcacgttttcacacagcctcactcaatgaggaaaacagacatttccctaatgaaaacaaaaacaaacaaaacatatcaacagccacatgcggtagctcatacctgtaatgccagcactttgggaggcttaggcgggaggactgcttgcatccaggagttcaagaccaggttgggcaacatgataacaccctgactctacaaaaaataaaaatttcaccaggcatggtgctgcatgcctgtaatcccagccactctggaggctgaggcagaaggatcacttgagcctgggaggtggaggctgcagtgagccaagatcgtactactgcactccagcccgggcaagacagagaccctgtctcaaaagaaaaaaagaacacatgcacttgaacaatcaataaaatggagtaataaatgtaaaactcttggcacccaaactccatttatatatatatatggagtctcactttgttgcccatctggagtgcagtggtacaatcttggctcattgcaacctccatctcctgggttcaagcaattctcctgcctctgcctcccaagtagctgggattacaggcatgtgccagcatgcccagcaaatttttgtatttttagtagagacagggcttcatcaggctggtcttgaactcctgacctcaaatgatccacccaccttagcctcccaaagtgctaggattacaggcgtgagccaacatgcacggccttattttttcatctttatttctgggcttggaaagaaaaaagaaggatggagaacatgttctttaatcatctgacaaaggatctgattcagattctacagttctataacattctctataacaaagtgaccgcagatgattcatctacctaaatacaaatatctagaagtcattccatatattcttccaataataccaggcaccaaaactacaaagatgaaaagacatgcactgaaggagcttttcaagtctagttgagggtggggagtggcagtacaaagggtgtggcagaggcggagattgaactctgctgctttgcagacacaatacaagtaagtctcagccccgaacaaaacaacattagccccttgttcctcagtaatagaggcttatactatgccgtcttagtaagactatggcacatcagctgcagctgccttcagacagtgctcttcagacctgtgaggctcaggtcccttccccggtcccatcacactgcctcacctgttcccagtggtcaccacaagaaccagcagcaccctgccttatggaggaaaaagtaaatgtgcataaactttgaactcttattgcctacagggggcattattttattgaatccccactataaccccgttttccagatgaaatcactgaggctcagagaagtcaggtagtactaacatcaggaagaagtgaaggagccaccccagacctcaaagtccattatgtttcactggttccactgcttttgcccgttagtaactgtaaacaacgatagatgtagttctgttactgtctacttaaattgagactctttagtgtagattgcaattcatggcagaaaactgtcaacaatggtggcttattacataaattttaagactgccttagagaatcctaaggaataccaagtgtagttctctcatgtgagaacctcaacacaaaccccatcgtccttagaaccagtaaagttacataagcgaagactgaatccaaatgacacatagttcaacagcggtagtggccaagatcattgcctctccattcagattgtgccagggtacagtgtcatttctgaaaacgattgagatggaacaccagttttgtgttttgttagaaaaatattaatggttctaaaaccacatgctgcttacatatttttaatgtaaaataaatatgttttcttggcactgtaaagattgtggtcatatatcatcaggaggcagcaatggtagaagcagcccagattagagctggagatggtaacatttaccacttcaatgtacagtatagttgtgggttatgcaggatgcgttccataaagctccaccactgtcttcaaaattattttacatgcttatgtagcaagacttaggagggattaatagcaaaaggacatgcttatacaattaggaatggaccagggtcatatgaggcagttctctgaaatggtaaccattcagcttaaattacaaaagaatcacatcctttccaatgtagtatcaagaaagccaacaccaaaaatttaggcaccctggtgtcttgtgatccattttggcacttaagtacaacacctaaactgcagacagaacttcgatgaagaaattactaaatggatgacttcattcactcatagttcataaatctttgtattatagaacattttctgagacttaaccaaagctggttatcatccagatagaggggatgatgcttcaggctaatctaaagggatgctttggccaaaagtacctagagattttttttccttttaaattagaaaaataatccctcaggaattaacacatcccactttctaccaaccattattccttggtgtgaataatttaatcaaatgtcatccttttgatggatgactggtcacatgggattttgataggctccaagtggaggggagagaatttgggagcctggcaggtggtcacaggtctgagaagccagagcagcttgaaggaaagtgggttaaaggatggagggaagccgaagatattgtttcaacaccctcagttttgctccatttcattgttaatgcgcacacaaaacagcaggagaggaaatctgaagtttctccctgagctgtattaggttcttcattttaaacccctctcccactgaggattggttcaaaattagtatattccccatactgggctctcactatttgattcctgaggggtagtgatctcactacccatgtaagaagggggagataacaaggtctgtgtgtgtggaaggcagccccagaagcagtgaccttaggaagggttccaagtcacgaaatgtggcaggaaggagcttccagttgggccactacccacagaaagtcaaaaatgacctcttcggtaaattaaaacatctaagcctacttcatccttttttcccatttttgacatgggaaaactggctcttctcagttaatccagggtaatttgctaggcatccggcacatgccacatgtttcatggaaatcacttccttgaaccctcagcagcctgaaaagtttacagaccatccatattttgtagatgaggaaactgaggctcctgaagtttacacagcttgctcaaagtttatgtccctgcaaactggcacgaccagaattcaaacccatctatgagactcccaagcttaagcccgtttccttctcctatactacttcttatcctaaattccataccttaattcttgtttatttttttctaaatcctctatgaaaactgttacccagggaaaattttccaccatcctatagctctggacatacagccattaggttgtaaattaaattattgttcaaataagtatgcaaaattatttctaaaagcagcaaatgtacttaaggaaatggccatgataacatttcacttcagaaactatgagctttgcagtgtcagctgatcaacccttgggaatatttaatgattttgtcctggactactgcacagtgagaaaatttgctttgaccttaggatagtgaatatgtgtgatttagatctgaggactggtaaaaggaaggaggttgatgcaagttgattaaaaaaaaaaaaaaactagatggccatggcatggtatatgatttgctatttatgaagagattttgtttgcttttgtgatagagttacctgccctgatatttattctgcttattaaaaaaaaatcacactcgtcagtttgctctctgggcatgataaatacatttcatgtcccaagtcctattacagtaaatttattattttttatttcaacatggggcaaaaactatatttttgatttgttctttccaactctgtcaagtattttataacttagattttatgcatttcttacttttagttattgtatttgcatttctgggacttctacctattttaataaaaaaaacttccatgtttagtaagcaaaattaagagctaaaatttaaccataataccttccacaaaataatagcactaaatgagctgtgtgaagtatttttatatgtgcatcaccatattcaatctccatgtatagtgcttatcaaaattagttgaagcaactaagattaaaacaactcattactattatcccatctttttttggccccttagcagataacacaagaaaaaatgttgaggcttagatagtatctatacacaccaaaatgactagccagtttcttttttcaacacagatgtttgttgttatccaaacttaaaagccaaatgttttgattgaattgatttgctacatagccagtgaacagaaatgttcacagagaacagagcaaatttcatgacaatgtaaaattaggtttgaacccaggggtgtgccatcaaaaataacacaataataaagtcatgtgtaaatccagttgtccattctttcatgccatccctaattattgagcccctaccctctgccaagcactgttctgggcacagaggacacaacagtgagccacagtgatactttctttgctcttttggagcaaattacctagttacaagaaaagtctcaaagtgataaatactatgccaggaattcaagtaagggattggggtaggtgaatgatgaaggtctcacttgagcatgtaacctgagatccaaatgacaaggaggagccagcaatgcaacagtgtgcaggaagaacattgcaggtgtagggacaaactaatacaaagaccgtaaaggtggagtagtgcaaaggccctaagggtggagctcagcaggagggctgtgtagctggtgatcactggtcaaggtggagggggaaggagatgaggtcagagagggtggaggcacaaggccatgtggggctttacaggccagaacaaaggatttgcattttattctaaatgtgagaggaagcccttggagggttttaagatgagggatgcgattcaatttatatattctttaagttttaaaagtttaagttagaatcataactatgcattaattcttagaataaagacaatgaattgtgtgttgattacattagattgcatgacatcatatcacctcctggcttcacttttccccttgcagcgtgacccacatttgaaaccttcatcaatctttccaaggcctctcttgtgaggtgtccagggcagcaacatccttcccaattcatcctgtttggatgttgactggtctaaactccatttcccaatagctttacatgtgatttaagcagttctccatcaccttccataagttcataaaatcctgcctcttttcgggaattgtaatttcactttacaataggtttgcattgcatattttagaccatctggacattcagtgagaacacagacatgatggggatagatagaccccagatggaagggagggatgtttgaaaagtattgttaagtaatcaggtgagaattttcatgttgtttccctagatcccttaagtgcagggactgagatcataaatattcctgtgatccactggaccctccccctaaggcccttagaaaatggttgggaaaatggatcaacagtcacaaaacaatcagtgaacacaacagaatgatacttattaggcatctataatgacagatgagagaggcagaatgatgttcccctaaagatgtccatatcctaattcccaggacatgtcaataggttatgtcatatggcagaaaggaattatgattgtgaagggaattaaggtgctgattagctgaccttaaaatagggagattatcctggattatccaggtgggccccaggtaatcacaagggtgcttgaaagtgggagagagagtcagcagacagctgtagaaagatggagttatggaagaaaggcatagagcaatgcagtgttgctgcctttgaaggtggaagaaggggagcatgacctaagtaagctggaaagagcaaggaaatggattgtctcctagagcctcctaaaaggaacacagccttgtcaggatgccttagttttagctcagtgagatccatgtcagacttttcagctacagaactgccagataataaatctgtgctgtgtaagtcactacattagtgataatttgttacagcagcaatagggaacaaatgcaacagaataaagttgcatgtcatggagtaaattagaaagtgcaagaggtgaggatgagagacgaacataaagtcacaggctcagggtttcataaaagaggcaaatctttgtccataaaacctgtgatagaacaccttaccttctgcagagggtaagacaaaacaaaactcttaacgcttttaagaccaatattcaagaccagcagcctgactaaattagtacagggtacagggatgtttttgattgatttctgtagaaattaaaaaatatttaggttaattaatatgactactgattagggatagattttgttcctaattttaaaagtctatattttataactatttaagttgttatttacagctcataaaatttgcaaggcataatatccttgagcctttatttttttcaagtttccaaaataagtttctgtaaactttgagaggagttatgatgaagcattatctatactctggcagagttttgttttgctgaatgttccagactaaaagaaagttagctcaggaaatcctctcaagtggctattgatatttaataagcttaactctaatgacaagtttcagccagtccctcttccagaaagtccacaaggtcactgtttatctgttatataagttagaggaggataccatcacctggtttccttacactgggaattattgtggatttggcatttgtccctctctaaattttctccttcctttgggcaaatgcaacatgtacctttcacctttgtttccacatggctatgagcacagtatctttcataaggccaacactaaatgatatttcatgaattagtaaatgaaacgttcaaattatagcagaaaggttgagcaaagtctccttttcagattcataattatgtatgaatctttatgcttatgtgagaaactactgcatttaaacatttgtgcagatatgtgtctgtgtaaatatacaaaggttatcctaatatatctaattttgccagcagcaaatatcaggcttcttagtgctaaattgttagatcaaatacactaatttcaatgatccagaagatatttcaaaaaaaacattgtatttaaaactcagaaattccctttctcactgtgctttttcaaaatgactgattttcatataccatcttaatggagggttcttctacatctaggctctgtcactaggaagaaaaagtcaagaaatgagtcattcatatcttcaagcctaacaaagacatcaaaagacatcaaaatcagaaactttattttcactctcattgtcaatatctatgtaccccaaaagagcatttttgaattgctttttgttgttgttgttgttatgaactagtaaattggaatagtcttatggaaaatacagactagggttgtgcttgcaaatgcatagacttatgtaacataaatgcattttctagattctagacaattccagatggaactttttttattccatcattacaatgtaggaaattgccttgatctttcctgtgcatgcccctatagtgtgactgagaccacaccttattaattttgtctaatcccttacacctagaatatagtggccaccctaaatttttgttgaattttactctgtagataatagaaaactaataaaataatacaaaatcaagtgaaaataaaaaaattatctaatttacctgtttcgtatgcacaataaaactgagtaattaagcctccagatcctaactcatccagtttagcaggatagtagagaatatgagaaattacctgaacatcaaattcagaaaaccaagttttgccactaagatatttgaaatataaatcatcttcagttttaattatacactgaatatttcaatgccctctccttgttttgcatgtgtaatctgtgtaatcatagatcaaaattaagtgttttatttaggaacctatttaaaagatgatagcagctaatcatttaaaattagctccatgaccagaacgatacagccatgcaaaactgaagcttagggtttgatccaaataatttacgttgtctatttgtcccaaattcgttaattcataacttctgtttccagcatgcccccgcatttgggctgttttgatcatacctttgaaagcactattgcttggggaggagggatggctgttttaaatgaatcctaaatgtgggaaatcaatataaattctcatccataagagaaatttttaccttgacactttgttcttcatttgcaattttgacttcttgggtgcaccctgttctcagatatggagggtacatcttggagaaaactgtcacagaccctcttggagggacagaggtaccctaggtagtgacaaagcctgtgagcttcaaaggcacacctctgatacctctagcttttaatggatttcttgggctttccaaaagcagcccttgaaccctgggaaatggattatctgtcttttgtttcatacttcaaagtctgttttttaatggggattcatttctctatggaattcaggaggattcgcatgtctaacaaggactgacatatatggagagaattgaggagaattcctttggaaacattgaacacctttaacattggaaagctgaccataggtgggaattgaacaatgagaacacatggacacaggaaggggaacatcacacaccggggccttttgtggggtaggggaaggggggagggatagcattaggagatatacctaatgttaaatgatgaattaatgggtgcagcacaccaacatggcacatgtatacgtatgtaactaacctgcacgttgtgtacatgtaccctaaacttaaaatataatttaaaaaaagaaaaaaaaacattggaaagctgaccacttattttgtctgaaatagtccctggactgcattagaggccaaagcaacattggcttaaaatatacttaccaaatgtattgaagtcaagccagggcccttatcaaaccaagccagaagtttcccttgctctttcctattcctttccaactttgttgagcttcctagaaatgtacttttttattttttaatttcaacttttatcttagatactggggctacatgtgcaggtttgttacatgggtatattacatgatgctgaggtttgtggtatggattccatcatccaggtagtgaacatagtacccaataggtagtttctcaaccaagtactccacagtgtctgttgtttccattgtccccatctttatgtccatggtacccaatgtttagctcccacttgtgagaatatgcagtatttggttttccatttcctgctttatttggcttagaattatggcctctagcttcatccatttcactgcaagggacgtgatttcattttgtatggctgtatagtattctgtggtgtatatgtaccacattttccttatccaatccaccattgatgggcacctaggctttaatcctgggatgcaaggcaggttcaacatatgcaaatcaataaacgtgattcactacttaagcagaattcaaagcaaaaaccatattatcacctcagtagtcacagaaaaagccttcaataaaacccaatatcccttcatgataaaaaccctcaacagacgaggcatcaaaggaatatacttcaaaataataagagccatctataacaagcccacagccaacatcacactgaatgagcaaaagatggaatcattccccttgaggggaatgatggccactctcaccactcctattcaacatagtactggaagtcctagccagagcaatcaggcaagagaaagaaataaaagtcatccaaatagaaaaggaagtccaactatctcccttcactgaaaatatgattttatgtctggaaaaccctaaagactaaccaaaagctcccaaaactgataaatgactttagtaaagtttcaggatatcaaatcaatgtacaaaaatcagtagcatttctatacaccaaaaacattcaagctgagagtcaaatcaagaacacaatcccatttacaatagccacaaaagaattgaaatacctaggaatatagctaactaaaggaggtgaaagatctctacaaggagaactacaaaacactgctgaaataaatcagagatcacataaataaatggaaaaacatcccatcctcatagattgggcgccacactgcccaaagcagtttatagattcaatgatattcctctcacactaccaacatcatttttcacagaattagaaaaaagtattctaaaatttcatatgaagccagaaaacaggccagttgtcatgggtcatgcttgtaatcccagcattttgggaggccaaggcaggaggatcacttgaacccagaagttcaagaccagcttgggcaacatagtgagaccccatctcaaaacaaaacaaaacaaaaacagcctgaatagccaaagcaatcctaagcaaaaagaacaaagccagaggcatcatgctacctgacttcaaactatactacaaggctgcagtaatcaaaacagcagggtctgatacaaaaacagacacatagaacaatggaacagaatagagatcccagaagtaaagctacatacttacaaacatctgactttgacaaagctgacaaaaacaagaaataaggaaagaactccctattcaataaatgtttcagggataactgactagccatatgcagaagaataaaactggaccccaaactgtcatcatttatataaattagctcaatatggattaaaggtttaagtgtaagaactcaaacaataaaaatcctaagagaaaacccaggaaatacccctctcaatgtcagccttggcaaagaatttttggctaagtccccaaaagcaattgtgacataaacaaaaattgacatgtggaacttaattaaactaaagagcttcagcacagcaaaagaaactatcagcagaataaacaggcaacatacagaatgggagaagatattcacaaactatgcatctgacaaagatctaatacccagaatctatgaggatcttaaacaaaatcaataagcaaaaaacaaatagcccataaaaaatgggcaaaagacatgaacaggcacttctcaaaagaagacatacaagtgtccaacaaacatgaagaatgctcatcattactaatcatctgagaaattcaaataaaaactacagtgagataccgtctcacaccagtcagagtggatattattaaaaagtcaaatattaaccaatattaggaaggctgaagagaaaaaggaacacttatacaacattggtaggaatgtaattggttcagtctctgtggaaagcagtttgaaagtttctcaaagagcttaaaacagagctaccaattgacccagcaatcttattactgggtatatacccaaataaatcattctaccaaaatacacacacactcaggttcactgcagcactattcacaatagcaaagacgtggtagcttttgaaaccatcattatttcatgatttgggccctctgcactcctccactctggaagcagcaggccagagacccgtgggaacaccaccagccaggcaaggaagaatagcaagctgggatccagtgggaggcatagacttactgcaggagatgactctaacagtacagtgagggggaggtggcagactatctgagggcagtaacaatgttgggcacattttagcagtgactggcaagaaacagtagcagggtttcaaataaagagacgaaaccctgccttgggatatccaggcagtagtcaatatgtaagagtcaaagagctacacattattccttttgaaaatataaaaaagaatgtatatagattcatatttttaccaccttttctgcaccaaaagcagtacattatgactttcttctataccttgcttttttcacttagtgaataccaaagatcactccactataatctatgaagatcctaatttcttttgtacagctgcacagtgctccattttggatgagccatagtttatggtcctgaaaaacatttgggtcatttacaatcttttcttctcacaacagtgctagaattaataggcttgtgtgtgtgtttgccattttatctctgggttagattcctagaagtgggtttgctgagtcaaggtatatgcacttttgctggatgctgccaaactcccttctgtggaggctgcactattttgcattcccatcagcaatgaccatcaaatgcagataattttatattggagaagcagggtaggaatttgagctactttaagcctggtgctttgttttctgttgaagtagaaaacaatgtcaccagtgaatagaggagataggtttgagctgatgtcttgaggagagcagggaagttatagcagaaaagggaagtactcaacaagtgagacaggaccattcagtaatgtgaagggctcagccaagactctgttctttgagattttcctaacgttagtcagcatggtagggcaaatttcttcagcagtggtccatggaccaagtataggacttaaaaatgacaaatggttagattaatctatggcaaggtgggggtggcacatagacaagggtgtaatgaaattgaagtgttggcaaaacaatggagtctagactgaatgaagaaggaaatgaagctaaaagggcctaaatagaaaggacttaaggaacaaaggaccatgatgaagagccaaagataggtgttgtggatggagagtgaagggaaagccagagagatatgaagctgtgatcagaggatggagttttagagtttgagatttcagatctggagtagtgccaggtcatagcagggtcctggtggggaaatggatgtggacagatgaattgggaggtaattcaagttaagaaggttcagaaactgaaatgctagggcattagaagggtatgctacatggatattgaactctcctggggtttgagctagatttgaccaaatattttatcaatggagaaaatgtctattatttcactctgataaggcctattgcctaatctgtagctgaagttcataaaataatcattaaatgaacaactgaatgagtaatccaattgctgtaggagggacttattcagcttttaggagataatatgacttaaggatattagtgatatctacttttagtattcaagatagtattactgacttgttctgtgattttgtctgacagttgactagtaaggaaaattggcatatttctttccctgcatcttatttttcctccatctgtgaagaaatatatagtggaaaaatgtctaaacaataagatgggaaatcagagatttggtcccagatttgctactcactacctgtaaccttattcaaagctcttactgatttatcttcagaaataagggtggttctggataacctctattttatttctaattctaaactttgagtttctttgagtacggaatttgaagtaattcagaaagtaaacattctagttgtattcacccatctagtctgaagttctttttgtttaagattgttttgaaggcaaacactgaaactcttgagttgtcccaggaacagatcctgaaacaaagatgtgaggacaagtggtttatttgagaggtgatccctggtagcactagtaggtgattagcgaagggaaagagcctgatactgggtgtgttgaggaccaggtctttactgtgggtgtttgaggttgagtcctggcagggactgctggtaggtggaggtcagaattgaccacccacacaaggaaggaagctggggcatttgtgctccaactcttgtctgtcgctggctggacaacctaagaattcaactggctggacatgatggtgcatgcctgtagttctagctactggagaggctaaggcaggaggatctcttgagcccaggaggtcaaggctgcagtgagctatgattgtgccagtgcaccccagcctgggtgacagagtgagaccttggctcaaaaataaataaataaataaaataaatgacttaagggaaattatgccagttcctggccagagagtgaggttcaagctgttggaaataacctctcaaatattccaataactctaaatccaatgtcatctacggaaagatgttctttcccatgaaagatggacatctaggaagccagatacctccattttcatcatgtcaataacatataactttctccttctacttcttctaggtggattacctaggttttagaaggaaaaatatttctttattcaaaaaagcttaattttatggagtacttaaatggacaagacacaactttttgcccttgacgagactccatgctaaaggggagataaaaccgtgcagaaatataaacaaataaccacagtccaaagctgccttactcccatttgagtagtataagtaaaaatagatctctgggttattttttaaaggtgtttgagaagtagagtaattgaaacattttcctttctcgttttttatttttataccatcttttttctattttcatctattactatctttatctaaatgccttactcttgtatatagaagttggctgcatcaccaatcactttcatcaatgtgcttacagataagtatagcattattcagatgcatagctacatgatttttaaagtgtgtatagatcgttttagactctttgaaagttattcacttttctgtataatattaacttcaccccatttttcctctgcactttgaaacagatttggacatcctgaaatttttttaacacagggggtagaaggagggagaggatcaggaagaataacttgtgggtgctgggactaatacctgggtgatgggttgatctgtgcagcaaactaccatggcacatgtttacctatgtgacaagcctgcacatcccacacgtgtacccctgaacttaaaagttggacattttaaaaaagaaaaagaacaaaaaagaaattatttaacaattagacaagagaaagaaagatatatacaaattaaattagcttaggtggttgcctctaagtagatttggtgtttaaatgtttttttatttttttaatttttttattatactttaagttttagggtacatgtgcacaacgttttatttttttaaatgtttcttcattagtgttcccatagcactttacataaacatctacttgaaaatttattactccatattatcatcccttgctcaaatgcctccccacccctctctgcccttacttgcctccttccctcctccattcttcccttcttccctccatcctttgcacaagaatacagtatccaggaaacaggaaccttgtcttattcacttttgtgttccttgtaccttgtattgggtgatgtatagctggatggatggatgagagacagctataagtgaactcttccacaagatctggagaatgatgatgatcatgatgatcttttaaccatgaaacacctgctaagtactgacttcaccttcagtgttcctgctcctatctatcaaatggttatgacctaaggaccaaagtctttaaaagtttatcaaaatctcttagaagctaagctcgacctctgaaaatgaaggtaattgaatatttttaaagctcaccgcagactgagtgagccaagtgatgaaatgtactcataggctgaattaacagagttttatcaaggattttctcctgtcctttttgcccctttagtctggccacctaaaatatccccagttcccagaattccacagctctctacttcagtttggccattcagatggaacttaaggaaagacacttggaagtgcaattgcagaaaataaacatgaaattcagaactttatagaaatatttgtgcactaaaattataagagggttagaaagttaagtgaattttaatggcatgaggcaattttatgaggaagaaagctttcagtacaagaagagtaatggcacttaagcagggtggaggggtcactcggtgcagccgactgcagtccttcctctgctgtgggcatttgtttctgatagtcggggagcacgagtattgcaatgccattgactgtctgttagcaagtagagcacttcaactgctgtgggtaagaggcaggcttccttctagcaaaaaggctttcagtcagatgcccagtgttttccaaaagcctgactttaactctgaacccaccaagaacgttggggaaactgattatttcagtccatccagaactcatgcagtagaccatgcttaccaaatgccaccagaccatcaggaattcatctaagatgtttgggatgtagatcaagggtgcccatgaaggagtttagaatccctcagggtcactgcccatagcagggacaatttcaagccaaacccattggattcaccctgaataagactttctcctctattatctgaagtaagccaaaattcggttttctgtcttcttctcaacatttttgttaatttgtcaagcagctcgaaagctgccattttcattttcagatgaatatcttagtctttgcttttgcacataagtaaaactgtttgctatatttaaggaagctttaggggaggaagaaatacatagcaaagtgagacccaggccttgtgccttttgctcttttccactaaaaacaattcatttctgatggtttaatttatttagccatgtatagtttctaatctaaaactcctattttaagaagccaatgaatcttttgcttttcagtcccctatagatcttatgattctggctagtatcaaaaacacttccagaagaggtttgggtcaccttcatcagtcctgggattagctcacattaaacaagagaatttataattttgaaaaaagtatttatttccatttcttttacaaccaaagtgttcaatggtttaaaaatagtttaaaagatactctgtaaaatttaaactatatggtgaaagaaagctgctttggtgattttatgtaaaaaatcatttcctctcttagagtagaagttggtttgcaaattaacgtggtggagccaaaatagagaattgcatcgtaagagagtgactcacaatgttttgactttttaaaatatatctttcccgacagcaatgactgccttgtcatttgattgctttctaattaatgttaagttttccattataaatatcacagttttgccagcagagctaccagttgtgaccttgtattacctgtccttgtaggacgcactgggcaattaagaccatgggtgtctatgactacaaagatgtatctcctcatattctaaccttaggtgtggtacaatcagtactgccataagaacatttccattaatagcagagaaataaatcaatgtttatttgcttggaagtaaaaataggtacttactgataagtgtgtgtttcttgctacttttatttatgaagaattaaccaaccatgaagtatccttgataaataaaaccaagttgcaacctttaaaaactatttaaggctgtgcacgttggcgcacacctgtaatcccagcactttgggaggccaagggaggtggatcacgaggtcaagagatcaagaccatcctggccaacatggtgaaaccccgtctctactaaaattacaaaaattagctgggcatggtggcacacgcctgtagttccagctactcgggagtctgaggcaggaaaatcacttgaacccaggaagcagatgttgcagtgagccaagatcatgccactgcactccagcctagggacagagcaagactccatctcaaaaaacaaaaaacaaaaacaaaaacaaaaaaccacactcacacgcacacacaactatttaaaagtagaaggaggaggaggaagaggaagaggaagaagaagagctgtacactatgcaaagaagaagatggatggaacagataaagtcaatccaaggctcatggtatgctcagcagagcagatactgcttgaagcccctccctaaaggcttcatgcaacctaaaaggagaattcaacctagaaggaatacagagacatatttggattctctaacacaaaaatgtttgcaaatagaaaatcaaagctgtgtttaaaagtttctgcagtcagaccttgccaaatgtaggctcgaaagcatcagtaactctctctctgcctctatgtccctatgtttagtcatttagagtcagaggtagctgaaggtggcctccctactgtctgtgaacccaatggacaaatttagaagtttatagccttaatataccctaagtgttatataataagttttacaacctgaattaataagttcttacatttaacttccaatttattttttcctttttgagttaaggaaaaaagctgtacacttgtctacaagaactgtcatcctccacttgaacaaagaccatttatctcttcttctggcacatcctgaaaatttcaaccttttgaatcatattgtatgcatagtttggttattcttcctctaagaaaatgtctaaactgactttttcttgggtattttttttcaccttgcctgattctttcagcagatatttattgagctcctcttttgtgcatgcactggagagatctttgaactatgaaggaatataaacttttctccccattttatacttaatttaactctttcttttccttcatcttaagcatcagttcctcacagaagcatccctgaccttctagtttaggttggtcatgtttattgcatagaacctcagtgtttcctttatagaactgatttcagttgtaaatcaactcatttattgattattttactattatctatctccccaacattagaacaggagccatgtctgattttgttcacctatttattccagtacctggcccacaatactgctcagttaattggtggactgattagtacttgatgaatgaatggatgggtcaatgaatgaaacatagtttcttccttccaacagctcatagcatagtataggaaaagaagcatagctgggcagggaaagtagatgagactggaaaggtaagtatgggataaaattataaacagcctggctaaggtgttttcacattattttgttggaaagaagatgccaacgagatgtggtttagacaaaggcaacagctgcagagcagcaggagcgcaggagctgagtcagagcacctcacacatccctctgcttccttggaagagtaatcagcattgcaaggaagaccctttaaaagattatctccttcccatagagtggggcctggcttacagaaactccctgacccaggggacccacatgacaaaaatagacttgaaccaagggctgattcaaacttggttttgacacatgtggccatacagcagagtaacaagttgctatttttcttcccagccatttttcagacagtttcagcaagattggaattccaggtgtagtcagacagtcaacaatatttattaagcactggtcatgtaccaagtcctggggatagaaggatttttttttaattgatgtggatatggccactgtccttgcaaaccttagagactaatgagccaaaaacaacagcaaataatccagggcaactccatgtggtaagtgttctgatagggaaggcacagagagctgtgggctcacattggtgtagctcatgtgtcccaggtgacacgtggtcccacaggacatgtgctctaagatgtcaacccaatgaggagagttaatcaagggagaagggggaagaagaacacatcaggcaaagggaccaaagtatgcaaaaactcacagacaagagagaacattgcatgtgagaggaagggagagggattctggagcatggtgtggaggagaggagcggcaggaaggcacaggggcaaaaggtgagggagaatctgtagagttcggcaggacaagatcacacagtgccttgtaatccacgtcaggagtgcaagctttatggtgagaacaatgggaagattagaggtgatgggagtattaaagagatgatggttacaacatggtggatgtactcgaggagcaagaaatgggaggaaagacagttccaaggtttgggcatgaatctgggggggaaatgatggcagtcccacactcaggtagtggcaaaaaggatgaagagtaatgtggaggtatgagagatatttaagaggtcgattggttgggctttggggactgattggatgataagggaagaagagatgaggaatcaaggatgcttgcatcactacgggatggtgggaccttcccctaagctgtgacacatggaggaggaatagatttagtgccagaggaaagatggtgaattctatttgaggtatgtttgagtgaaaagtacccatgggacatcttaggggaaatattcagctgccacttgacttgacagatctggagctaaggagagagatcccaatcatctgtgtgactcctcttgttggtagtcctcacatgttggcatatacaacagtcataacaacgtggactttcacgtcagaggagaccaaggctcaagtcgcttatgagttgtgtgggcttgtacacattacattgctaagcctttctgagctttaatttcttcattataaaaatctgttaataatgttacctacttcataggctattgagagaaataaatgaaataatctttgtaaggcacttagcctcaatcaatctttattggtggcagtggtggtagtgccggtagtgggatagtgttggtgggattagtaatgtcatctaccctggaaatgtagatttgagaaccaccaatgcatagaaccatcaaaggtggatttgagaaccaccaatgcatagacgataccaggaaccactggaggaaatggtgataagagtgtagaaaaaaacaccaacattgaagggatacataaagggcatacacaatagagattgaaaagtaaccaggaaggtaagaggaaaatgaagagagtgccatagcattatggaattcaagggaagagaggcttgaagaaactctactggaagtggtcagtggagtaaaattctaccaaagagtcaataaaggtaaggactgtaaagtgacattgaattcagggacaagttaggatcagtgacccctgagacaagcgtttcattagaagggcagggataaaagcaaaattataacaggttgagagaagttgccagatatggctcactatttaatatgcaaatacttctcattaaaaacactgcagggcaggagcatgagaacaaagttaaaagagtattctgacgattgaaatttgagtttgcctcatgccatggtttgaagtataacaaaaagaccttcagggtctgaatttggatgctccattctagttctttatcgtgcattgtcagacactgctgaaggaaagggaaaataataatcctaaagtcatttcctatagaggagacttcttgaatacaccatccaagtataatgtgtttattctgttctcaaggcttttttgaaaaggaattaaactctatatagcatcagtagcaattttctgcattgcatgtgtattcacttggagaattcattttcccatttacagcattataaggtctctatcgagcaggaattccgacaacagtctgcatcactagatcccatttcagggtcttctcaatgacttttgtggatttgaaagcagccttgccttcccttcactatcagagagaacacacagatttgggattggtactcaggattcatttatctttgtgaggacattttacatgatctgtgttagggcctttgccctcaaatgaaacaagctttatttgtccgaacacacatgcagagaagcacacactcctatacacacatgcacatgcgtgcaggggcacacaccattcaaagcctttcacctggaaatagcattgaacagataagggaagtgaggcaccaaatgaatcgttttagccaagactgtaccatgacatcattgatcaaactagagccaggtcccattatggccttcaaataaaaggccaacactgcctttttagccaggactttccagctgtcatggtagtctccaatgttcagcatcatctcaatgggctgacttgcagcgggtgattcttattgtgccatctcaagtttgagaactactgcactaattccttcttttcacagggccatctctagagccagactggctgggttcaaatcccagctaggccacctagtagctatggacaatttacttaatctctttgtgcctcagtttcctgttttgtataatgagaacaacagtatcacctggtaggtagaggcaaggacaacaggaactaacacatgtcaagtatttagcactgtgcatggaccttaaccattgtctttctgtttccccttctacaaccaagggtaataatggtaccaaccttaaaatgtggttaagagtctggcatgagctgattaatttaagtgtttagttgtcactattaaatatctcacgtcattcactttatattctaatcaaacttgtttaaaaaaccaggctagctcctgggctttgtcatcaaaagttgtgtgcatcttcatgtgggtcattttcacatgattccttcccaatttatgtcactgtcttcatttctgaagttgtgtttgtaacaacccaaaatgtgtaacccaactccacatggaaaggggtttcctgtgttgtggggagtggaaaacctctcaggtgttcagaagatgactggcggctctccacttatgaaaatacatgaggtggatgaaataactaacttcagggaaaaggccacaagatttacatccattccaacattcatagcctttatgagacaagtcacaaaaaaggtgcacatattccctacagtaaccttagtgcctcagttcagctatacaaagtggtaactagcttttattcatatatatatatatatatatatatatatgagtaatatataatatgatatatagggtttatatatcctatatatgtaaaagatgtatataatctattatgtcttgcagtgttctgagcagtttagataatttaacctctacaacaactttatcatgtagtactaggattatcagtatcctccttttatatatgaagaaactgaagtgcaaaatgagtaagtagctcaaagaagatcaatcaggtaatgagaggcagtgccaggatttggacccacatagcctggagccagaggctgcatacttaactgttacctataccatcactcagtaattaacacctgagattatcccaagggatgctcaacccagggcttcattttacgggcaagggaataaatgtttcggagaaagatttttacctttgagcagcttcacatacctagaagcttagttgttgctgttttgctcagaaatgcacctctgatctgtgtgagataaagcttagcaacaaagctaatttaagtaccaaaaggtgaaagggggtttatcttgaaaatgcactccaacattttcagcaaccagttctgtgaagcaaggccaaactcagagctaaagtgaatataagtaaaaagataagttattttatctcttctatataaaatatacagtttctaaagaaaaggtgccttttatgtaacatcaatatttccaggagaaccctgggcaagttaggggcagagcatgatcgaacagagacacctactggtgagagcaactctcacttcatagatttctatcataatttatttcaggaacaataatgatctcattatcatttgaaatgtgttggatatggacagtatggttgtaagatacagagtcttcccttcaggagattacatttttaaaagaaaatatcatatgtattcaactatttatgtaataactgaagcacaggattgctattctcccttatagaaataccaaggtacttttgagggtactgcaataagtagctgtacttgggtgaggcaaataccaggctaggtgcaaggtccctggagtcctacattcctctcatctcaatccacagtgtctgttgattgaacactggcattccgaggatggatgagacagagggccacaatgcactctcaactcagaagccaggagccaaggggctgatcattctaaatgtctctggttgcccttgacagacacttcccagccagtctggagttccaggatcagacctggtcttatcagatcagatgttcgtatctcttctgcagtactcagatgttactttggttctccagatatgacacttttcaacaaacatttcatgaatatatcattgtttgaattctctcttgtgacatgtcagttggttgatgttgagattgtactttgaatattgtactttcctaagttttgactaggagaaagagttcagaaaggagaaatggggaaaaggatgtgtcttagtacattcaggctgctgcaacaaataccatatactgagtaacttataaatgacagaaatttatttctcacagttcttgaggctaggaagtccaagatcaagacaccagcagatttagtgtctggtgagggctcatttctttgtttgtagatggtaccttctcactgtgtcctcacatgtgatctctcctgggcctcttttataagggtactcatcccattgatgtgggctctaccttcaagacctaatcacctcccaaagcattcccccattctaatacagtcaccttggggcttatgattgcaacatatgaatttagtggggacacaaacatccaaaccataggaggatgaaggaaaatgaaatttaggagaaaataaaactacatagggagatgacaatattactttttttgttttattagttaaaacactttggattctcagtttaaactttctaaatttcctagccatgcttacttatgattgaaaactcttaatggctttagaagaaatagttctcagttgggttgtttgaatgcaatagtttatgtggtttggttttaggttccatgtagaatttggagttaaagtaagacagtctgcatatctgaaagtgcaactgaatgacacaaaagtgattacacctcagatctaaacaggatactttgatctaagggagaagacaggatgaaagaatttaaaacaatttaatggacgatacattggtgttgagaattcagccaactattgagatacagacttaatattaaaaataaattcatgaatattactgattagagtttattcatgaagcacctaagtataagcattgtgttaagtgttgtaaagtaaacagatctcaatcagacatatcctgacgattgaggagttgtaatccagcaggaaagataagataaatgactaatcttcttttttttttttttttgagacagagtctcattctgtcgtccaggctggagtgcagtggcaggatcttggctcactacaacctccacctcctgtgttgaagtgattctcctgcctcagcctcctgagtagctgggattacaggcatgcaccaccatgccccgctaattttttttgtatttttattagagacggcgtttcaccatgtcggtcaggctgttctcaaactcttaaccttgtgatccgccccaaactcctgactccatgatcggcctcccaaagtgctgggattacaggcatgagccactgcgccgagcatgactgatctttaaaacaataggaagaagctgcagggagaatgaaacagataaggacaatggaaagcacccttcactttttgaattccctcttcctccacatccactctatcccaaacagaaaacaagcaagactggaggcacttgaaccagttagaaggctaatcctattgtttgggaatgagaagttaagcttcttaattaacatgggagggggaaggaggtagggattggggaaaaaatttgtaaaggatgaatgaatcaaatttagggagttcgatgtagagcttatggaagaagagctgaacataaacatagacacagacatagaatattagaactgggggggaaaactttaatttccaagtggaaaaatgaaataaaggcagtatttttaacagaaatagaaaaatctgctgccgggcacggtggctcatacctgtaatcccagcactttgggaggctgaggcgggcggatcatgaggtcaggagatcaataccatcctggctaacgcggtgaaaccccgtctctcttaaaaatacaaaaaattagccaggaatggtggtgggtgcctgtagtcccagctactcaggaggctgaggcaggagaatggcatgaacccgggaggcggagcttgcagtgagcagagattgtgccactgcactccagcctgggcaacagagtaagaatccgtctcaaaaagaaaagaaaagaaaaatctgaaaggattctttgcaggaaggtagagtagaaagcaacatcatgagtttcctttttcaactatttataaggctagagggaccaattgatttgtaagtgaaaatatcactgaagaatttggaaatgtggaactggtctcaggagaccatttctaagccaggagatccatggagtggatccaggagatcttgggagctcactgatatcttgtgcaaaaaatgatattaatttgtttatattaagggttaattttaaatcactttttctcccacatgcttttggaaaaggttggttaaatataaaagattattgattataagggagatttttgaggcaggatatttccctgaccccttcgtgggcaggaactggagtgcacagatgctggaactagccagctgcttcactggtggcaggagcagactccacttgcttggtcccgctgtgttccaccccctcacgggacggggagcacaggtgagaggagccagggtgagagcttttaggcaccagcaggagcaaaactccatgggggccctgcagcagcatctgagggtggtgtctgtaacccctgaagccccagaaggagtgctacagtgctgttttaactttactgtctgtggacagcttaagtgttaatagctcagtgtaggttcagcgtgacagccttttgcatctgcactcctggcacccaagttcttatctggcatccaggaggaatgaggtcacatgaatgaattgaatgaagatggtaaatgtgggagattttattgttaatgaaagtggctctcagcaggaaggggagctaaaaaggggacagagcaggaaggtattcttcccatgaagtttggccatccccagccacacttctctctaaagctacatcatcaagttgtccctctgaagtcaagctgcttctctccagtgtccaaccttagtctccaatgtccagctgcttctcctctctctgtcagctgagcctggcatttttatgggcacacgatgggagatggggcagaccatgggtggtttgagaaaaggcaacattcgagctggaaaacagggatggaatttatcattttgggccacagtatcaggcttttgggcttgagggtccctcactgcagacccaccctcttccacccagaatttccttgccttctgtccctatcagtttctagacataaacaacagtaaatcattaatctgagaaggaaatcatttccttgtgaggctttttcgatgagtactaaagttgagaaatgatttaaagagtgaataaatcaaagtgaaataaactcatgtacagcaaagagaaacaaggatcaaaaggttgaatttagcaccaaataaacttccagtggaatgagaaagtaaatactataatcagttgactaaaagtaatcattaatatgtgagatatcacccttattataatgttcagatgttttaaaaaggcaaaggagacaatatgaataatagagaatttatgctgttattaaatgaacatatggttattttattgaaaattagaaaaaaatccagagttaaaagcctgagacctagtcagtaaatcaactccatttaaaatactcttaattggcaattgtatgtgacatgacatagtattttggtttcagttcaaacaatttgtattctgtcaatggtgttgaaattgggaaaggaaaaagatggttatatataatttaagtggtaaatttttaaaagaatggtggtcccttataccaaaatatattttccagtaatatcagctttacaactaggtataataggtgaatgtttttgcggtataatttaaaagcccccactaatcaaaaatatctccattgcctgaaattctactgatgaagatggaattctactgatgggtcaagatataatctgactctcatagtgatatcaggttggtagaacaggaggtgaaggcaatggttgcttgggcagatattttgacagggaagagaaaggacccaaagaggtgtgaaaggtgtagagagaaggggaagcaggctgaagggtatccaaggtaaataaaacttgccccacagtgtttcccaggctgatcaggaatgccaatatgcaaacaggcaattatattcttattttcaacctacctagtcatgattttacagagagaaaattagttcctttcagcctatttctactgtgaattttggtgttctttatttatctgccaaatctgtggtacctgacaatctcccaaccatatcattaggatgagaactttaaagcaaaaagatcaagcagcataaaagttgtgtcttctgtagcagtgctaagtcatcatctgtctgtgctttgttctcttgtctacttagactttcagaagcaaacactatttaagcaatgagagaatggggttgtgggaatgacactgggcatattttttattattattatgttaactcctttatttatgtagaaagcttagaatttgttttgctaagcttaatgtcttagaaaataagataaagaaagcctaagggccacagatagtatttgttggattgcatttgcataaataaaaatttgatgaaaataacacatattcaataggcatttaagataagtactcagatctgggaaaattcctaaaattcccctttttgaggaattctaaactaatttataaataatgtggcaaaatgaattttgtatattttattatgtttatataaatgattcaaaagcataaaatattactccaatagtaggagaaaatcaatgattcagtctctcctggtgcacaaagctttcagcctcctagaggccatttaatgtggtgcagctggccagtggcagccagggctcattgggttgcagttttatgtgctattgtaatataatgtgtttagtcatgccctctgcctgttttaggaggtcaaattttagattcccggcatatacaaaactagtctggcatttagaaaacctagaagtctaaaagacaacactgtgctcagtgaccaactctgcaaacaacagctgtggccacaaataaaataccatctatctgtaagtaaatagaatggaaagggcttttgggcacccacaggtctttttcaccatatcttcaagcacagctagcaatatttatcagtattatcatctccaaaggagatatacatctgtttatatatgtaaatgcatgtatttatatgcatgcgtatgttacaccatagcattaaggtgtttctatgagaatttttcacttctttacatatttaagcatcttcagcactatacggaggaacagctccacctggttcgtggccgaagtggagttcccatagccctgcccactaagtcttctccttctctcagcagtggcccccacaaggcacatctaaagagcccctaggctcctgaaaaccacagaaggaagtgattctcactatggagattaagaaagacttttgggagggtgggggtaatgggtagtttttaaactgggactgattcaaaatagttgtgtaccacacagaagataggcttctgaacaaccactgttttttccatcatcagaagagaagatttgtgtggtagccttcagacatgacctgccacctcccctttgcagctgatgaatatttgacaggctacaggaaataaggcatggccacaggctatgatggagtgaccatatgtaggtctatcactgacaaactgattgcattcgaccaagtgaggatccctagcttgaaattacagaaatattttaaacttctacataggaagtaagaaatttaaacatgaaaatgtttaggctatatgtgaaaattatctggacatttgtcataatatgctcggtgtatttttatctgtagactaaatatcaatggtggttaaattttgctttgataatcagatattattgcagacatatgtcttcatctatgaagactatttgttgaatatatgcagtaatgttagccactatttaaaagcacttacgaggtactagatatatttaagctctaatctcaatgctatcacctctattacctgaagagtagatgcctcgtagccagatgagcaatagaattgagatttgaatccaaaatgtgacctataagctaatattatagtttaaaactattgagtcaattattttaaaattaattacttaagttatatataacttaagtcatgtaagatcactagatctcaagtcatgtaagctcaataaacatttacttaatcaaaaattgggtcttttttcttattttgagacaaatcatataatgaaaaaaacccacatatttagaaaccaatatcaatcaatagtctatcaataatgttaactttgcttaaatattgaaggatttcatcagaagtttaaaataatgtcctggccaggcacagtggctcgtgcctataatcccagcactttgggaggtcaaggcaggcaaatcacttgaccagcctgggcaacatggcaaaaccccctctccactatatctatctatctatctatctatctatctatctatatatatatatattagctggccatggtggtgtgcacctgtagtcccagctactcaggatactgaggctgaggtgggaggatggcttgagcccagaaggtggaggtcacagtgaccctcgattatgccaccacactccagcctgggtaacagagccagacactgtctcaaaatataaaataataacaaaaatactgtcctaatgtagcactaaagaccaggtgtaatttaatatatggcattttcttatgatgaagatttaagtactaagtagctttgctagtgattaatgaaaatgtatcaacccccaacttatatcctaggaaatattatgaagtaaactactttattcaaaacccaaataacaacagaatacaaaaagcagtcaataaaagatcaaaaatacaaatgttagagctaagaaaggaccaataggaccgtaacacagaaactatagataaggtatacacaggggtataacaggtagataagttgtagaagtcctaagctaaagttatgtcaaaagagcgagagttctgtccctttttgcagagcgcggaaggtaggctaccttctctcttattgagtgaaattatccaaagttcagcttgagaaacattgggatcatgttaccttcatatgaatcatcaaagtgtaataattattataatttaatataataattactattattatcatcatttggggtaggaatatggcttagtatacacatgcaaacatcaacaaacattttacaaaacactgtttaccctttcttatgttttctattctactctcatctgttctattctactttttttaaaaaatgctgattaagactattaaattgatttataacccaccaatggattgctacccacaatgtgaaaaaatgctgttctgatgagccacacataggtaactgccaccacatttcagcaggacctgcttttactaggagctgaatagcagagagatgaggtatggtacatagttaaacttactggtgtttcggatgtaaacatgggtttatctaggcaacaggatgaggagtccttagcacctttaacttacagactaccactagaggaagtgttttaaaaattggtttttaaatttcctaacatcaaagaaatttcttgttgctaaacctaactgttttaatatgttattttgtagtatttccttatttatatttctcccgtattccactggtgtaagtgatttttacagcttctgggaccacatgttctaacttgtcctgggctgcggtttagaatgcaggtgttaattacctatttaacaaatcgtaactatttacttccagcagtaaatacaacttagtttctccaaattaaactggttttcctgctgactaaggttccaaacccctatgactttcctctccttttcaaatgacattagatttacttttgaaaggaatgtatgaaatggctctgtgagtgttcttagctctatctctcattaaagtctggaccttctcactgaataatataacctggccatattcatttcctcaggctaagaaaggtactctctcacagttctggaagctagaagtctaaaaccaaggtgtggacagggctgtgcttcttctgaatgtgctagaaaagaatccttccttgcctttttttagattttgctggttgctgacaatcctggcttgtagcaataccactccaatctctgcctctgttgttacatggctatctgccctctgtgggcctctctgtgtctctcatggccttcttataaggacactggtcattggatttagggcccatcctaattgaatatgacctcatcataactaatgacatctgcaaagaccccatttccaaataagatcacactctgagcttttggatgtacaagaattctggagagatgccatttgccttagtccattcctgctgctataacaaaataccttagactgtgtaatttataaacaatggaaattaatttctcagttctgaaggctggaaattctatgatgaatactccagaagattcagggtttggtaagggctcactttttgcttcaaagatggagcatcactgatgtgtcctcacatggtggaaaaggcaggaatgctctcttcagcctgtcttatgagggcacaaattccattcatgagtgtagaccctctctgtctcaatcacttcccaaaaggccccacctcttagtattatttcattgtggattaagtgtcaacacacaaactttggagggacataagcattcagaccattacactattcaacccagtatcctgatttcccaaagggatctgtaaaccaaaaaggatctgaaacaggtctcaatcaatttagaagcttattttgtcaaggttaaggacatgcccatggcacagcctcaggaggtcctgataatgggtcccaaggtggttgggctacagcttggttttatatgttttagggagacataagacttgaatcaaacaatatatgtaagatgtacattggttttgtctggaaaggcaggacaactcaggcagtgggggttggggggtggggggagcttccaggtcataggtggattcaaagatttcctgattgccaattggctgaaagagtttgtccaaaaacctggaatcaataaaagggactgtctgggttaagataaagggttgtggagaggaaggtttttattatgcagatgaagccttcaggtagaaggcttcagaaagaatagattgtgtttcttatcagacttaaaaagttacctgactctgttaattctctcctggataagggggtttggggggagacctagaaatggaaaggaattctctacacaatgcagattttacccacaaaagacggttttgtagggccatttcaaaatatgccaaagatatatgttttgggataaaatacttggatttattttagggcctgctatctgtcatgttggtatcttactgctacagagtctgctttgtcagtcttaaggtctttgctttaatgttatatgctggtcagctgtccctgaattccaaagggtggagcacataataaggcatgtccaacccccacttcccatcatgacctgaaatagcttttcaggttaaattagaatgcccttagtcaaggagtgggggtggtccattcaattggttggggggcttagaattttatttttggtttacagactatacatttgtctgtaccaaacttattgaaattagtcagcaacatgcacagaaatgggctaactggcaattacataagaaaggaggcactaatgtcaaataggacgtaataaggataaagttcttctacccctaacattatatagtagttaataattctgcccaaactctttagttcatttatcttaaaaatgtagttaattatcattaaaaattggcatttatactgaaatgtctaacttccaaaacatcttcacatgcattatatcatttcagcactacaccctacttctgtaaacgtaattgtcatgactagcaccagtctatggatgaagaaacaggctccgtgtcttgactcaggtcatgcagttaattcagtaatacagaaccaggatgagggtcaagtcatccgactcaaaatccagcattctttcaactaccaagttgaattgtgttatgtgaaaatgtttaaagcaatggctgtcaagcacaggctgggagaggaggtcagggtggaattagagaccacgtcagcatcatctccaaggtttttttctagctaattacacccacccatcccagaacctctacacagtgttgaaaagccccatagcccatgagaatccactcctgtccccagaactgagatccgctggtttaaactgtatgggagaacctccaattctgattttttttttaagtggcatgcatttatgtctgaggtcagtgcctctcaaatttaaatgcacatatgaatcatttgagaatcttgctaaaatgcagattctgattcagtgggcctggggtggggcctgagattctgcatttctaatctgttcccaggtgatgctaaagattgaagaaccacattttgaatgacaaggccttatgcagccctcataacagaacccaggagcagataatagaatgtgtctatgtgattgcagaaaatgtccgcatcagacagctataaaaaaaagggcctctctgcccaataaacacctcctcagtctctaataaatacagaagtgcttgggcccattcaaattatgagtccttggtggttgctgcccaaacagtctaaataagactcaatgaaaggcccttgtctgtgatgcttagcttcatgacaggaagaacacctgtcatgcttgcaacggaagattcagtgagacactactgttcatagggccctggaatgcatagcagcctcccataacagcagatataaagtggatcacgcaagctctctgcagtcacggctggatttggctcctatctgactttcccttggcagagccactccatttcagcatggccgtccatatattctattttctggcattgtgtaatgtggtcttaatgatgctgaccccaaaagtacttttcaaaagaggtttactgcagagattcattaaaaggaaaaatgattgcattatggcttttgttttttctttctttcaagctgctgggacatggtctttagatatggggataatggtgggaataaatccctgcaattctctgttaatggtgatagatgagatgatgaagccgactaggtgtccaaggaacaaagccagcttttaatggcactttaattctggaaatttagaaaacttccttgcagaaattggaagttggagtggcagaaaaataattcaacaaatgaatatgctttcaggggacagctagtataaataggtccttaaactggtcttctccctttgtgatttcagaatgtacacttaagataaaattttataaaagaagaaaggtctggtgaataatatagtatttatctcatcattttctcatgtaccaatgaactgttgtttaaaagagaaatgtttaaacatatggagagaaagctcaacgtcactgatcattaaagaaatgcaaatcaaaaccacaatgagataccaagctggcgaaattgtggagaaaagggaatgctttcacagttggtgggcatgtaaattagttcaaccattgtggaaggcagtgtggcgattcctcaaagatctagaggcagaaatactatttgatccagtaatcccattactgggtttatacgcaaagtaatataaatcattctattgtaaaaatacacgcacaagtatattcatggcagcactattcacagtagcaaagacatggaatcaacccaaatgcccatcaatggtgatagactggataaagaaaatgtggtacatatacaccatggaatactatgcagccataaaaaggaacgagatcatgtcctttgcagggacatgcatggagctgggagccattatcctcagcaaagtaacttaggaacaaaaaaacaaacaccacatgttcttacttatgagtaggagctgaacgatgagaacacatggacacattgtggggaacaacacaccctggggcctgtcagggctgggggttgggggagggagagcatcaggaagaatagctaagggatgctgggctcaatacctaggtgatgggttgatctgtgcagcaaaccacgtttacctatgtaacaaatctgcacatcctgcacatgtacccaacaacttaaaataaatgttgaaggaaaaagagaaagaaatgtttaagagaaatttcataacctaaagttcttattagaatactctttaacatgaggaaatattttttccagaacacataaactttatttatcttgttctcaacttataaaatctagttaaaatgtgttcacatgtattattttcattttatcatttcttttttttatatccaacttttattttaagttcagggatacatgtgtaggatatgcatgtttgttccataggtaaacgtgtgccatggtggtttgctgcacagatcatcccatgacttagatattaagcccagcacccattagcttttcttaacataaataaatattatttggaaagataaatgatgatttaagtcaaggatcactctctttctacatctgtaagataatagtggagatttgttggagctactcaatcttcctggtaaattttatcataaacttgggaagtcctagatccttctatctccatagcaagcagggtcgagattctacttcatatatatttgaataatgtatccccttctttccctttgctgctgccatggcattaaaaatgtattgtcttatcttcagctgcaccctgcgccccccatcagtcctatgcattacagtcagtaatctttgtgaaatgcaaatctgagcatagctttgccttgcctgaattcctcgaatggcttttactccttacggcagcatcctcaagctttggcaagcatcagaatcacctggagaacttgttaaaacacagattgctgggactttccttggagtttctgatccaggaggcatggagtggggccggagaattagcctttccagcaagttaccacataaagccagtgctgctggagtgatgtggttgttctggggacaacaccttgaggaaaactggtctatagaaggaagcgcgtcaaactcttcatcactacaccgagtacccttcagaatttatctatcatccaactctccagaagtgtctcacccccactcttttctttcttttttttttttcttttgagatggaatctttctgtgttgctcaggctggagtgcagtggtgcgatcttggctcactacaacctgcacctcccaggttcaagcaattctcctgcctcagcctcctgagtagttgggattacaggcacatgccacaatgcctggctaatttttgtatgtttagtagagacagggtttcactgtgttggtcaggctggtcttgaactcctgaccacagatgacccaccggacttggtctcccaaagtgcggggattacaggcatgagccactgcaccgacccccaactcttttctgtgcctctgcctgcattcaaccacactacactactcaattctctgaaatcaaggctctcgcaattggttgtgcaagttgtgcactgcacaaaacatagaggcatcattcacgttatagtctcttgatgggttctttctggaattgaccagtttacagcctatacccttatatgcagcagtcctgaaataatcacaaacccctatgtgtcatgcctctttatggatgcccccagccacacaaaagtacttggaattttctgagcaaaccatcatcttttgggcttcaaagcctttgcccaccattttcctcagtctgtaatgccctttatcccttttctgtgtagaaacctccatgaatcctttaaggcctccctctcaaaaaagatttatgattagcattatcctgagaccaaataaaacatttttccaacaggaaaaagaagagtgttatagaatctgaatagagccataaatactctggtgtaaaaattcaaaacattccaagtattcaaaatctgttttttctccctcaagttttcatgaattatcttttcaaagagctaaaaactgataaggagaaaagtgaggacttctttccactttctttctttttttttttttttttttgagacagagtcttcttctgtcacccaggctggagtatggtgacgcaatctcggctcactgcaatctccatctcctgggttcaagtgattctcatgcttcagtcacccaagtagctgcgactacaggcacacgtaaccacacctgactaatttatttttattttttggtagagacaagatttcaccatgttggccaggctggtctcgaactcctcacctcaagtgatccgtgcgccttggcctcccaaagtgctggggttacaggcatgagccacctccactttcctattttgttctagatctccacatatctaagatgttgtatgtatgtgtatgtggtagtttaacaaattatgtttgcaaatatacatttattaaatggaatatacagcattcttaagtttacatttttatgaccttttattactttcctgtggggctttactttcaattacatggaacacacacacagacacacacacacacacacacacacacacacacagttttataaaaaacatattttaagacatgagacaggtcaagttcacctggagaaacctcagtttaactctttaataaacattggcaaactagatagttcagtcctaaggaaaaaaagattcaattgtctaggtttgtcatgtaaaccattgcttaagtgaatgtgtttgaaagtgttaaaaatgagcattaaatagttctggaattgtatttaactgggagataaacagttttttttttattgtttcccaatgctggctaaaggcattttccaaacacatctccagcatttcttacacttatcacattctgcacttggcaggatgctttcatgtgcatgatccagtatgagccttaataaccctctgaggcagccgaggcaagcatgaggcacctcattttgcagatgagagaactgaagctcacagagggaccgggcttgtgcatgcagcaagcggaggtagaaccatgtgtttgaattgctgatcctgtgcttctttccaccacaaaacgtccattatcttcaaaggactaaaatcaacaagctggttcaattgaggcaagtctccggctgctttacttcctcccacaaacagaaatcaatacaaccaatgttggtccctactaatgcgagtgctgggagccctcttctgaactccctgtgatcctgcgtatgtctgtgtctaagtgaagaaataacgtaatcatccaggtgattcaagggagaaaaaaggttgtatccagaaagaatgtctattcccagtaactaaatgcctagaacatacgcagcgcaatatttttcagtcttctcttttgaatgttttactcattatgtaacaaaaatttactttggacgttcaactaaaatgacatcatcaactgtgacttgtcctgggtttggttgacagacatgactggaattagtaaaatgttttagtttagacagagaatcaccaaatgttagaggttaagtgaccttgcagatgacctaatccaaatttccgaagggtttaaccaacatcacgcagttaattgtttggaatcttcacttccctggccgtatacacacataattgttttttttatttctttttttattattatactttaagttctagggtacaggtgcacaaagtgcagctttgttacatatgtatacatatgccatgttggtgtgctgcacccattaactcgtcatttacattaggtatatctcctaatggtatccctcccccctccccccaccccacaacaggccccagtgtgtgatatcccccttcctgtgtccctgtgttctcattgttcaattcccacctatgagtgaaaacatgcaatgtttggttttttgtccttacaatagtttgctgagaatgatcgtttccagcttctttcatgtccctacaaaggacatgaactcatcattttttatggctgcatagtattccatggtgtatatgtgccacattttcttaatctagtctatcattgttggacatttgggttggttccaggtctttgctgttgtgaatagtgccacaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaaccagtttacagtcccaccaacagtgtaaaagtgttcctgtttctccacatcctctccagcacctgtttcctgactttttaatgatcgccattctaactggtgtgagatggtatttcattgtggttttgatttgcatttctctgatggccagtgatgatgagcattttttcatgtgtctgttggctgcataaatgtcttcttttgagaagtgtctgttcatatccttcacccatttgttgatggggttgtttgtttttttcttgtaaatttgtttgagttcattgtagattctggatattagccctttgtcagatgagtagattgcaaaaattttctctcattctgtaggttgcctgttcactctgacggtagtttcttttgctgtgcagaagctctttagtttaattagatcccatttgtcaattttggtttttgttgccattgcttttggtgttttagacatgaagtccttgcccatgcctatgtcctgaatggtattgcctaggttttcttctagggtttttatggttttaggtctaacatttaagtctttaatccatcttgaattaacttttgtataaggtgtaaggaagggatccagtttcagctttctactaatggctagccagttttcccagcaccatttgttaaatagggaatcctttccgcatttcttgtttttgtcaggtttgtcaaagatcagatagttgtagatgtgtggtattatttctgagggctctgttctgttccattgatctatatctctgttttggtaccagtaccatgctgttttggttactgtagtcttgtagtatagtttgaagtcaggtagcatgatgcctcaagctttgttcttttggcttaggattgacttggcaatgggggctcttttttggttccatatgaactttaaggtagttttttccaattctgtgaagaaagtcattggtagcttgatggggatggcattgagtctataaattaccttgggcagtatggccattttcacgatattgattcttcctatccatgagcatggaatgttcttccatttgtttgtgtcctcttttattttattgagcagtggtttgtagttctccttgaagacgtccttcacatcccttgtaagttggattcctaggtattttattttctttgaagcagttgtgaatgggagttcactcatgatttggctctctgtttgtctgttattggtgtataagaatgcttgtgatttttgcacataattctgtttgctagagctgaaatagttcactcctgccagctctggaggtcagttgttggaggtgaaagggattaaaaacctgaggcaggtggggcatggtgacttatgcctgtaatcccaccactttgagaggccaaggtgggtgaatcaacttgaggcccggcatttgagaccagcctggccaacgtggtgaaacgctgtcgctactaaaaatacaaaaattagctgggcatggtggtgcacacctgtattcccagctacttgggaggctgaggcacaagaatcgcttatgtctgggaggtggaggttgcagtgagccaagatcgtgccactgcactccagcctgggcaacggagccagacactgtctcaaaaacaaacaaacaaaaaaaactcctgagacagtgagattctaacctgtgaatggttgtggtaagtaaagcaatacctaagtgttcccggaccaaaccaagggtgaggctgcttattctcatggcccaataatgaaatgcagaggaactgggaaaggagagagtttatttctgtaaccaggtacagggagaaggcctggaaattatccccagagcaactcaaaattacaaagttttccagagcttatataccttctaagctatatgtctacgtgtaagtgtgcattcatctaaagacataagtgattaacttcttttaatctataacaaaggcctgagtcctgaagaccttcctctggagcctcagtaaatttacctaatctaaatgggtccaggtgctggggtggttacccttgtctcctgctaaatcactgaagtttggggagttccttcagacccccagaaaacttgtttgtgaagacctggggagtttcctaagaccccctataaaacttgtttaatcctaaacaggtcctgttaagaattccttcattatcttgtcagcttcaaggcccaggaaaggcctgggcaaaactcttggtgggcttttgttgcagtccaacctttatataagggcattggctttttcagcttttagtatataagttaaccactcagtcagtgctgaaacaatggttgtggaggcctgcgttagtgagacctggcttgccacataagtgccataagagcttgctataaagtaaatattcatgttttgaagtgcatcctcaagcttaaagcaaaatttcacatttattatatttattgtgttaaaaaaaactctacaataagacaataaacttgcatttggctcattgcaccacacatcaccttggtatttattgaatcatttatctaaagtgctgtctttctgggagaactccaagcttcacaagatgtttaaaataagtccttcctctaaattgagagcaaatgggttttgacaaattgaatttcaacatgagaaagataataatgcacttcagtacctatggttttctttaacgtgaatatggaatggcttaagggcttgaatgattagtttttcctttagtaactatttgtcttcaagaatgtgtcctaaatcctgttctgcatatgctaaatttccaagtgttaaagtggtcatatttgttaagctgtggtcaactagacaatagactacagcaagactctattgtgtttcatcatcatttcccaaaattagctgcagaagtaaagtgacctacagtctagctctaattgtggaatgaaggactgaaggcccccttggacctttcactttatcctttgccaaaaggtggaaggcaatagaatggattcatttgcatttctacttctctcctctctttgaagtgataaacacatgtcagtaaaatgcattcaaaattaacaaatgaacagattagatatagaaaatctagagtatggattgtcagtacaagaagaatggcagtaatcccaatacttaaaatgcccaaagatgtattagcaacagcgtgacctcccgaaaaaatatcttggttccttatgataagagcataggaacggatgggatctgaccattgatttttcaggaatattttcctggcagaatattgtacatgttaccctgccattggcttctgatggtagggattcaaggtgagcattcccaacttgcctttaaaaccatctgaatctattagccagggatttatctaaatcttctcaagggagtttctaactttagccttcacagcctcttagaggagttaaagaggacctttatttttctattgtgatacactgatccatatttttaaagaaaattctgaagtactctcaaaaagatagaaagtatttaacctagttctaagaaaaagtataaaacactaataataaaacactgcactttaagttaaaggtccataaatctttatttactctacaacacattctgaaatgcattatactgttgtttcactttatagcaatttaaggaggaaagatggaagctggaagaagaggaagaagaaaacaatgaaagatataaaggggccaggcacagtggctcccagcactttgggaggccgaagcaggtggatcacaagaccagcctgggcagcagggcgaaaccccgtatctactaaaaatacaaaaaaaattagctgagcatggtggtgcatacctgtagtcccagctactcaggtggctgaggtcaaggccagaggatcacttgagcctgggaggcagaggttgcagtgagctagtgagctgagattgcaccactgcactccagcctggatgacagaacaaaacctttcccccttcaccccccgcaaaaaaaaaaaaaaaaaaaagtaaaggagacataagaggagaaaggaggaagtgaaaggagaataacccagaagtggagaaatttagagagattaaaaagaagaaaatgcagggaggaagaagtaagaagtcctgatgtaaactaattttttaacaatctaatgtgtactgagttgtgtggtatcaaaatgtctaatcactgccctttgaaatgtttactagatgctcaatctctaaatgaagctgtcacttcagaatatttttctcagtgctacatatgataactgaaaccaatgacacctcccaccaaggtcactggcaaaggtcagatgaaaccaagccagacctaacctaggtaagagaggtttccttctccaccaagaattgagtatactaaatacacaatttaagcaaagaagcacttcctttgccttaccctcaaatctgcatccttctgcttgccccataaatctagaacactgggatttggttagaaaatccccacttgggctatctatgtcctatatggctttacagatattccacatacctgtccttggcctttgtccttccagactgcagttctgggtcatttcatttatttagtgatgtctgtgtaccatgtaatttttataacagctgcgaagtagctatgattgttgcctttattcaacagatctgtactttgagacagaaaggttaaataacttgcccaaggtcacccaataagtggtaaagccagggtcagagctcagactgcctgactctaaaacccagtcactagtcctctccttacttcattctaagctgttcctctttccttccgtgtctgacatcatgccacctggaatgtcagccctgcactgaaatcatcatggttgttcttcaaactcttctttatgaaaccttcctgcactctttgaagttagcatataatcttccttttccacatgatgctggccagaagtccacacatctgaggacaaaggccatactaacttggttctgatgtcagtgcttgccacatgaatattacctgttcttagaagaagcattgttgtactgagtgccatgttctctctccaggtgtcggtctgagtttatatttttaattgtagaatgaaattcctggcgatcaccaattctgtctagcttacatggcatgtaagacaattcctttaacaaaacacaaaccaggtggttaagagagaaaaatacagataactaagagaggagagataattactccccccaaaaactattccagccatatgtggccctcatccaaatgttggatgcccatacatgttcctaagaacaatgagtgcggaaggggggaatggaatttaaatatacattaggcttctaaatgaagtatttgtgttagttagggaattttaagttgtaaaattaccttcttataatcttcttggaagaacttggagcattccatattagttaaacaatcaccgacccatctgtctcctagctgcctaagcaactaagaggatttgctgacttggacttttctcttttccagatcctggccatcgtgtctatcctgttcattgtgctttccaccattgctttgtctctcaatacgctgccggagctgcaggaaacggacgaatttggacaactcaatgacaaccgccaattagcacacgtggaggctgtgtgtattgcatggtttaccatggagtaccttttgcgattcttatcctcaccaaataaatggaagttcttcaaaggcccactgaatgtcattgatttgctggccatcttgccgtactatgtcaccatttttctgacggagtccaacaagagcgtgctgcagttccaaaacgtgaggcgcgtggtccagatcttccgaatcatgcgcatcctcaggatcctgaaactcgccaggcattcgacaggcctgcagtctctgggtttcacccttaggcggagttacaatgaattgggcttgttgatattgtttctggccatggggataatgatattttccagcctggtattttttgctgagaaggatgaagatgctaccaagttcaccagtatccctgcatcattttggtgggccaccatcaccatgaccactgttggctatggtgacatttaccctaaaacattactagggaaaattgtgggaggtctgtgctgtattgctggggttctggttattgcccttcctatcccaattattgtgaacaatttttctgagttttacaaggagcagaaacgccaagagaaagcaattaaaaggagggaggctcttgagcgggccaaaaggaacggaagcatcgtttctatgaacttaaaagatgccttcgctcgaagtatggaactgatagatgtggctgttgagaaggccggagagtccgccaacacaaaggactccgccgacgataatcacctgtcgccaagccggtggaagtgggccaggaaggctctgtcggaaacaagctccaacaagtctttcgagaataagtaccaggaggttagccaaaaagactcccacgagcagctgaacaacacgtcttcctccagcccacagcatctgagtgcccagaaactggagatgctatacaatgaaatcaccaagacacagcctcattctcacccaaacccagactgccaagaaaagcctgagaggccatctgcatatgaagaagagattgaaatggaagaagtggtgtgtccacaggagcagctggccgtggcacagaccgaggtcattgtggacatgaagagcacctccagcatcgacagcttcaccagctgtgccaccgacttcacagagacagagagatcgccgctgccgccgccctccgcctctcacttgcagatgaagttcccaaccgacctcccagggacagaagagcaccaaagagctaggggccccccgtttctaactctatccagagagaaaggacctgctgccagggatggcacgctggagtatgccccagttgacataactgtgaacctcgatgccagtggctcccagtgtgggctacatagtcctttgcagtctgacaatgccaccgacagtcctaagagctctctaaaaggcagcaacccactaaagtccagatccctcaaagtgaactttaaggaaaatagaggcagtgcaccacagaccccgcccagcacagccaggccactgccagtcaccacagctgacttttcgctcactaccccgcagcacatcagtaccatcctcttagaagaaaccccctcccagggagacagacccttgctgggcactgaggtttcagcgccttgtcagggaccttccaaagggctgtcccccaggtttcccaagcagaaactgttccctttctcttcaagagagaggaggagcttcactgaaatagatactggtgacgacgaagacttcttagagctcccaggggcaagggaggagaagcaggtggactccagcccaaattgctttgcagataagcctagtgatgggagagaccctttaagagaagagggcagtgtgggctcttcctccccgcaggacacaggtcacaactgtaggcaagacatttaccatgctgtgagtgaagtcaaaaaggacagtagtcaagaagggtgcaagatggaaaatcacttgtttgccccagaaattcattccaacccaggagacacaggttattgtcccacacgtgaaaccagcatgtgactagttacaaaagcaataaattgaaacaaaacaaaacaaaacaaaacttgtttcttaaaaatgcggttaataatgcctgtgaactaaaaaaatgggaagccctccccaaaaaaagtgcataaaatgttatttttgcatggcatgaacagtttagcttaagtactgtttaaataatgagtcaagactgcattttgtaacaaaccaacaaaaatgactgaagaacagtgaacaaataaaaagagctctattaggaaccaatattctgcaatgtctgacatttttgatcctttcatttcaaattgtaggccgattttcaagtcttaacgtttattttacaatgaagcttagaattttcacatgaaaggatgaaatgtcattgcatgcattcataattatgaagaataaggtactgtgagcttgcaaaatgcataactttgtaaataatggggcctggatgcaaaagtgtcatgaacacatggaaacaaatttctgagacacaggtatttccttcacagctactgcctggaggagctgtacagacttcctgttgcaaaattgcaacctctccttaaaccatctcgcatatcttgctttgagttataaagctcttaaaagtacatttgtttaaaggaatacagtattttttatttatttgtgatataattcataggctgcattttacttttttgcttctgcttagttgtggcatttgtggttcatttataaatcatagacataggcaagatttaatgaccagatatcaaaatatttgaaattttgccaataagttatatgtcatgccacagccgattacagaaatgcattttttaaaaacctgaaattatttaaaaggttgtatcatacaattaaatgtttttaaggcagtctacatttggaaattagttctgttaaaaaatttggccacctaaagatgactgtattttccacttgtatccaacataacataacctttcctaactaaagttctaaaaatagaatacagatatgccaaaatggaaattccaaaaagtgacttgacaaactaaaagcagagtcatttaagtgagattgccgctgccactcatagagttggctgggagatgagttactatgaaaagagcccaggcgtggtaatgggtcaccctatatttctcaacatgggatgcgaggtggggggacactgcaatgtgtgggaggaagttgttctttttgcaggatatgaattacagaacccagagcacagatggcagtcacaccctcctgtaattacagcaactagaaacacccccttgcatttccaaccttttcagggggtggttgggactctgtttgttcaaaatgactttcagcatttttgactaggagcggtgaaatccagagcagtgaagacactgaccagagattgccctgttggtgaagtctgtgctagaacccaggtcatcttaattcactttgcttcacaggaatcaaggctctggtccaaatttgcaaccaccagatgtgggattctaggcaagcctgtacaacctttcttgatctcagttttgctccagtaaaaatcaagacaaaattatttccaaggtcccataagactttaatatgattccttggtctcccaggaaggtccagattttgcctcagcctgatgcactttgtacacgtctgtgtgtgtgtgtgtgtttgtgtgtgtgtgtgtgtgtgtgtgtaaaattcagggaaacaggaagatgctgggccaaatttaaagcacaattcatgtttaaattaaaaaattctgaattttattttatttttaaaaggaaaaaatagcccaaatatttagactgttatttaagtctttaaagaaaaacatttctttattaacagaatctggtcattatatctcagataagaaaacaggttttgattttagttgaaacacaagcagacctactgctaaaaataattttaaacatttcttttttcactgtgcttagaatttcttactggttttcatgtttgtttcaaaacataaccttaaagagtttatggtcactaatcgttgatatttacattactcatacttatttcagtgtctaaagctaaatattgatcagttttgtaaatagagtgtttgaattttctgtctatagtttttcaaggtcaaacaggtatatctgctgttagatgcatagcaaataatttatgaaaatcattttatttacatagcctcataaagcaattattttcgaacatctcttattgatgaatctcaactctttttattcatctttctgtataagtggacttgtcttaatgcgctaagagttgactgatgcccacctttcctatgtctgttaggccttctgctgacaacactgctccagaatgtttaatattagaaagcttgcctagtcgaagaatcctagacattcctccctagaagcatcctccccaaaatcttttttcccttcattctaaggtacatttttaagttttagagaattttctagtacaacgcatggaagcttatccttccattttccttagttcctctgagccaaaagtcttcagctaggaaaaaaagaaaatgctcctctaagaaacatctttgactttggtgtttcacaaggaggcagtgtggggactgaaggctcccaggatgcacttgtgtagcacttcctaagccttttccatgaactgcacctaacgcagagaataaacatgtgtgcctggaatggtctgggaatgtcccaagcacagagttcttttggagtcttatgttttacacaaaaaattcatgtaaatgctgcattttacttcataattttatatattccatatgtttaaatattttaaaaataatgttttatattatttaccaactagtaaaatggatacttgtgtaactttaaatacgtcttttgtatcccctggaaaaatagatccccagtttgagatgcactgcatgaatggcaggaacagagattggttccctgagggccactggaggtttctgctgctgagagcactcaccccgtgttacaagtgaggattatttgaatgactacaaaataactcagttccatgtatggctaatttgattcttctgactctcttaacaaccagcacaaattgccacaatattgtttgaggtcaaagattgagtccaatcctatgaggatagaaatgggtgcatcaatgtgtgtcctgagtcagaccacacatacaaggatgatatgctaagtgggtccccggaattgacttgattcatctctaaacatttttactagaaatttctctaccatgacacaaccagctgctttgaagcaagcatttgatcaagtgttatcctgatataactagatttggtaacaaggagaatatgtgccaagtgtctgttcccattaatttcttctcaaaacagtctcactctcctgtagacactggcctaggaaagtcaacaattcaactattttctcttgaaatttgaataccaaaaaaaagccatatgtatatagagtacttatagtttcttatctcacaacagccttttgaatattcagtaaaggactggaggggttatacattttgctcaatttcacacatgtccctggtgaatagaacttggcctcatccatgccgtccggcttcaagtctggcattccagtatactacaggaaagtatgtttagttaggcttggtttttttttttctaataatatcaaaaatatgtaaataaaactggaggtgtatttatagtcacacagcttgtttaaagcagaagtagatggtgccaaatggtaaaaacataaaagaactggcattgaccatcttttgcatatatgtttcccaatttggaattctgaccataagatatacattccttggttaaagaaaagaattcattgttcatgatatcacatgacgtactcattaagcagagggctgcaggaagacacttaatctgaaacaaaagcaaatagaactttagaaatacttctaagttcaaaaatattgtctagttgaatttgataatcatttcactgttcatttgttcaaatactagttgagcatccctgtatggtgctagggtacaaccctggcttcatggagcttactgcctggcccacttaaaaccaagctgaggatttggttactgaaaaatgtcttttctgaggatggaaaaaccattcaattatcaagccagggaagcacacaacagaaacaaatgaagtgattttccaaagaactgttttcctaaaaagtagatggatggaataaagtctaatctaaaattatttttgaatcacagtttagatttcatgtttgaaataacaaattgttaatctgattgagtgaggttatgggttgtctttccttatatgataaaatgaaaaataattttttattagatatattgcttgtcaaaatagctaattatagtctgtaacaagtcactagagcaaaatttaatactagtggaaaagtctgctaaaaagtttatgttttaatagtgtgtttgatggttatattattaaaagcaaagcattttaatgctttttcttcctattaactatcggcaacattttagggatatatcattaatcattgcttagtcctctcaatttctaaatgaaagatttttaaaattcagtatttaaaaactacttagtttgactcaaggtatttattctctaagtccatatggattttgtgactgcactgccctcccccaaaacagcacaacaacaaaaaaagaaaaaaagaaagaaagcaaaagaaagccacaaaatctaaattaaaattgaaaagtttaaaagcccatccctactaagaggaaaggtcccaactccaaaattttggtgaacacctcatattactcagtttagcatttattgtgacatagtgacataaatgctctcctttagtggtttcaatgaccatttcttctacttgcctttttaaaacagcctaacttaattttataaatccttatttaccataatctcttccttgttaagtttaaaagaattttaacctgtaaatacacatataaataaagggaagtgagggactgtctttaatagtaaggtcatccaaggccagccaaagatacaagtacaaaataaaagaagaaagactaagaaaaatgtaagtaaattaaatatgtttttaagcagaaaaatttatattaggtataggcatgcacctgcataaagtttagactaaatacttactatttataggaaatttagaattcaggccataattccaattctactttctctcctgaagaaattatttcttatcatctgacagatatttccagattgttgttgataaagtgttttattcaacaaatatatgttgagggtcacctatgtgcccaaaattaacttaggtacagttcattccctcaagtttgcagtctagcagaggtttcatatttaagaggttatagtaccaagtaaaatccaattccagtggattgcagtaagctaataatagtatgacagtagatttgagtttgttgttggaaaatgtctgtaactcccttttattttctttcagacccaagttatttttttccattctctaatctagaatctgaatttccaccacatagggtttctaaacactcatgcttaaaattgcagtagctgtctgaaatctagtgacaaagtatttgaatgaagacatttcccactttagcagaataggattctagccaaaaatgactttgaaaatgatcgtttttatactcccgtaactgttctgtttgatttttttaaatcctaggctgtatgctgagctagatgccaccccaagctgctgattttatgaaagccgaacgcccatctgagcaatgtttatcttccctccgcggtgggcaatgctggccaacagtatggctacatagtttttcttttaactatttttgctccatttcaacctaaaacacacttaggatggtataccaaacacttaaaatagactttcaaaatcaaaactcagggaaactgacacggaatagtgaggacagagcagcgtggaaagatacaggttcagagaggatgtcaggggcgctccgccgtccggcttgttactccctgtgtcgagtgccctctactggtcagtctgagagaaggtggaagtgtacaggccaagaaaggatgccttcaccaggacttgaaaaccaccttcagttttccaccttcagttccccctgcatttagccaaaaccacaattccattgctttttcagtgattacatctcaggttttttttttctttttccaaaatatttgataaaactcttgctaccctttgcacagcactttcagagtattcctacctccaaaatcaaaacaaaatcacaagtgtagctgaatgtttagcggtgccctagtctacacttgggatacacagtaaatgctattttcacctttctgccattagtgggaagcaagataagaactcaaaatggtgggtttaaaaaaaaatcatggatctgtaatgacaaggctatttgggttgactcactccaaaacccacagtttccattcgacttgaagattacaagtagagcctgaaatacccctgaattgactcttgggaaaaaaagaatggtttctaaactccccttagacatctgtgtgtgctggccagatattctactacagccagatttctggcccacctttaaagcaagatgtttctaacatttttatttgggtatgggttaggctgttttcaacctgtaaattatactcacatcataatgtttcatgacaagaagatttttgtaaggaaaacacgcagaaagaaacatattggtattacccaaattacttatccaacaaaatgctatcactagaattaattaataaaaatgtacatattctatgaaaatctcactaaagaactagcaaaaattttcctattaatatttagctcaaaaccaaagagaagagaaaaagaaaaacacggaacttacaaaacacttacaaaaactagtgtgtgacactatcttgtcacacaatagccaagttccaaactcatgcaattttaaagaggtatgatattaaaccataaaaaaattcagtgaatgcataaagaaggtttattaagcaaatatgaggtacagttaacacactgaagcatttttaataacctttaacttaactacatagcggctatgtttgcttttagcaccttgatttcaatctgaagtctttctgtttgatattgttacttgtgtgtttgcttacttgatttgttttgtttggagaagtgagggtaggtgggagaaagttgttgaaaaggaatattattgggcaacttattaacattacctagtgtacctggagtacaatagaaaccatttgtagacatgcctcggccatcacactcccctccccctttttgtcaagttttaccatcctggtttggaaacagattcttgtgatcaaatttcagatcctgctaattaagacttttatcaacttaaagtataataaaaaaaatacaaaaaaaaaatcattcctctcctgtctgcagtactccccacaatccttccctagaatctccctgagcagagtatatcaggtaccaggtcaaagggaagaccaaatgagccattagtaatcacaacttgaagcccaaagccaagagcaacaggaggatgtcccagcagtcagaaaacgtagcaaggcctgaggacaaaggaattgtctctatacagtataataacatgatttgaccaacaaaacaatgacatagtgttttcccccattatggacaaaaaaaaaaaaaaagtatgttttaagcctctattaagttattttacttcaaaggtaaatagctggctggtgagaaaggtggtccctaattcactagtttatcacaaggatttaggcatcatcctaaatgcaaactctccatctaatttgtgtgtgtaacaggttgttcgtgtgcctgttttcagggcagaatacagagacgaaaataccaatattaccctttttatcattttcttttttttttttgagatggagtcttactctgttgcccaggctggagtgcagtggcacaatctcagctcactacaacccccgcctcctgggttcaagcgattctcctgcctcagcctcccgagtagctgggactacaggcacgtgccaccatacccagctaattttttgtatctttagtaaagacagggtttcaccgtgttagccaagatggtctctatctcctgaccttgtgatctgcccacctcgtcatccgaactttttatcattttcaatggtaataaacagttcaatcagggaaaactgatattgctctggtagtttttatatggttctgggccaaaacggtaatgacagtttaagcaaaactttagcaaaagattctaggcgtagagagaaagccatattgaaaatttgtactttgctatacatccaattacaaataatttgcatttggattctttttttctaatattctttcatgtaaaaatctttttaggtgatcatttgaaattaatactttttattttcttataaatataggtttttttaaaaaattgcataagcaagatgatacagagtaaagcacctagcacaatgcctgacaaataggaggtatagattttcttttttaaaagtattccaaaaaaaattattcaatccacattagtatgctaatgacttagtcttctaaaattcttctatggctttctaaacagtcaaaattttacgtgtgtatgtgagtataactcactgttacgtaaaatggaaggcattttacttgctaaattatacatattatacatatgtataatatatatattatacatatgtataatatatataattaacatatgtataattatatatattatacatatgatattctattatataaattatgcatatacaccccatgtggctttaaaaatacattgacattatttggacaaaccacattctattaaaactaggtagtgcatttcttttacctaattgccttaactttttaatgtttaatagacaaatacaaatttctccttaaggaagaaattctttgtccacttctcctacaattattttttaattttttttatagagataggatcttgctatgttgcccaggctggtctcgaactcctggcctcaagcaatcctcctgcctcagcctaccaaagtgctgggattacaggtgtgagccaccacacccagcccttaaaattattaagacttcacatatactatctatttgaggagtcttttacagcctccttgttaccacacatttgagtatgcttagtcattatgtgaatattcaacaaactggtccatctttctgatttaaatatttgtacacctaaggatgtatttcataaagtaattcataaccagtttggttctagatttactgtaattggctatctgccagaataaactataaaatgagaataaaagcttttggtgtcaaaattttttttcattaaattttgttttgattatccagtctaaattgtcatctgtatagatttcatcagatacttttttttactttttaaatgtcaatcttattgatcaagaaaggtaaaaaagagggaggctcattttctattctgatttgtttaaaatgccagatcacataaatttagatagggcccttattttctacgagagcagtggagctgggtgatgaccaaggactacatataatgcagcaagcacgctgtacagtccttacactatctaaatgcacctactcaaccaaagcagataggcactgtggaacgagaagggtgcagccaacactaatgctaaagacaggctaacttggaaattcttgcattgaaactgcaaaggaatttccaaatacactaaaaattctcttttagagtatctgctagccatcatcagtaaaaggaaaataataccttgattttaatgaggttttattgtttggttggttttcgggtggttatttggggtattttatttgtttggttggtttgttgaggggtttttttgcttatttattttatgaaaactttagtataacacactacttagtttggacttgaaatcaacttattatgatgcttaaaaaaatccatgttctaaatcataattgcatgacagtttagatcttattactatttagttgtagcctaacaaatactgtattcctctgttttctcaaaaaaaaaagttcctagtttatgaaatagtattcagataaagccttatgctgc

SEQ ID NO: 1269 - DNA, 402756 bp, Homo sapiens
tccagaaaggcgggacaacttcagaggtggggagtggcttttaggtcatgggtggattcaaagattttctggttggcaattggttgagagttaagttgttatccaaagacttggaatcgatagaaatgagtgtctgggttaagataaggggttatagagaccaaggttcttattatgtagatgaagtctcattggcggctgccccaaacgcaatagatgacaaacgtttcttattcagaccatgaaaaggtacttctcagccaatctcttctggaccagaaaaagacctggaagggaagaggattctctacagaatgtaaattttccccacaaaagagagttttgcaggatcatttcaaaagatgtcaaagaaatatattttagggtaaaatacttcggtttatttcagggcctgctatctgtcatgtgatgctagagtcaggttggaatttggtatcttattgttgcgaagagtctcttctgtctgtcttagggtctctgttttgatgtttaatgggtcagttgtgtgcctgaactctaaacggagaagggtatatataataaggcatgtccaacagctcccccgactgcttgtcatggtccgaactagtttttcaggtttagttggatccccttggctgagaagtttcattcagtgagttggtggggcttagaattttatttttggtttacactttcaacatacattttcagagccactactgaaaggcacatgccaccctaggcactggggatagcgtggaagaacacagcccaagtccctgctgtttggagcgttcaggctagtgggggagcagatactaggcagacaaatatataacagagaggtagggagtggcacatactctgaggaaagataaaccggggagtgcctttctaatgcatgtcggagagacctctctggatgtgatgtttgagcaaagacctcaataaagtgtgaatcagcttggctggggatagaatgttccaggctgaggaagagcaatgcagaggctctacatctggagcatgcttggcctgtgtgacgagcaacaagaaggccagaagggctggaagggagtgagggagggggagagatgtgaggatggagaggcaactgagacctggtcacccagggctttgtgggtcccagtaagaatgtcggattttgttggaatgacaatggaaggtcactggaggtcttggggtaggagaaggacatgatggttggtggggcaataaaagagatcaggctctactcccagccccgctgtccaaccctcagcctctcagccatggaggtgaggtcttcatcagctccagggctgtgatgtcagttagctcagactctgggacccagaagacagggctgggaatgggaggctccatcagcagcttctccctgatcccttcccctggggcctggttctgccttcttccatgtccgcctgttaatccaggaccagagaacttttgtctgattttcacggtctctacaagctatccacagccagaactgtgttgggacttgaggagggtggagaccattcactattctgagatgaacttgcctggcatggtgcttggcacttagtaggtacacagacacaagttcccttcctccacagctacatgaaatgattgcccttgtcagtcaggagaccaagaaagatgtcttttagggaaggaggtggggaacatcattctctccggctgctgaataggcttgatgactctgtctctatgtagtcagaagccatagttgtgtgattctaaatgtcacttattcattcctccagttaactttcttactcctcttctgccctgggctttgtgccaggcactggggtaccagaggaaaaggtcatagtccctgtccttagaattacttgtaggacttattaaaatacagattccaaggcccatgcccagcagctagttctctgagcaggcccaggactcagcattttaccaggttcccaagtgattgtgatgcttgctgaaatttgagagtcagtcctcctagtgtctgggcatgggccctgaaacccacattttttgtaactcctgtaagaaattatgatttaaataaaccatattagtttcctgtggttgctgtcacaaattaccccaaactgggtagcttaaagcaacagaaatttttttctcattgtcctgaagggtgaaagtccaaaatcaggtggtggtccctcctgaggctctcaggggaattctgcttctggtggttccaggcattttttgacttgtggtttcatcactttcatttctgcctctatgttcacattgccacctcctcctttgtcttccttatcttctgtttcttgaaaggacacttgtcattggatttagggactagccagataatccaggatgatcttattattgcaagacgcttaattatatttgcaaagactcctttttcaaataagtcaccatgttcacaagttccaggctgtgaacatgtctttctgggggccaccattcaatccactacaaggacgctggaccatactttgagaaaaacttgcatgtgacttctaggaaatgggctgatcagagaaacactaaggaggtagaagtaacaggagctggcaatgggcaagctgggtggaagaggataagggaggagctgcgaatgactcccactgttctgacctgggtgctctgggacattgatgatgcagttcctggagacagagggtgtggaagaagccagctgggccatttggaaagagcagagccctgagcacctggaacacaggtcaggtatattttgatgggaaagagacagaaaagtagcatcgagaatcaatttgcatctcagaattgggatccctgccctaatctctctactttatgcggccgtgtcctgcttttcatgactctagaaagcagaggagaaagtggatgtaagatataaattagtctgtcttgtagggctttctcttggtcccattctgggaccagccagtgtccatacctgtggcctttggtatccaatttaaggcagttcttctctttccatgatcacacagtaaaggagcccccgtatacagtgctccaggactgagtccagtttttagtgtagcgtgcaacaagagcagaaaaggcagagttgggaaggacatgtcaacgggcagcaatgaggtggtataaagaccctgggcatttggaggcaacagagggagaaaggtctgcttcaaggaccaacttggtctcttcctatctctgccctggcagcaccagcagctgcacattggcccttcttaccacttccatggcaaaaccaaggtttctctacctcgcctagccggcccctgcagacttgctgacacagctgagtgcggagtgcatctagaccccaacatgaggcgcccttctctcaaaacaaatgagccttcgaaactccagcaaacagtgctaatgaattgccctcggcttcttaggcatcattttctcgtaattataatgggaagaagacatggagtcccactgagaacgtggagctagcctgcccctagagcaaggcaaaatccctctctgaggaccacactcaagcagaactgatttttctaagacttagagaagaaacaaaatctgatttaattcttaggaaattgctttttttaacccacctgtgtaagcctgtatttaaatgctaatatatttggcctgccgggatgccacatttattttcttccttagcagcaacaaaaatcatttatttatgagaattctagctcctacctgctctcctgagttcctcatcttcatttccatctaccagctggatgtttgtcttcccaagacatacaaaatctgtaaccgtctcccttcccagaccagattctctttatacctttcctgtttctgtttccagaactactgatggcttttgcctccctctgcttcccccgtgctttcctccaatcagtcattaatcacactgctcaaccttcctcccaccggggcaaataacataacttgcctaagcctccatttcctcatctataaaatgggtttaataaatactaatacctacttcatgagcttgttacaagactaggatgagctaatccaaataaaacactcagaacagcatctggcaacagagtaacacatcacagtgatatttctataatgattatgacaatgatcccgacccccacggaacctgtccctttcctctttgtagttgttctatgagctgaccagcaaactctgggagggccctatcctgctcattagaaaacacagaccggacactcttcatttcatcactattttcactgcctgaaattctctaccttatgaatttgtttgtttgtggtctgagtaccccctcccctgttcagcctgtaaaatgcaacttccatgaggcaagggattttgtcttatttaccagcatatccctaacggctgacacacagtaggtgtcggatagatatttgctgaatgaacacgtgaggagaaaaaggctctaggatttttggaaggaagacatctagacggcgctggtttttaagcccttcaacactcaggtttcagggctcccttctctgctctgctcatttctgctttgcgggcagccctgtgacaggctctgtcactacgcggggagagaggtgcaggctggaagaagagcgtttttttctagttcacttctgcctgcatctccacggcaatagttcttgaccctagcatcaatatgttccagctgcagcagctggttccagtttgtagtgtttttctttctttaactcccagaatgaagctcatcacacaacctcagagacatcagcaccagccagcaggcactgcctctgcctcactgggtccctttgctgaagttctaggtccaggggattccagtcttgatttcctttatcctctactcacccccacccaactctaggagtggtagctgcttcctgcatttcctatctctatggttcctcagtgttccttttagcctcctgcagtcctccaatgctagcttaacaagtctttatgtgaagtcctctctgttaaactggctgctgtggtctttttctcccggctggacagtgactgatcccttgtctagtcattccctgcctcccctcccacgccacagctctggccttagagggaattatttccaggacaaacatcttcaatctctctccacgatgcatccagggatggagagtgtatgatttaatagacagctgctaatttcttccaatatcgaggcaaaatatacctctctaacactgtgagtcactttcattttgagccctggtgagatatcaaataagtttttgtaaattttagagtcaaatgtcaaatgatctcggattcaaattcagcttcagctgtgtgaccatcaagaagttactttccctctccgggcctgtttcctcacctatagaatatataatatcgtaatagctacctcatagggctataataaatatttaaggtgtgtatgcacttagaacagtcacctgcacggggaagaaacttggtgaatgatgctgtcattatcatcattgaggaggacagcctttcaacttttgaaggacagcatgtttgtcctctcttagccttgcactcgaagtcggagcactttcccaggcccagacaccagctggagcccccatctgcttgtcctacttccgcctggaactggggtgtgaagattcccataaacgcttcaggtggagagaaaactctgacttcccaagttcctttggataacgcacatctgtgacccagaggctgactaacacatgcctgctgatggtctcatttctagggtctcaggtgctatgtaaatcctcttccctgttctttatttgcaggatagcacattccttgagcagagcacgattctctcctgtactctcctgtcatgaagtgcatactggcacaccttgccttcctttgatgggaatgttcttggcacactgagtcccttgcccatgtattggggggatattgctgtgtggtgttttggatattgctgaccctctctgggcctgacttatttgtccaaggctgagagttcaaacacatgatgccttgcagagatcagaggagaatccaaaatgcttactgctaggagagagaaaaatcaaagagctggctccataatttcgaacaattataaagtctcacctgcacagcctctatttattttcaccttcctttttctgtgcttgcttggtttccacctctgtgagttcttttccacttaccacagcttcagtgatctcaatcttctcttcctcttctggaattctctacccctcccttgataaaaacagtgttttataatggtttcatgtgagagcaacgatcccatctcacacttcctttggagccctccacagcatttgcctggcactgggcacacaacagctgttcaggactccagaccgatagagaatgtttcttgtctagtcacatagatggtaggtggtagttttggggatggggcaggaatggcatcagcatcaacagtaggagaggtaggagcagcagcaataacctttgccgttgacgtaataacctctgccatgtactatgccagccactatattaagcacattaatttcatttaaaccttccccagaccctatgagataaggattattattcccattttacagaagaaaaaactgaggctcagtgaggataacctgtttgttcaacagctgctgagttgaactcaaccctaggattgagctcaaggctgtctttggcctttgtgcttgttatcctctcagccttaactattcttccccccctcagagagctgtatggctggtttgagtctctgttcaaatgtcatcttaatagaaaccttccccagtggccctatctgaaatcggaactcctgttactctctatccatttgatcagttttctttttctttaaagcactatctcttgtatagaggcccatttgttgactatttctgtccctggaccacatgaatataatgtcaataagcccagggactttgtctgttctatctaccactgtatcctcagcacctggaacagagtccatgataatcgtatactttcaatatgcatgtgtaggatgaacaagtgagtcagtaaatacctagtgcgaagatctgtgctcttatccattatacatctggcttggaggagttatgggatgttcataggatttgtcaggtcaaacaacatatgcttttgtttctttcccaaaatatggtcaaatgttgggattccagattcctgagctggggcccaaatgcagatccaccctggacatttcttatcatccctgaacagaggctgctaactgtcttgtgggagccattcctccagcaggattcctggccagatttccaggctgaagactgagctctggatcaccttatatcactatggtcacagccttttttcctttggcttctcagtttttagtcttaccctctctggtgggatggaagagaggagaaactgggcatagttgagagtcctatgtcctgcaaagtgaactcacctattcagaggacagtattattgttggtaaaatgatcagatgggtcccacaccctcccttccaaactttctgtctctgatccttctccatggtgcctaggttgtctgctctttgcccactccttgcctgccaggtcgtgctccatgaccgtcttaacacctacctgcctcatgcctcaattccactaagattctgcaaagtgaaagaagttagttagataaactgattctcaacaaggactgagtgtctcgtggtgaatctcctcctctgtaagtccatgagggctctgactttgtcgtcttatttgtctggctcagccctttctgcatcctgggtgctcagctctttcctacacactgggagctcagtaaatattggataagtgaatgagtgaaccaaagactaagtgccattaacactctcagacaccgtgtgcctttttttttttttgagacagagtctcactctgttgcccaggctggagcgcagtggtgcaatcttggctcactgcaagctccgcctcccaggttcacaccattctcctgcctcagcctcccaagtatctgggactacaggtgtgcaccaccacacccggctaatttttttgtatttttagtagagatggggtttcaccatgttagccaggatggtcttgatctcctgaccttgtgatccacccacctcagcctcccaaagtgctgggattacaggtgtgagccaccgtgcccggccaccatgtgccttttaactgggaccttcaactcttaagacagagagtgcataacacggcaattttaagccctaagacatctagcacaatggggtatttcctgctagagctacttctgttatatatgctctgactcctaccatgctggcaaggcttgagggcttcggggttttgaggaggctctgagtttgcagactgtctcccaggcctcttttcagagctgaaatttgttgatgagcactctgaaggctgaagtttctttcttcaagattcacttccacattgactcccagaacacggggtaaaaatcagacctgatacatgagttctggcttatctggcatttgtcaactcagtctccattctctgtctcttaagcaacggattcctcttgaacatcccagagaagcagatcaaagggagacagtcgaggcagaagaagagactttccaaggcatagccttattcagatgaaggtgtttcatatctgctattcacaagtagccacactgcattcacagatgtacccatggccagggcccacaaggactttctgaggaaagcaaagcagggttgttttgggggaggttcacacctggtgaagagggtggaatgagatgtccctgccaccagggtcccttccaactcacggagcctatggtactgaatggcagccaggttttttatggagcaatagctggacttcacatttgcataatgccttgcagtttcactgttaagagtactgcattgtattctaattatatgaatctcggtcattcctttatgacatttctgaggaatactatctcaatcaagaaaagccctaattgcactcctctcctatcccggtgagagagcacagactcgtgcctgctccgcaggggtggaggctggaattcagtagtctgagtcggggatgcctggagcaggaggtggtcaggggcattgtcctttccaagtcaggaaggcagacagcacctgctgttggtgccaaggttactggacaggctgcgagggctctgtctgtctgtccgatgttcacaggccagctccccggaggctcagcactcagcccagcttctccgagatgcaaaccaggccactctgaggctgcctacaaactttctgctgagtgccgacagctgcttcctgctctgcggggagttcttccagatcctgatcaaggcacagagaattgatctatcagattaaccaggaaggaaagagtgggagagcgagtgtgggaggctgtggggctgagtgttttctgcgtagcagtcccctcccttctgacttgagtattaattgctacattaccgctgccatgtaagaaagacagtcagcaaagcctgggagagctccagctcctccctccctgctctgctcaacttcactctcctcctcggttcccttggagtaccttgtgccccggcagtgctgtcccggccctggcatcctgaggtcctcccgtggtgaggacttaagtggacagcaggagtgggtggagagagggagggagagtttgccctgcaggctctctggatgcagaagccagactcgctgcagaggcagctgtgctgttcccggagcctggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaaggtatggaaactggccttgacccttgctttctgtcttgatatggcctggctggtcgcattgcctcggtgtggtgagcgtgaccattctggtgcacccaggtcttggaaaaagctggggaaattggtggctgggattcgaggttgctgacaacctgcgtcctggctttgagtaggcgggcacccagccagggaactcagctggctgtaattgcctggaactttggaaatggagttggtggtgtgtggctgatacgttatgggcgggcagagggatagaaccctttccagagcattggaagtggcttagcgtgactggagtttcaagaagttatccatggaaggttgtattttgttgataaaagagagatttgatgcagtgggttgtgagtaattctgcagaacagagacgcttgagggggccagtgggaggtggtgatgggccggcatctgctttgccctggtggcttcagaaaccggatcagctctgcacctcaagtgccaagagcctcctctcatagggttccagcgtctcgtgcttctggggcttcattcatcgttctgctttcttggatccctgtccctccacatttcatgcctatgtccatgcctgtcttttctgcttctccaggaactggggtggcaggtggtttgcaggagtaactgtctgggcagatcagaaagtgtggctatggaccagaattagggctgcagccccagatgggcccacagccgggaggcagaaagaaggctaactcctcagggcccagtcctgtgtcttaaaccccattttacacttggcaccagggaaggtgaggccctcagaggggtctggccaactttgtggagatgatgtcaagggagagcagcagcatgatgtggttccactggctgaaaaaacgtctttaaatattcatgctgtctttcaggaagagtctttgggggctggggagagaggcactggaagcagcaggcagaatattcagggaaggagcccacaaaactttgatgggattttacaaaatgacaatgagagcagagaaaggctatatgcagccagatctcatgacatggctcaggtgcccgccacccagcgggtctggcccagtgtacgttgtgtggcatgtgtgggtggtgggaatgatgggattctgtttatctccttccttgggatgttctgaccttcctgttatttccctaccatccttctgaagtggggcactgctcttccaagatacccaggtgggctgagcccccaatgtggagggccaggctgcctggcagaattcctggaggccagaagtggggtaaacaggaggttaatgggtatagctgtgattgctctcagtggctttacctcctggagaaggagaaagcaaaggggttaggaaatttcacaaagtctccccattcaatcctcagagacagctggaaggttttctttcctcattacagatagcaggacctaagagggtaatgggtgtggggcagcaacccattgcagcctctcatggagggcttgtccccacctgcagtctagtggcgacccagaccccacacacagatgctccctggatgccacactgagtgctgagatgggggaatcatgggggtcaacaggcatagagaagagatgtctggggcagactaaggagtgcctccaaacagtgacatctaagctgagatgaggagaggcagggctgagaaggtgggaggaagccgaagctgccagagggagcaacatcagagtgttggcctctgcaaggaaccagctggagagtcagaatgcctccctctctctgctcagaatcccagaaactaagatccatgtgacacagaagggactccgtggggacctggccttcctgtgaactgcttcagtacagcctttcctgtggccagggctcagagaggcagcccatggcaggcaccagggcaggattgtgtcttaaccgcatctgtcttctttgcttcagctccgcagagaggaccaagtgtttacacagccccggctctgcgccaggcacgtgctaggtgactggtgttctacccgatccaggtgtttgctaaatatttgttaaatagtgaggaacatgggagcagggccaggctgggagcagggtagctgagaaaggcctgcagagagtccagaaaacggctttctaatgtttacacctcccctaggtggatttagattcaaccctacatggatacattatgattgcttaatgatttctgattttaatttgatttcacttattcattattcattgcactgagttctagatttgcagtaatccaaccctcaggagagggatttttctttgtcccttgcagaactgaggaatgtaaagaatgtgttggaccaggtacctgcttgttctatggcaatttactgtttcttaccagccttgcaaatacctgggggacaaggagggtccaggatcaccctccctgtcctgcctgttcctaacccttggccacctcctgccatgccagaaatccttcttgccatttgtctaagatgccagctagcccagatttctcatcagcgcttattgcagagataaactgctcatgtccacctgctcacatatctcatcaaccttgaactttccttcctatccctgatcataatttgtggtctgcattccctttaggaacatgtttgctaaaggctctcttccccactagacttcagctccatcatggcaagaccatgtgcatttttttgctcaccactgtggccagagctactagcatggggcccagaatggagtatgtgtgttaccgtgttaaacgaatgcaacggcaccgcacggcacagacaccagccgtcagcctgagatgacccctggtacaggagctttctaggaagcactatgcaacacctgtcccacaggtgctcagcaaatgctctctgaagtctgtttagctgcagcaagctgagtctgcagcctccagcctccagcctgcgtgagcctccagccacgtaaaacattcaggctgggtctgagcttgcatagtgtctagggaagggcattaagattgttcccagaaggaaaggctgggtgggcaggcttctggcatccccactcccacccctctggctctatttttatttgttttatttactggatttctcccacatttaaagaatctctttggcattaaaaaaaaaaaaaatttcaaaccacgaatgcagtgaggagcacagttggtttctagactgagacatccccggaccctgcactgtggctcggaagcctcggactgggtccctcacctccctggcatttagtttcctcatctataaaatggaattacaatacccttcttatggggttgaatgagattgtgcagataaagctccctgcctattaggtgctcagtagtgttgatggatatgacttctgttattagcggatactctcatggttgagagcccctccgggctgggactccctctcactcattacttgttttctcagcaccaggcacagattctaagagcaacatctcatgatcactttatgaaagcctatggccttgtcagttactgcatgactttatttatttatttattttgaggcagggtctcattctgttccccaggctgagtgcagtgatgcaatcacggctcactgcagcctcgactttctgggctcaagcaatcctcccacctcagcctcctaaatagctgagaccacacatgtgcaccaccacaaccagctaattttgactgtttatagagacagggtctcactatgttgcccaggttgatgtcaaactcctggctcaagagaccctcctgccttgggctcccaaagtgctgggattacaggcatgagccaccacgtccagccactggatgactttagaccactgcttcccctctgctcaacttgttttcttaagggcctacccagagccatctccctcacctgattccttattaggagttaaaagcctgactcccagagccaggtcctcgcctgctgtttaacctaggagaagcccagctcctggctcggatgcttggtgaaatcaggggtctggggaacctgcgtcttcctctttctgcacagtcagctcccctccacccgcctcacagacttcctgggggccgctggcaggaaccagaagttgtgcaggctccattctggctggggaggtttaaactcatctccttctgcactgggaacaaatgttaccccaggcacagatgacagagccaaagtgagcagaagggaggaatccaatccaggagagcttctagtgtcctccaggccacccatgaggctgcgggggtggggaaaaggggtgtgggaagatgagatctatctcaaggacaaggccctggagccgtaactctcccctcccgcccaggcccaggctgttcctcttttttcgaggcaaaacctcagctgccccatcagtgacacactgttcctcttgcctcctcccactgctgttcaagatcctcaagagactgaccttggacccgggcatggactctgccttcaagcaggccaggctggagtaccaactctgcctcttaccagctgtgtgaagttgtgtcatttgaacaccaccccaagccaaggctccccacttttaattggagataataataatatcaatggcacaaggctgttttttaatgtaatgatgatatgagtaagagatatcagctcacaggcaaatcccaactctgctcttgcagggcacccgcccccgcttacattttgtgccctaggcaccttccttgcctctttctagtcttgatcctggaggtagggattgcaatcaccatttcagcaggtaaggaaactggggtttagctaagtgtcgtggctcccctggtgagtggcagagctgggattagaacccaggtcttgctgcagccaagacaaggtacattcctctgcactcctagggctggagaagtcacgcctgcctgcactactccccaccttgccaccagcagagagtcccccagcgtcccactaattctgttggtgggtttttccctgctgggtctgatcagagcagccacctgtcatgcaaagggttgtgacaaattccataaagtgtcatcacctgggttatggggaaagggaacactccagaggccaagatcagcaggacagccatacccatgctctctcagtatccctatcacctctcaggcaggtgtgcaggcccaaagcacctgccagacactgagtaggctctgtcccatgagggccactcccccatggctctcccttcttacaggccaagtgtgagaagtgttcttgggtgtgggaaaatacacacaaagttttggacactaggcaggctggaattgaggtgttgcagctgtttactggaattgtctgggaaagcagaagccttcacactggggactttgagacctgtgagatatcatcatccctctaccaagaggagaatgccacctgtcccatgaaaagctaagcttcaatgctgccccttgctggggaaagagagtccccaccatccgagtcctggctcgctcactgtcctggcagtgaggggctgagcaagcactctggtcatgttacaacagccccactcactctctgcaaccctggaacctctgagtgccagtgctttgtcacaggaagaaagtttgattatccagggcttctgggtccctgcctacctctccagccccaagctagagcctgccaggaggggcatgtgttcaccttggccctcctgatgtccagtagccttcatcccagcctactggcctcaccacccttgcccctctgcagcaggcccagcattccctgacccatttgggttgttcaggtgctcagctcactagggtctccatagtcccacagtagaaggcagagaagaaggagggatcacctgcccctctggagcctccgggtctttctcctagataaccctgttaccatgcaggagtaatttgttcagggccatttatcctggcactgctgcacagacatcctattaacttcaggaccacaggggagcggctagtttgctccaaattaaaagtagctggaaacggggccctctggcaggcaggagagttcaggctgccacaccacagccctgggagaagtggatctagtcaggtcttcatcagccttctaagtccagggcctcctttgccatgccacagggaccctcatcttccccagtcttcttagggttacagaatctcccctgggccatctctctcagcagacccaggtcccaaatccctgaaagcctttgcttcccaagggtggaagtggcgatgtgaagtcactgtggaaggaagcaggatgcagggcgggaaaactctggacccagagggacctgggctccaaccctgccatgcaccaacaggacagccttgggcaagccattccccatcttgagtctgtgtccttccgtaaatgggccagtaatttccatctcatgtggctactggagatggaatgagatgggacatgtgacaggcacaggacctggctcatacaagctgctcagtaaaagtcaagttccccacccttcttttctatgatacgaccttggatttgtagccaagagaaacaaggctgagcctctgtgggtcaagtcctcttcccagctcctatccagatgtgctgctatttcaaaattatcccccctgcccccagtcactcttgatgacaagttctataattaaaaatgtgccaacaatggaaatgatcctttttatttagttgttcatgggagaattggtcatccattctcatgagaatgggagccctgtgaaagcgttcaccacgttcaccacgtgggaatcacctagagtgagtgcctcaagcacctgcagccgaggaaggaaggttgaataaataacgactaaatgctttccctgccgagcaacatcaggccatgtggctggagttccctttttgaggtctggtcttagtcaggcttgctctggagcctaccactccctatctcccttgtctgaattcctgtgctggagtttgacagcagtgaccagccagaacgacctggatgagacaagggtcagtgcaaacaagaccaaaggcctgttcctgcccccattccgctctcatgctctgctgggggactgcccctgggtgcaggcccacactgcctatgcatcacagctggccaggtgctcaggtgaggcggcggttcttccccgttgtccacctgcaccccacccagaagtgcaggaggagggaccccactgaaaggcaggcagcaggggagaggagctttgggggagaggatgtggaaatgaggaaattgcataggcctcccgggccagctggaggaaagaaaggccaggactcctgaaaaagactcatgggaagtcatttactatcaccactgaccacgctctctgtcacaggtcttcagtctaggggcagaagaaagccttccttctctgttaggatgaggggaggaggaccatgaacacaaagctaaccttggtcccctctggctgaagccactgagattccattttgtgttcttagaagaacacccgctttggagccagacctgggtttgagtccaaatcctcacaactgcttgctgtcttaggccatcaggctgcttatcaacctgatggcctaagctaccatacaaagacacggtggcttatcaacaacagaaatgtatttctcacagttctggaagctggaagtctgagatcaggatgctagcactgtggacttctcgtggggactcttcctggcttacagacagcatctcctgctgtattctgacgtggaggaaagagagtaagctagctctctggcctcttcttatagacacaccccattcaagaggctccgccttcatgacctcatcacctcccaaaggccccaccttcaaataccatcacctcaggagtgggatttcaacatgtgaatttgggggacgggaggcacaaatattcagcccattgcactaagtaaatggcttttttttctgggcttcagtctcttcatctctaaaatgaaggagctgctgatttcaaaggcctctttcagctttggaatttaaagattaaacaaaattgcagcactgctggtggcacctgccatgtgcccagcattgcctgagcactccatgcccaatattttatttagtgcacatgagaaacctaggaggtggagtgctctaattaaccccacttacagatataaagagcgagcttcagacgggggaccggcctgcttggagtcacacagccagcatgaagcatagccacaactggaagcctaggcggtctggccccaagccctgggttttacttccctccccagcccatccccagtacactctttccatttctgaaaatcagatccagggtaagaagcaacgaagacaaaacagattccttcccagtttggccaagaggcaacacacactcttgttttcgaaatcaagacttcaggacctccattctgactgaggaagtgcaattgaggagaatgccctctgagactcaagctccccgatccatcccctaaaccgttacccataggtcacctttcacagtcaaacaacaaaacatatggggagcaggcccgacagccaagactacagggaggggagaaaaaaggaaacaccacccagcaagatttcctgttgtatttctagtctggccaattttcatttattgctggaatgaggtcagttggaagctgaggcagagaattgggcaggaatcaggtagggaggtgtgattctggggcttgtatctgagaagctggggttagcctaattttctttctgtaatcttttgattaactgtgggccagtttggatgacatttttcaaaccatctgtgcttggcaggctgggccgagcccaggcttactgctcggtgtctgcaaaactcagcttggagccggctatcacccggagcctgggatgtctctaagccatgaagcatattggattgcagaatgatccacaacatccctgtgctgattaactctgcccaggcctcacaagttcagaaacagtggctgtcatttcaaacgcaacaggaaacatgaggggaagggccatcgccatcctctgttgagtgctacctattttctgggggctttacaaggattcctatattcagtccagccctgtctctgtgagttgtttttattccaaaccaggggctttgagaggctgaataacttgccaacatcacagatacagcactgtggttgaaaaggtcatgtgcaaacactaatgttcctttgaacacgcctggtcaaacctgtcagcaccgtcacttctgtcacagactgaattgtgtccccttaaatgtgtatgtcaaagccctaacccccaaggtggctgtatttgatgatagggccttgatgcaggagattaaggttaaatgaggtcataaggttgggatcctaatccaacatgactggtgtccttgtaagaaggggaagagaccaggagtacacacacacagaggaaaagccatgtgagggcaagatggccaactacaagccaggaaaagaaacttcatcagacaccaaccctgcccgaaccttaatcttggactttcagtgtccagaactgtgggacaatagattttcgttatttaactacccagtctgcgacattcgattatggcagcccaagcagactaatacagccccatagaccattctttgcatagcatcctttcctatatttttaactgtgacaaacatatataacattaaatttactattttaaccatttttaagtgcacagttgtggctttaagtacattcacatgttgtgcaaccatcaccaccaaccatctccagaacatttttcttctcgcaaaactgaaactctgcactgcacccactaaacccttccccatttctgtctaccctcaggctctggcagccaccactgtactttctgtctctattaacttgactgttctaggttcctcatataagtgagtcatgaacagtatttgtgtctggcttatttcacttagtgtaatatcttttttttttttttttttgagatagggtctcactctgtcatccaagctggagtgcagtgctgtcatcacagcgcactgcagcttctacctcctgggctcaagcaatcctcccacctcagcctccagagtagctgagactacaggcgtgcgccaccaccacacccaactaattttttaaaattttttatagagatgaggtttctccatgttgcccaacctggtctcaaactcctaggctcaagtgattggcccaccttggcctcccaaagtgctgggattccaggctgccatacctggccctcacttagtgttatgtctttaaggttcattcctgtaacagcctgtgtcagaattcccttcctttttaagtttgaacaatattccattgtctggatactacattttgctttttatccattgatggaccattcccatatttttaaaataaaaaatgaatcatatacgattataatccccttactggaaactgtctccagtggtttcttgacacatttagaattaaatgcagactcctctcagtggcctgtgactttgcatgatccgtcctctgcatttctgtccttctccttggactctttccaccaaatacccccaggctctctccctcaattcattcaaatcccctcctgcggttgccgtccctcctcatctcccccaacacattgcctaatgctgccttgcttttctgcacagcccttactgctcctgcaataatattacacatgtgtttgcttggtgattttaaatgttttaatggaaaatgtctatgtttaaggtatacagtgtgatgtcttgatacacacatagataatggcctgattatcacagtcaagctaatgaacatatccgtctcttttcatagttacctttctgtgtatggtgagaactactctcttagcaaatttcaagtatacagtgcagtcttatgaactacagtctccttgctgtgcattactctagagcttgttcattctccatagctgaaactctatacgctttggccaacatctccgttattcatttgtttatgatccagctcatccactaagagtcgagctctgtgagggcagggaattttgcctggccttgactacttccccagcacctggtgcagggcctaccacatggtaggccctcattgggagttgagaggttgagctggcagatgaggaacctgaggcctggggaaggccacccagcaagccagacgcagagctggccttgaatctgggcttcctcctctttccattccctacaggctcggcactgcatgccctttaaaggttccagttctgtatccaccatttccacgtccgtctgtccatccacacttcctccttagcaaggccgcccatgttcctgcatccaggacatgaggggttaattaagatagtcatctggcttctcaggctaccatcctaagaacagccctcctcagttctggagctggcgggccatttggttcatctttgatttgttcttgccatggagagaggggaacctgccgctgggaaaggatggcgatggtttccagtgtgctctgctccattcagccaaggggctcctctgggagggcatgaagtgagcagtcaccagcgaaggcatctgggggctgcagacgcagctggcttccatggctgtgttcccctccagcccttgaggatccaggactttctggaaacatgattttggagttcactggatgctgaatccattaccaccaaattgtgtgaccttgggaagtccaagggagtcactccttcgagcctagcctccttttctgtaaaatgtgtgcaataatgccaataccacaggtttattaaagtaacgcacttaaaagtgtttagtgtagggcttgtgtcaaattaaggattcaacaaatgatgggtggttttgcttttatttggctttgctgtttatcagggctgagcttaaatctccctcattgcatcctaggcaaaccagggacctcccatgtcttgggaaacggctgagtgactgaaatcacccacgtgggccagaaaagagtgagagatgttttcaacatactctttgcctttcctttccctacccgggatgcgagtatcagtgacaaagagttttattctagggagatgagacaggagagctcacactgtattcattgagcaagctcttcatgtccagaacctttaaaatctcctgtacactcctgccccactcccagcccacactctcctacggatgaaaaaataagaaggggcagtaaaaccttgtctttgtatagagtccaccgggggctcaacagaggaggtggaggaggcctcagacctggatgtcgtggcagtcactgcaccctgggtcagagccccctgaggacaccaccctggaagggagaagctggctggaaccacaaagccccatggacaagcaagctctggcactacctttgagcatctgctgtgcctgctggcctgtctcacagggcacatgaggtaaaaagacatcaggcacaggctcccccatgttcattatatctggaaatttcagtctggccaagggagcttctgagagcctgaaggtggccagtatgtgactggaagtcaaggccacatggcacagtgaccagcgtgagactcctccaaatgtcctcagtgtaagggtggggaaactgaggccagagcaaggaacacccttgagtaagctaccctcaaaacggagcctcctctggctggtagctgggggcacagggatggagggtagcctggcccctcctggaagtggtggccacccagcagatggctcttcattgccacacagccgatgactcatagactaagcccaagcaagacccctcgcctcctcccttcatctctgcactctccccttcatggcctcacctctgggggagactcccaagtctctctctcttgccttggctcttttcttaagctccaggcctgcaggtgactccttggctggactgtgaacttgttggaagggcaggggctacattttagttatttaagaacgtgcagtctggcacggtggctcacgcctgtaatcccaacactttgggaggctgaggcaggtggatcccttgaggtcaggagctcgagaccattctgaccacagcgaaaccctgtctctactaaaaatacaaaattagctgggcatggtggcacatgcctgtaatcccagctacttgggaggctgaggcaggagaatcgcttgaaccagaatgtggaggttgcagtgagccacaatcacaccactgcactccggcctgggcaacaagagcaaaactccgtctcaaaaaaaaagaagaaagaaggaaagaaggaaagaaaaagaaagaaagaaagaaagaaagaaagaaagaaagaaagaaagaaagaaagaaagaaagaaagaaagaaaggaaagaaagaaagaaaggaaagaaaggaaagaaagaaagaaagaaagaatgtgcagcacccagcacaagacctggcatagagtaggggcctaacaaatggatggattgatggaggatgggaggaaggaccactagacccttccagttgaatgtctttctatagcccctactcaatccttgtaaaaccaaaggagacctctctctcctgattttactctttctctttacatgtcccagtctcgagccttgttctttccatctgtcactccctttccactctcagaaccgttcctgaaatctgaacctttctaacctctcacccgctttgctgcagcagcctgcagactgcgtttcttcccatttcttccctttctgactcctccacaccattccaaagagatggcccatctaacccattgacccagaagccctacttctagaaatctattctaagcaaatcatcacagctgtgcatacggacttttatttagaggtattcattatggtattattgcattatttataacagtgaaaaactggaggcaatctaagtgtcaatggaaaaaattgtgtattaaataaattttggttcatctgtctgatggaacaatattaaactgttgaaaaattattttaggaactaattaataacctagagaaatgctattgatatcgtatcaagtaggaagccaggagaaaaaaaactgtatgatgaatgcagttccagtctgtgggaatagatgtgtatggaaaagtaaaatagagaagaaatacactgaaacattagtttaggttttagcttggattaaaggtgagtttttaaagtttttgtttgtttgtttgtttgtttgtttgttttattgagacagagtctcactctgtcaccaggctggagtgcagtggcgcaatctcagctcactgcaacctctgcttcctgggttcaagtgattcttgtgcctcagcctcccaagaagctgggactacaggtgccggccaccacagccagctaatttttgtatttttagtagagacagggtttcacaatgttttccaggatggtctccatctcctgaccttgtgatccgcccgcctcagcctcccaaagtgctggcattactgttgtgagccaccgtgcccggcctaaagttcttcttgatgcttctctgcattttctgaattgtcttcaataagcatccatatttaatcagaaaccacaaacatatcattcactaaatacacatcttcaatcatacagttctcagtatgggaacgcatgaaagttctgctttcactggcatatcactggctgttcatgccatgtggcaatacaccccgaactaccagatttggcactcccagccctaaccccacagtctcagacctcagcccactccctagtcctgtgtccccgtgaccaaacccacacacgcattctcctccagccaaactggtccccacatgtttccaaaccagccttctgttctgtgctcctcagcctaactctcaaatggttcagaaacacaaattcgcatgtgcacagagagagacagagacagagagaaaatccaaatatgataaaatactgatcatcattggtgaacctagatgaaggggaggcatgcttacaatttgcattgtagttggatattttcaaaataaaaagctggggaaataaaggagcagtgtagtatagtatttaagggcataaattctgcatgaaattaccttatttcaagttccagtcccactgcctattagttgggaagtagtaacattaggcaaggtacttactttctaagactcagattcttcatcagtaaaatggggataatgaaaatcctggtgtatttgtttcctacagttgcccagagaatggaatgtatgtgtgtaaagggcttggcgaagagtgccacacacccttgatcatgaactgttagtatcagtgctaaatatagaaatcaatttattaaccgtgactctattcatgatattctctacctccataagctgctcatccctggacaactaagtaaagtgctacagctttggaaacttttcttgcacggttctttttctgccactagccctggaagctgctccaatgcggtgcctgccccgctggtatccatacctccaggccctggcacagagcctggcaagggggaagaagccattaaatgcactgaaccccaaatgagaatctcaaagggttcaagctgtactttaaagaaaactcttctcatcaggaccaagtttgcacttttgctgatgcagccactctattcccatgggcttccttgagataaggcatcaccttgataaattagctgtagatataggcgtcttgcagttggcatgggaaagcaatttaatttccaattaagcctgatttctgggccaggaggttggcctacctcgcactggaaggattattctggccaggcctattattatcacgggtcatgattctcccatgaagtggactctcaaggaagctggtccttcaaccattggaatggttcagtgaggcagaaatacggcctctgtgggtaggaccctttttccccaggaattaagtttatacaagtagagtcagggaagttcaaagcaaagataggcagtctgtttgtggccaaaattgttaagtcagggtacccctagaaatgaagcaagaggggagagagagagggaggtgaggcagtcatcaatcaggcccacaagcaagagaggcgggaagttgctagtaagaaaaagacggcaggaggtagttctctgagcccaaatcgaaaagaatctgaattatcggttgaaggagacacacttacttgaagagagaacagacatttgtgaagcatcttttatgcaccgtgctgagtacttcacattcatgattgatgatacaatgcaccctgtaaaacaaacactgtgaggctcactttccaattgaggaaactgagattcaggaagattaaataaactgcccaaagtcatgaacaaggcagattcaaactcttgttttcctgagcttttctccctgcaggctccctctcaaagacaaatacaaaaacatcatttagggccataaggataatgccatactcagctgtatcttacccaccaaaattgtaagcatgagaaaaaggcctttcaaacaagtcctgagagagtgaaaataaatggtggctgaggctgcttggggcgaatgatctgatggaagagctaacaatatctacttctcttttgggtgttgtttttgctcccatctgtccctcaaggagggagacctgagacctgggcgcaatggcccagcatggctgagaggctcctgtgaggtcaggatctcctcccacagctcagactgcttcaaaccagcggggttctggcttgtggctgaggggatttcaattcagaagggttggaaagaaacaacagaggggaatgagggatcatgaccagtggagccacagaaaatttagttaggtgccaagaaggtatgacatggcctaagtttagttaacgatagtaaaagaggactctgaggcaatatgtaagcaagcatgctgtcaactcctggacaaattctagagcgcatgattaaacccatggtttgggaacacttgtgaaagaaagtagagatgaatgagaggcgggtgcatttgctgagaaggagctgtgccggtgtaccagtctcccttctgttctgcttttgcatagtgaccagttcaaggatcgctgcaaccatggtgtgcctgggttccagttgggcgtgtgatgagctatgggctggaaagcatagatttaggcaggtgccagctggcctcgtggtcctgtctgtcttggcagtgcccacagcagaacctttgtgggacattttcagatccttctgcttggccatcacccccacatctattgagacttcagaggtgtggccccagggagtcaattgagagcctgggctctgtgatggaaaggtatctggaagcatctaacaagctctcaatagttgaccttgacctgcttggcattttccacttttgatatggggtaaagacaagaacaggattcccagtggttagagtgttttctggagcaataccacctagatttgaattccagctctgctatttgctaacttctgccttggggcaagttaaatcttttccttgtgcctccattggctcattggtgaaatggagatactaataataacctcaaaggatgttgttactgttcaatgagctgtgcctggaaagatcctggcattcaggtaggtgttcaacaaatgctagcccttattaccgttaggaatgatagattcttgcacagcaagtgatcagctaaatatatgcccaaatgaaagtggctccatcttgctatagtgagttattcatccaaagaggtgttgctgcaggttgtcattgaagagaactattgtagaaagagtgtgactgtgttctccccgacaatacttctgacaccacgtaagagggttttcttcccccctactgataccaactagtttggacaccaactgggtgtcctacaatttaattcaattctgacactaactacccagagttagctcagaccccacaggttaagaactcagtcccacaagactgcccccattcaaatgccagccaccaatagggtgtcctgactatccacacttccacctgactgacagaacattcctacaacctcccctacacctccagataggatataataatttactagagtgatccacagaactcaaaagaacattttacttactattgacacttactattacatgttgattacagaggatataactcagaaacaggcagacggaagagacacacagggcaaggtatgagggatgcagggtggaggtgcagagtttccgggccctctcccagcaccttgacgtgttcaccaacccagaagccccccaaaccctattatttagggggttttatgaagatttcactacataggcatgattgttaaaccactggccattggtgattaaactcaacctccagcccctcttccctctgcagaggttgccgggtagagctgaaggttctaactctctaatcatggcttggtccttctggcaagcagctcccatgccgaagctatttacaggcccaccaagagttatctcactggaaaaaagacactcctatcgcccctaaaggacctctgtaccaaagaccaaatatctttctgtgagacaacagagagttcaagcaccaaatataaagtggagaagcactagatgatctctaaagtcttactggcacttggagaacaagtgtttgtatttgaacatgcggaatcaaaggggagttgagtaaaaggggctccagaattgacacaggaggaggactcagtgcagcaatctcatggggcgtggggacagaagacacatcccaaagcttcatgtgcctctcaagcccctgcttttgttttatgtgtactggggataggggaggttggtatggaatgatggagattatgggagaacagagtccatctaagccacttttgactctgcaactgggggagatgcagctggcctgggaaggaatcacaaacgtggtccagtactcagtttagagttgttggctttgcttccatatacctccctttctcatctcccaaatcctttgaggaagttggctggtgaaaatgtacttatgtaagtggggagggagagttgtgcaaagctaggaagaagctgagttctgcatcagaggtgacatgagaaagaaccaggaaagcactgtggagaggaggatgacccatcaactgactcatctgggggacaggatctgggagccagaggtgatggagaaaactaaagccctcctcctggcccccagtgggaatctgatggagcctggtggagagcctcacatttctacagggcacggtgtgggaggggcctggaggccttgtctctggatgcactaggctggcagttctgaagcttttcatcatcaggacccttttacatgcttaaaaaatattaaggatcctaagagctttggtgtatatgggttatatctattaacagttaccattttagagattagaactaagaatggtaaaaatatttaatttgaatttacttattttaaaataataatacatccattagttgctaacaaaaataacatatttttttgaaaaacaattatgcgtggcaaaaagtatattgggagaagtggtattgttttacatttttcacaaatctctaatgtccagctttagaaaggcacctagaatctcattgctacctcggcattcagactgttttaacaatgcatgttacatgacctctggaacattccattgcactctcataagagaatgaaaatgaaaaaggcaaataatgtcttagtattattatgaacagagttttgactttgcaagcctccactttgagaactgctacactggactgtagtgaatttctccatgtctctctgatctttctttggtcattttctttcccttccatgtgacagggcaatggctggtgaggtacaggaaggtggcactttgctcaaacagtgtcttcttaaatatttcatagaattcaaactcccccaaacacaagaccaattcaaagaatactggatattctcacataacagcctgtgctgccaatgaacaataaaataaatgcagtttgcaatgccctgacccaaggagtttaagataaattttggatgagttgttgatttagaggaggagctggtatcacttcagtaagtcacagaaaataagattatattaatatttatattgcattattttaaatctgcataatgctgagtcttcactgtgaagaaggaagcccctcacaatgattagtgaggggtagggagggagaatggcaagaagacaccaagttccttgcaggcaagcaaatagatacatcataaaagtgaagtgaaattccagtcctctgagatcttcataaatagaagaaaccctcatttctttcctcctctggttgcagcttggactgatgagctgaagctctgtctgagacctggcactgttaggatgtcccccagggttctttccaccccagttctggagctcaggtggccccttgcctctgaattccaccgctttgtctgagttctggaggacggcacatgggagaaccatccaggtgcacctctccaggtatgagtcactagtccatgagaggacaataataaatgatggaagcactagacactcattagcagagtggtttattaagaactgatgaaggttctctgctcccaggcagatattattgcaaaaaaacacgtaggcacagggtctaactccatcatgcctaaattcccattatttcatgcttatcccgtgcataaagttctgtgagcagcagacagttgtggcatttgctagaaggccagtctttattgacaggaggagaacatctatctcaagcaaatgaaggtcatcattaataatttatgggacagtgggggttaggcatcctcacatactaatttttctagaggaacatggccttttcccctgcagggattgtttgggtattctgagtttctgtgtattttagtcccaaattcaggtgcatggaaaccattgacaaaatagaccctttaaatcagactccaagttgggacttcctttcttatttttcttccttttttaacttaaatttttgagataattgtagattcacatgaagctttacgaaataatacagagacattccgtgccccctctacctaatgtccccaatggtaatatttaatattttgcaaaactatagtacaatattacaattaagactttcttaaaagactcacatgaggacctttgagacttccctgaccccagaaggaaaaaattccagggaatgatgagctgcctgcctttggaaggaaggtccaccaggtaagaaactggaggccacagggatacctctgggctccctggctggaattggcagatgctggtgcagatgccagggcctcccctcagaactccaacctgcatgagggcacctgggttccagggatgcaacgcagctccctgcctggcccctgtggctttgagtggctgtgtccctcagcccttcacagctggctctgcccctcagcccttcacagctggctctgcccctcagcccttcacagctggctctgtccctcagcccttcacagctggctctgctgagttctgtggttgagatgccaggtactggaacacacagctccaggcttgagtcctagcccctcactttacagatggccttggccagttacctcttacagcctcagtttttcatagtaacttagatagcacttaccatatgtcactatcctaggaaatttacataaaaatttgtttcatgccaaaactctatggaaagatactattatcagtttcgttttgcaaacgaggaaacaggcacagaaaggttattcgtccaaagtcacccagcttgtgaacagcacagctggaatttgaacccaaacagtgcacatcccaagtccacatacttagccactgtcctctgttgcttctcatcatctgtgaggcaggttcaggagtatctcatttttttttccaaggcaaactaattagtacagtgcctggcacagaataaataagcacccatacatgccagataacattgtcagtataacttctggaagtttctgagtattcatgacttattcttttttttttttttttttttttttttttgagacagagtcttgctctgttacccaggctggagtgccgtggcgcgatctcggctcactgcaagctccgcctcccgggttcacgccattcttctgcctcagcctcctgagcagctgggactacaggcggctaccaccacgcccggctatgattttttctattttttagtagagacagggtttcaccgtgttagccaggatggtctcgatctcctgacctcgtgatctgcccacctcggcctcccaaagtgctgggattacaggtgtgagccaccacgcccggccgactttttcttgttactaacaatagctctttttccctgatcctctccctcctcctacctcccgccctccaataggcctcagtgtgtgttgttcccctctttgtgtccatgtgttttcatcatttagctcccacttataagtgagaatatacagtatttagttttgtgtccctgtgttagtttgctaaggataatatttggcctccagctccatccatgtccctgcaaaggacatgatctccttcctttttatggctgcataatattccatgacgtatacgtaccacattttctttaataatgggtactagacttaatacctgggtgatgaaataatctgcacaacaaactcccttgacacaagtgtacctatgtaacaaacctgaacgtgtaccctgcaacttaaaatgaaagttaagaaaaaaacacacacacaaaacaaacaaaaaaaactatagttgccattttaaacacctatgatgtgtcaaacattccttcagccctcccaactatccagaaagagtccttcttttatagatgaaaaaactaagaatcaaagagatgaaatcgggcagagtagagacaggattcaaacccaagatctgcatcttggactcacaacactggaagaaacttcagacaccagcctaacttcacacccagctcaggactggccctgccgaatggtcactcacctgctctgaaaatcctcgcgacaggacgctcacttcctacaccggtagttctctggctcgaggtgtgccacagaatcccctacgcattgttagaacacagaacattgctacccccaccccgtgcagggcttctggcgtggtggggctgggacaggggcctgagagtgtgcatttctcacaagctgccacaggatcctgatgctgctggcccagggaccacacttggacagtcatcgttctaggaaaacttcctggagtgggaatggtaaaggtgatggcttcttcccattttgcccttttcaaatctgagataggcttccccagcaggctcagtgccagagtccataccctcaatttaaataacaaatcctcctctatatcatgacctttcctccagagggttgtttttcattttttgttttttgttttttttttgagacggagtcttgttctatcaccaggctggagtgcagtggcacaatctcggctcactgcaagctccgaaccccgggttcacgccattctcctgcctcagcctcctgagtagctgggaccacaggtgcccaccaccacgcctggctaattttttgtatttttagtagagacggggtttcaccatgttagccaggatggtcttgatctcctgacctcgtgatccaccagcctcggcctcccaaagtgctgggattacaggagtgagccaccgcgcccggcccagaggggtttttaagattgtgtgttctgaatggcctgtctctgactggaacccaactccgtccccagacccacttccatctttttctgtgagggggacacactctttcaacttttccaaaatggcatctaccatggcttttctgattaaaagcaaacgaaacacacccttcctataatcaaaaatttagaaaagcagcaaaaataaaaaggggataaggaagaaaacagaaattaaccaccatcccaccgctaaaattttgatgagttctcatgtgtttccttgcagctgattgttgtttggcatacatttattaatattggaattaaaaatatatatggcactttatatcctagaaaatagtaatactgtaaatgtgttctagaaatgggagctgctgttgctcttattagagaattcaaacaaagaagggaggctcgctggggacagcttctgggggaggatgggtaccgctttgagacaacagggagaactcaggcacagaggtgacgatcatcgttctctgtggggcacatagtgatgcagccggaaacaggtatgagtcagttgagtggggacaggtaatagagagctagaactggctggccttatggcctccaaggcattggggagccactgtacattcttgagcaggcaatgacttcacaaaaggatttctcaaaggttagtcctgcaacagaagacagcgtggattggactggaagagtgggagggcaggtggagaaggcattgtgctgcaagtggggagcagccctgggggcccagccagtcccctgtgccctgacaagtggtatggcatggatggatggctctacttctgggccgccaggatggacaggtactggttgctcttcaccatggcgataatgaggaggccaccggtcagcaggaaggtgggccagaagagggagaagaggagggcctggggcccgtagaggcgctggaataggacgctggtttcgttcccccgaggtgcggagaagcagtagaagacctgctgctcttggaatttggctctgaccttctccacgtcggcccgggccgtctggtaattgtccacgctgcctgggatgtaggagcactgtggggagaaacaagagcagctgtgggcttggaaatccccatttcttagccaagggcttgatatggagtaaagaaaaataccagctttgtagtcgggcccctggattggagtcggggctttggtctaaagcttggcaggccatgcgctgtacaggtctggagagcacgctctcatttgtgtcttgtgtgtggatggcggtgctggagctgctcggggtacaggctacacacctgggcgcaggtcctaccttggagtcctggctctgcttggattggctgtagaatttttggcaaatttctcactctttctgagccctgaagcttcatcacttaaatgggtgaatatcggtttcaaaggatattatgaaagaaggacttcacacagagctatctaaggaaaccagggagggacacaggccaagtgggctgtgtatttgaaatcgagatcatgtgctcaattgcctacagggctcatgaaggtattgtcagagggtgaagcaggcaaagcaatgagatgacaggtgcccactgactcttgccttggtgccaggaagaattgccagggtgtggcagggcctgtcaatagggagagagccagctgcctccagacaggcagtcaccactccctccaggcaatggatgtcaggccatccagaagatctataatagccagacctccaacactttaagagaagttagaaaccagatcacacctgtaatcctaacactttgggaagccgaaggggaaggatcccttgagcccaggagttcgagactagcctaggcaacatagcaagactttatctctacaaaaaaagttaaaaattatccaggtgggcatggtggtgtacctgtagtcccagctacacaggagactgaggtgggaggatcacctgagcccaggagttggaggctgcagtgagctatgatctcgcaactacactccaggtaaggcaacaaagcgagatcccatttcaaaaaaaaaaaaaaagtaaaatattagctaaatttaaaattgaaaacctttgcagtttcaacctgtgtacagcaaacaaactatgttggcaagcgggtatttgacactgggatccaaaggaaagaaagaatgcattgaaaagagttttgtgccagcagagcatgacacacatttaattctgacgttgattattgttattaggaactttctgccctgttcagatgaggccagctggaaagtgatgcaaagcagtcataaagcggagttttatctggttttatctctgttctgagctgcaagtgtggtgcccccatctgcagcagaatacctacagggcccccatagcccaggtccctacccactctgcatcactgagggcgagacccaggaatgtgtgattccttcatgcacttaattttgccctagtgaaatcatgtgcaagatcaaaatgtgtaaaactgagacccaaatggcaggtgttgagccagattccttgcaggcctcggccactccctggatttatatgaggtgccaccctggaagctgcctgccctgagggcattcactccagcaacacagaggagggttgcactgtagttctcacagcctgggaaatgcagatgctgcactcagatctagggccccagccagccagggagtagctgaggctggggagacgctggctcctcaggaatctggcattcagagctgttggacactgccaggtcctcagtagcatataatccagcatcctgagctgacggtgagggggcctggcctgagtctctccaatgcctctgactgtgaccttggctaacctagctccttaaatagcagtgtggctatggagtcagacaggcctgagttctgagctgtgtgaccttggcaactgccacaacctcactgggccttgtaaaatgggtttgtgaggctacctgcctaggagaactgtcatggggattaaatgagatgatgcatgtaaagcactgagcacagaagcccagcacacgataagaactcaaaaaagtggaagatgctattattaataataatatgttttgacttatctatgaaattgcaacaacagctccttctttaccttcttaaaaagaggtctatggatgagctctgaagtagaggcttctgtccatcctgggcctagtgtatcctctgcctgctcagggttcctctggatcttttatgctgggcctgtttggcaagacactgggcaggaattcactcttcatggccaaacccagaagccggggcctgaatgcatcctttctctcctgtcctgggtccagctaagcctgagttatctgaatgatctgaaaccaaccagctttttcccaagccctgcagtgtaaggtccccaggacagacaatgggagggaatttagaactcacctgctccaggctaagactcacaggaaaagctgagggcagactatggcccctaccttcagagttggagggtgggatgagagtcttcttggcccttcacagtgattccagaggacacccagctagcctggagccccagccacttgaacccctatgatggacataggcggaaggagcagctagcccacaacccagctgcttggcaaaaacacgaagggcatttccactgcttcctcccagctcctgcagcctgctatcagcaccacacctggtcaagcctgggcggcaggggagaggacagcagtggctccagcatgtccttccttcacatcctgctgacagttcattcaggggatgctcctctgagctggcaatctcaggaccagggaggcagcctgaaaaccagcctgctctggcccatatcactcccggagaatgttaccagttattgaaaatttgtttcttgcattgggataaatcaagggctactgaatgccaacgcagaggcaggggtcatgggtaggagctgcctccagtgggccctgagacctctctccaccgggtggggccgagtcatactagcgatgacagaacacctgaccatcctgcactgcccagacccacttctcattgaccttcagcactctcaagatcccccagcctccacgccccatcccaggcaccctgccccttcccgtcccatcagccatcaagtccggactgtcagcatctcccctgctgcaggccacatcttggtcgtgagtgcttgctgcggccttggctcctctgtctagtaactggacccacacacctgtaggctccatcttcccagcccaactctgaaactctgatcatgccctaaagattcccattgccaacagcaataatttccaaccttagaatcaccttgggagctccatgaatggatctctgaccagagattccaccttgatatgtctagtgttggaccctagttttgttttttaagactcttacagggttctaatgcatagccaaagttgacatatcttgagacatacacactcacattttaattccatattgtggtgatcaaaggcctctgggaacagaccttagtctgccctgacagccttttccagctgcatacaccccatcatgggtcattttctgtagtcagccctctgatccctgtctccacctagcccttccctccgccatgcctcgtcctataggcatacccgcttcctatatcacctcattctctatgccttgcatcctgcgcctgcctgatgttaaaagcctaatccaagagcctttcttttttttttttttttttttgagatggagtttcactcttgttgccaggctggagtgcaatggtgcaatctcaccaagagcctttctgatacccccatcattgtcagctggaaaacatccccctcctctaacccctgtaacttcctctgttcttctccccggtgccaattcttccctgctaggcactgttcatgcatgagctctctcctcttgagtcctacaggcttgacacaggaggtgctcaatggctgttgaataaataaatgagaggaggaaagaaggaaacaaggaaggaaggaaggaaggaaggaagggagggagagagggagggaaggagggaggggaaaaaaaagaaaagaaagaaggagggaagaaagggaaaaaagaaggaaagaaagaaggaaggaagagagacagaatatgggccaactgatcgctttaggaaaggatatggtggtgagttttgtgttttggagggggagggtgggatgttgggatgcaaggatggaaaaaccatctaaatgtttgtttatggaggttactccagccctgagtccctggtttcctggggagtcaccgggattccactttgaggatctggccctgggcctggtccctcatttgactgaggttgtagaatgaaagtactaacactaatcactgcttttgtttgagtgcccactatccactcagcatcaagcgtggcactttatatacagcgtctctgacttgataacagctcttcaaggtgcagcattagcattccactttacaagggtggaaactgaggaggtgagaggctaagtggcctgcctatgtttacacagccagttagcggcagattcaaacccaggtctgtgtgactccaacacagaagagctagggctggctcagtctcattccagctgtgagacctggtcaagtgggttgatctttctcagcctcggggacagggacagttaggaacaggctcacacacctgacagggataaagggatgtgtccccatccctccagttcagtacctgctggttctggtcccgagtgtcctccgtgtggtacagcacagcccacctgccggcagctgacacgttgacccacaggcatgggtactggggcaccttcttgcccttcagctcctcctggtccctgatgttggtctcaatcaggtggcacttggattcctgggtccacacgctgaggagaccacacacatgcacacatacacatctcagaactgggtgacacacagaacacccatttgaacccattatcccctgggagcctctagagggatccaggactgggatcctcatcttgtcttcagcatccagcaataaaggcacatgaccccacagtccccggacacagggaggaattgtagaagctggatggggtcttagacattatctatatgactggttctcaaccttggctactcttgcaacaacctggggagcttctaaaaagattcccgtgtccaagctacaccccagagcaagtgaatcagaacttcttgggtggtttggcccaggccctgggtgttttttcaaagctccctgatgtgattctgacgagcagccaaacctgagactttcttatccatatcgtcttcattttgcagaggcagaagagaaactcagaaaggtcaagtgactttgctgagaccttgcaggacctgaagctaggtctgagtgggttggagagctgtgttctttcccctaaaaggagcagatgtagaaggggtttgagttgagccaggatgggaaagatggtggggacagtctctagatggtgcttcaccagattaagagtccagcctggaatcgcttcagcgttgtgaagagtgaggctgcagcaggcccgggagaggctaacaggttcatcaacatattagtaaatcagttgtgcttcaactcccaagtatcctgtgggagacccattgccagtcagaagggggctgtcagctgctggaacgtgcccagagcacaggtctgagacttatcctaaggacaggctgggggaactgagtgtctttgttccaaatagaacacgaattaggaattcacagcttttccttaaaatctcaagtggttgatatgtcatggagcaagggcatggaccattctctgagattcctgagcagaacttcagggaagcagatgctggctcaatgcagacacatcagaaaacctcaaacatgaaatgtatgttcagtgaggcaaggagctccccgtctcttgaggtattcatcaggaggctggatgcccacctgacagggaggcttcagaggggagagaattatgcagctgagctgtaaacatctgcaattctctgattcctcctgggatcaaacttgcactggaacctttgctctgattctttgctatttcttctgagaagggcatcatgtgtctgttaccaccacgtcctagatcatgtgtctgttaccaccaggtcctagaatctcagaccagtggggctcagttcatcctaccttccctgcacttgaaccctagaacctaagaatgagcatcgtcttgaccctgctgccttgaatgagggtcaaggagaggggtgagtagaaggccagggttccttacagatgccagacccttaggagagggttggggggtgggcaggccgggagagctcagtaccttttctggtagaggggcagcacagtcgtgaccaggatgtagtaggtgatgacggcacacaccaccatggttacacccaggcaaagggctcgtgtctctccccgcttctgggccatcaccagcttcttcaccatattcactgggggcagtgatcatttctaggtccacagaagcaaacagaagtgagatcagcccagttcacaggtgatccacagaaagagaggacaggtgagaggggaaggtactcaactattaatatcactcttgtttatatttggagctttgcaacttccagaagtcttgctttttggaccccatgtaagccttccctgtgcaattgagaggcaattgcagataaaagacctacggctcagagaggtaaagtgacttgccctaggtcacacagtatgtaataggctcagtaatggccccccaagatgtctatgttctagtctctggaagctatcaatgttactttatgtggcaatgactttgcagaaatgattaagataaaggctcttgaaggccaggtgcggtggctcatgcctgaaatcccagcactttcggagaccgaggtgggcggatcatgaggtcaggagatcaagaccatcctggctaacatggtgaaaccccatctctactaaaaaaaaaaaatacaaaaaattagccgggtgtggtcgtgggagccagtagtcccagctacaggggaggctgaggcaggagaatggcatgaacccaggaggcggagcttgcagtgagcagagatgcgccactgcactccagcctgggcaacaaagcaagactccgtcaaaaaaaaaaacaaaaaacaaaaaaagataaaggctcttgaaatggggagacaatattggattatccatgtagctcctaaatgtaatcccaagggtcctaataagagggaagtgaagggagattaaacagatgagaaagctaaggtgatatgaccagggagacagcaattagagtgatgtgaccacaggccaaggagtgcgtcagaagctggcgggggcaaggaacaatggctcatcccccacggccactgcagggagtgcagcctgcagacaccttggtgattttggacttctggtgaaatttctgtcgtttgaggccgtcaggtttatgatcatttgctacaacagtcataggtcccatgcggtgagcgagcagtacatgtgcatcatccatgcacctccttccacggcacttatctcacagggatacttggagtatttctgcccagaaacagttctgtggcagggctagctgggccgggcacaggcagggaaaggagaggagggccccagaaggcagctgcaggttgtcaggagaggcaggaggtttaccatattccggtgttttttttttttgtaaggaacattcccctacttcaagcaaagaaagaagaaagaaggcatcatggtggcctcagcgactgctttcttatttcagggcttgaagccacctgggacaaagcagaatgggcacattctgctggtggttgctttccttctctcctctttctttaggcagcaactccttgtttttcccctggacattgactccaccccaatgcaagcaaagattccaccctcccctgctaggctcctgatcgctcccccaggagtgtgagtcttgacaaagacttcaagaaacagcccctcaatctatgccgcctggagccacagagatgcccagccatggtccccgcgtgatttcccatggttccgcaagctgtcctagagcctctggtaaatttatttgctgttgtttttatttgtttaaagtaaccagagtccatttctaccaaaaataccaggaagctatcaatgtaatcctccattttaggggaaattttaggggaatttaggggaaattttagccagatatcagggggactttattctccttgccaggtccctaaagtaataaacatattatggtttttgtttgtttaattagccagtgtccgggtgacaggccttagtccaaagagattttctgcaaagtgctctattttctgctcaggcgtctcttaactactagactgtttcaaatattcagagattcttgactccctccccttagccaggctgccctcatacccgggcatctccgctaaagggaagagaccagggtcaggcaccacggatacccatcacaccttcccagtgagctggtccacctcccctatcgatcggcagaggtgacatccaatgacaactttttctcctttatttggcaccaggaggtgagtttctcctgcattctaatggagacattataaaagcacaagcaagcagaaattgcccccgacaaagagagatgttttattcaactctttttattcaatccttttcctcctgttctgtgatcttgtgggaatgggagagcccatgcctttttctacctggcgtcagttgaacaagactctccatgtattcacaggtaaagcaacagaatcacctggaggtaagctaaaagccccaacagcctgcttccccaggacctgcaagggtcactggcacttggccccaccccagatactgtgagacataaatcatttgaagccaatgggaaatcccatcttggaagcctagggctgagtgcccacaacaaagccatttctctcctgggggaactggatcgcacctgtgggggcttcctgtggctccttcctggctaatcagccccccccagcgcccagggccatggcctcctctgctatttggcttctagtgccctctcaggcccctgggcactcctgaggctggtgaaggcaggaacctggttttaccagttttaggagctcagaaggaaaggaaaggagaggcttccctgtcacagagaagtctggaaacttggcttattcaggtctgacccgtctctaatggtctgatgagattgttgcctgcactgagtgagtttatagagtcatgataaatcctcctaagaccatgcgtggggttcagtgtagatatgacttcagcaagaagttagtattcagcatccaaagggagaacctttggcgggaggaaggatgggaactgtcaatatcccccaagggacagaaagaaaaggaagaagtgggtttcagctatcataggagggatttcagttagactgtaagaagaacttcccagttttgagcatttctaaatatctctgaagttccaggatatatcttcccatttagaaaggtcacttgagatctgggatagattcagagaagatggagaaggacaaaggaaggcaggactttggagtgtcctgggtgacctgatagctgggtcgacatccttttccttagaaggacaaggaatagagtacattgttgaacagtttggtggggtgtggacagggcgattctgaggtcctcagacatggaatcaaatcctggctctgccacttacacttagcaaccacatgactgtgaaacgagaaccatggtacctgcctcagagagttcagctaaagatcaaatgccatattgagtatcagacatgtatcatagcacctagccccaaatcagcccccagtaaatattagctattactactaacgaaggaaaccctgaaagtttggagcagaagtctggacccctcttgatgaatctatttttgtcccacctctctaccggtgacaagtgccagcattggtgttaatctccaggctgcagccttctggccactctgagaactgggacctagagggccagggcgcttactaccagagtaacctggccactgtgccaccctccccactggccaccagaccacgggccctccatccagaaggacagccccgagaggaagggagtcctcctgcctgcctccctccctgccccgtggcaggctgctttcccctgtctccctccagcccggtcttcagagaaatcacttcccaagtgctttcaggcccggtactcacagtcttcccggcgtcctgtgggtcttgagcagcagacagtttctttctgcctggacccccgcccccaccccaaaagaggccacagagcttcagcaggaagtttggcctccccgcccgtctccagggaagcagcttttggtccccatctggggcaagcctccatgcccaaacatggtcaagtctgagcacacagcctggagacacagactcggagagcaggtacccagccctgaggaaggcagctgttacccaagccctgcacctccatcttcccagagtctcgtgggaaacagatttcaaacaacaacagacagcaagactgagaaactacgaaagatcagcctggtatatttggaaatatttcttcttctctctgtctctgtgggctggcaaagatgccagaaataggaaatgattctccttttgttggcatgaggaagggtggagttgggctggaggggttgggcttgtcactagtccctggcatatccacgctggagcagctacagctccctgcctttggcacttacgtgctgtgtgaccctgagcaagttatggcacctctctgggcctcagtttccttttttgtttttggttttactcccaaacttatcgttaaatgacctcagttttctcacttgtgttactggcatttttaaaacctactttgctttagggtagtgatgggagttagagacggtggggatttatggcaaggggagagaactgactttttaaggaccaactgagctgaagctgggagtagtgagagctccacaactgcttccaaccaggtccagggacagtctgctcaccaggggccctcccagagaccgcgaaagtacagagatttcttcctagcaataagacaagtgaatgtcagcatttgcaggcaaaaaacatgcttttagatctctgcttcttcatctgtaaagtggaagtaaggattaaaaatcagcaacaaagggcaggcacagtggcccacgcccataatcccagcactttgggatgccaaggtagatggattgctcaagcccaggagtttgagaccatcctgggcaacatggcgaaaccccatctctactaaaaatacaaaaattagtcgggcatagtggtgcatgcctgtggtcccagctacttgggaggctgaggcaggagaatcgcttgaacctgggaggcggaggttgcagtgagtcaagattgtgccactgcactctagcctgaacagagcgagaccccgtctcaaaaaaaaaaaacaaatatatatatatatatatatattttcaacaaaacaacaaaaacaatcccagatattggggctttcctaagtatcaggcgtggtggtagaaggcagcttatctccacccttcacttgacccaagaatcaaagaacctgaaactgagacttggaggcttgaagtcactggtgcaaccctaggggccagaactagattcgaagctggcccttccagatggcacagcttggtctgtctctgatgaccctggggctgctctgagacattaaaaatcacctcgatcatacagtaagctgccacctgaggctctggaggtcaccctgagtttccccagcccccagggaggtgggtgcagcctggccttccctgctgagcgagctcaccaccttcctccctcctgcctccagcaggcgcgaaatgaaggcagccactcaggcctccctgacacactctcaggcggtgagtgcccttctccacccctttcctaattgaatcttattaacaggagactacagtgtctgtttaatgggcaccatagcaccagagggtctaagaccagcttcagaccttgcaggcagattgacagagggatgtaggatctggaattcaatctcagaagagcaattttccaaggatgatcctctgtccactcagaagcaggaaaagtcctcctggggctaatccagaaatgccaggcccccctcctgcttccctgggggagagatacacagtgcaacaggctgccatttatgagtataaccgaagggctccttgctcgtgatactctgaataagttattaagggctacatattatttggaaatcataaacaaactttagcattcttcccaagggaaggtgggaacaaacagggaaggggggccgtggggtcttctgctccccctaaatgagccacaaccaaaaggcattgacaagccctgtcctcgagggtttgtgggtgaaaacccaggtcctttgctggctgcggggttgtgtgtgacagatggctacaggtggagggcaagaaaataacaatgctgcaacaataaatattgacggtttgcattagtacggggtgtcagagatcacaaaatatcttctctgactcttccaacagcttcttaaggtactagcacaataggctcacaatagaccactgaggtggagatttttctacccatttgatagagggagtaactgagcctcagagaggtgaaataaattgcccaagcaagttactttgcctctctaagcttcagtttgtctgtctctaaaatagagataattatacctagcccctcagtgtttttgaggaatgagagatcacctaagctacctgacacatagtatggagattgtcctttccaaagatggtcacaccaaatacttcccattccatgtgcccttttcacagtgtggcatcaacactccaccatcaagaggggcattgatgtctcttccccttcaccctgggtggagcttcgtaagggcctcaatagtagaatatggtagaaggacacagcacgatgttcaaggctaagtcatagacgggggctcgagttccccccacacgctctcgggacatgtacctgggaaccagccaccatgttgtaggaagccgaggccccgtgctccagctgacagcctcagctcagatctcagccaacagctagcaaatctcaccgggcatgggagagaacaagcctgcagacagttccagcccccagcctgccagcctcccagctgaggcctcagagaatgtggagcagagacagcccacctgctctgtgctctctctgaattccagagccacaaaatccacgagaagaaaaaaactaatgtttcatgcccctgcgttttggggtaatttgttatgcagtcatagtaactggaacacacttgcaagtgatttcaaagggggactgttacagttgctggtgatagtggtaggattaaaccagtgagaattaaaacacctgagattgctatatggagtgttacaggagagtttagaaatgctttatctaggtagggcatggtggctcatgcctgtaatcctagcacttttcgagaccaaggcaggcggttcatttgaggccagtagttcgagaccagcctggccaacatggcgaaaccccgtttctactaaaaatacaaaaattagctgggcacgatggcaggtgcctataatcccagctattctgggaagccgaggcatgaaaatcacttgaatccaggaggcggaggtcgcagtgagctgagattgagccactgtactccagcctgggcgacagagtgagactccatctaaaccaaaacaaacaaacaaaaaaagtgctttatctactcttaggtcacacactatggcacaaatggaatagaagggcagtgatatgggagggtatttttgtttatgaagcacctactatgtaccagggaatgaccacatagatatgcaatacatacacatacacatacacatggacattcctctccacaatcccccacaaaaggccttgttctttctgtaaaagcacaaggcaaagtgattttcccaaggtcacgcccctagcgtgtgatgtgatggagcctggagtgcacctgtgcccgctgactccacagcccgtccctgcccctctgtcaccccatgactcccttgggagcagttttcaagagaccccaggtttcttcatgatgtctgcttccactgctttccagacaccctcagctcagtctgtacccctctctggattatgcacctgcttgtttatttaagtctttctgaatcaatatctcctctctgctgacacttgggataataagtcccataaatcaaattggcaactgagtcttgagcccctgtgtgtgcctctctgagtgctgcagggatgggtgttagtcactctcagtcctagcgaagctgtgcgttcacagacatcccagcacttgctatgcagaggctctggatacaccactgtgccgaggtgactcagacacggtcccttcactgcagaaaagcgatgccagatttcctcaactacaaaaatacagaacagaaagtgaaagatgtgttttaaatgagagacagtaataaaaggcagaggaaataacggtgggaggttttttagtagagttgagatgacaaagtataacaacagcaaaagtaaatgccgatattacaattaaatggtcacacaacaagacacgacaaaaaacatggtaaagttgttccctgctgtgtagggtgatactcactcctttttcctctgactcttttcaccatattttcccttggcctgatttttcttcctttatcctgccatgctgttaacataattgtaagcaccttgaaaatcctctttgagacaaagaggagcataaataaataaacagccctgctgtctgtctgtgtggtaaggttggtttttttaaaaaaatgctttttccttagtgcaaatcatcccagctctgtgggaaagtggcatgatgtggaagtgcagggagaagatgaggtacagtgttagcctcactgctcagagagagttgctgtaagagtggtggtggccttttcaacacacataaaggaagcatgtgccctctccttccatggcacatgtctcctctgtccttgcctcctggccagctcttcctcttccacaggactccccgctggggccttccctcgcccccagccccttagccactctccgcgcctcctgggccaggcggaagctctgcttccgcatgctgggagcaccgcatgcctcttctgcagaacacttcctccgcctgtaatttaacatttattcatgtgcatcctccattaacatgtctcctaacccaagggtaagctctctaaaatcagggactggaaccgttcttattcactgccgcatctctagcgccaggaggaataaacaaagatcttgcggttttgttgtcatcgtgctttggttttcgggaaaaaaaatctctcgcttttttacataacagaatattataatcattttcccatgccatgaaacatttttcttctttaaattgatatattatagtttcacagttgtacataaaacacttttctttcttgaattttaattatagattcgggggatacacgtgcaggtttgttgtgagggtgtaatgcgtgatgctgacgtttgagcttctattgatcccatcactgatagagtgaacatagtacccaaaaagaagattttcagcctttgccccactccctccttccttttggagtccccagtatctattattcctgtctttatgtctgtgtctacccggggattagctcccacttagaagtgagaacatgtgatatttggttttctgtttccgcattaatttgcttagcataatggcctccagctgtatccatcttgctgtaaaggacatgatttcatcctttgttatggctgtgtaatattccaaggtgtatacgtagcacactgtctttatctaatctgctgttgttgggcaccaaggttgtttccacacctttgctattgtgaatagtgcggcaataaatgtacaagtgcaggtctctttatggtagaatactttattttcctttgtgtatgcatccagcagtgggattgctgggtcaaatgatggttctatttttagttatttaagaaatctccaaagtgctttccacaggggctaaattaatttatatttccaccaacagtgtaaaagcattcccttttctctgcagccttgccagcatctgttatttttttactttttagtaatagctattctgactggtacgaggtgacatctcattgtggtttaatttgcatttctctgatgattagtgatgctgagcatttcaaaaacatttttctagaaaggctatacagttttctaggttatggctaagtcgggatagatttcatcaaagccatgttgtcagatatttaagaagggtacttgcttccctgcatgcttgtttgtgtttagcggaaggcagagtccgcctctgctatgggcagacctgttttattctctacccctgaaccacacccatgcccagatgtcatttttcatgaatggacaggtataagggagactgtatctataagcacaaagtttggggaccagaacaggtggatagagatggcaacatcatagaagtgggagatggtgacaggttggcaattgctcaaccctgtcccaggcctgacttgagccttagtgagtgagagagagcaagagagagaaagctgttgttagggcttgtgggactcagaacacaagaaatgccactttgggacctacgaagagggtgtttccacttctgcttagctgtggccttgggcagtggccctgacagataatggccatcattatcatctaaaatagctgcagcaaaggtagactcctgtgtgaatcggtgtccctaggtgtgctgcagctggctcacactggcaccgtgagagcctttgcaagccaagtgttcaaccatcaggagctgaaaatccaccacagtgatgggagtagctatactgtggaaatctacaaacaatacacatcagggcttttgtctttttggagagctgttttgccagcacaccactttagaggatacacttcaactgggaaacctgaggaggtattaggaatgaaggtgtggacaggttataggaaaccacagggaacagtgacctaggggctcgcaatgttggttgagggctgagggaagggagctctgtccaggatcagcaggagaatcttcttgagaggggatgctcccagcctggggagaccctcagggaaggaactggggaatggactgctatgctcactctcctggaatgtgttgatgaaaaagccaaactctgcaaattatttgaagagatttgttctgagccaaatgtgaggaccatgacctgtgacaaggcttcagaaagttctgagaacatgtgtccatggtggttgaattacagcttgattttataaatgttaaggagacagaagctacaggcagacatcaatgaatacacataagatttacattggttcagcccagaaaggcaggacatctcaaatggggatggattcaaagatttcctggtggattcaaagattcaaaggtggattcaaagatttcctgaatagcaattggttgaaataattaagttttgcctaaagagttgaagtcaacagaaagaaccacgaaggggggttatggaaactaaggttattattatatagatgaagcctccaggtagcaggcttcagaaagaataaatgataaatgtctcttaccagaccttagaaggtctgattagactcttagttaaatctctctgggatgagaaaaagacttagaaagggaaggggagtctctgcagaatgtagattttccccacaaatgacaactttgcaggactatttcaaaatatgtcaaataaatatagtttggggttaaaatacttgtttctttcagagcctgctatctgtcatgtgatgctatactacagtcaggttggaatttggtatttattactacaaagagtctgtttgtcatcttaagacctctgttttaatgttaatgctggtaagttgtgcctgaataccaaagggaggaaggtattttattaagaggcatgtccaacatcccctccccattatggcctgaactagtttttcaggtttctttgaaatccccttggccaagaggtgggatccattcagtcaatcaagcggcttagcattctatttttggcgtacagacccttctgcagacacctgatctcctttggttgaatccaactggtagacagacaaagagcttgttgctgcagtccccagtgatcagtttccagggcagagccagctagagagtgaggaggggtcaggaggggcttacatagatatcagtccatctccctgtgtatgtggctttgggacaggaaaactaggtaagagcaaaaaaagagggcttgagcacatggggactccctgcaaatcccccagaaatatttgtaggggtctgaaaggtatgtaggtagggactctaaacatttgtaagtcaaattttatgtggctaatttggagccccaggctggtaagagctcaggaaactcaggttccataaacagtgcctcattaaatattctttgcataaaataggttgatgaaaagagtcaaactctgtaaaatatttgaagatatttattctaagccaaatatgagtgaccaatggcccatgatgcagccctcaggagaccttgagaatatgtgcccaaggtggtcagggcacatcttggttttatacatttttgggagacatcaatcaaatacatttaagagatggcttggttcagtccagaaaggtgggacaacttgaagagggggctgccaggttataggtagatttaaacattttctgattggcaattggttgaaagagttataatctatagaaagggatgttggggttataataagaggttgtggagactgaagttttatgatgcagatgaagcctccaggaagcaggcttcagagagaatagattgtagatgtttcttatcagacttaaggtttgtgttgacgttaaatgctggtcagcttttcctgaaatccaaaagggaggagggcataatgaggcatatctggacccctctttccatcatgacctgaaccagtttttcaggttacttttggaatgccctggtgagagaagggatccattcagatggttgggaggaccttaaaattttatttttggtttacgaatgtttgcacactttttgttatttccctagaataaagactggacctccaagccaaaattctagggcaaaaggtttctacatttttaagattttggtatatatttcacaccttttaccagaataccgataccaattcttgtactcactgctggtagaggagactggttaatttcacacataatcaccaattcttaacactcttaaatttggaaatatgtgtcttttggctaggtgaaaactctttcatctgtttttaaatttgctttctttagattactagcaagattgtacagtcctttatatgttcattggaagtgaaatattttatttgtcccaaattgtgatcaggaataaataagaagcccctgttttagaccattctaactgtcctttttctctggcaagattcagaggcccaatcttcatcagctgctctaagtggttcaggtcaggaccggctccaggggctgaatgccccaccccaatccctcccagcctctcagcatgggcagggggttttgagattataaacaggttattctgtaaactttctttgctgagccatagaatgtcagccctctaagggcccttagaggtcatctaggcttgttgctggaaaagagggtcctgatccagacacctagagtggattcttggatctcacgcaggaaataattcaaggagagtcacagaggacagcgaaagaagcaagtttattggaaactactttgttacagagtagggcatcctcagcaggaggaggagcatgccatcctttgtgagtgtgtctacttgcaagaaattagaaggagctctacacttggaatgtgtagatgtgcttaccaaaggtaagggctattggtgttatcaatgaccatgaatcttttaccctaagcctgctaaccgatgttatctttaagtaaaattggctgtactcttaagatatccggacattgtacaggcttgctgggagatgctctgtatggccataaatattacataattataagtggtggtcagcttagaatttggctattttcagaccattagcattaaccttaaacacgctttgtgaatgcctgcctgctcacttcaatatggagtcactctagtcgcattttattaaaccagaggcctggtaaacaggggtttctataacaggcctacatgaccactttgtccttgagtaatgttttctatttacaaagtaatagaggtaagtcatagagaacttgataatacagaaaagtaaaaaagggggaaaataaaaatcaatcaagattcaatatcctgaggaaaccacagtcaaaatattagtggattatgttctaaagattgatacaaatcctttctaaaaacaaacttaggaatatactatacaatttaaaatgtgttcttattttaaatagaaacactttccccatttatgtaatattgcttttcaaaataccagtacttcatggccctataatagtccatcatatagatatgtcataaaatgttttactatttcctcttctgagacatttaagctattttccaggttttgctattataaactactctccagtgatgatctgttcatgtcatctttgctcacctctctgattatttccttccaacaggttcctaaaagcatgatcagagccaaagaatattagccattaaaagcctctgcctcttctctttttctggaagcataggatctgataaaatacacacctctgttctgttggtgagccatgtgagctcagacaggtgcagtgatttgcccaaagccacatagctttgttagaccagggattggaattcaggcctgtctcgacagcctctcgtgagtgccagaacccagccaggagtccatgcttcctgactcctatgccatattcttgccttattccttgcattagtccgttttcacactgctataaagatactacccaagactgggtaatttataagcaccagaggtttaattgactcacagttctgcatggctagggaggcctcaggaaacttacaatcacggaggaaggagaaggggaagcaggcacctcttcacaaggtggcaggaaaaagagagagaagcccaggggaaattaccatttataagaccatcagatctcatgagaactcccttactatcatgagaacagcatgggggagacttcccccatgatccaatcaccccccaccaggtccctccctcaacacctgggtattacaattcaagatgagatttgggtggggacacagagcctagccatatcattcctctttgtagaatatttctccactagtgagaactctcaattactgatcaccaacatgtgccaagaactgtgctaagtacttgaactgcagtatctcatttgatcctgaccctttgaagtggttactgtggttatcctaattttatagatggggacactgaggtggaaacacagcatttcttgtccaaggtcatgatgttagtaccttagagccgaaacccccattccttcttgtctgagcagtgtggtccaaacagaactttctgtggtggtggaaatgttctataactttaagccattcgatacaatagccactagctacctatggctgttgagcacttaaatgtgaacagtgtaagtggagaactaaacttttaaccttaattaatgtaaatggaaatagccacatgtaactagtgatattggataggtatctctggagccttaagtttccctgttccctccatcatagcctgactcaggcagctctgaagagggctcccctaccatccttggacctcagcctggggtgggactcagaatagccctcctaacacgccttgctaatcctgagccagagactctctctgagccaggaccttgtgcctgagacagattcttcagctgcctacagggctggcagtcccaggagctacttcctgtgggcatttacaaagacacactgcagagagaggctttttaatccccttttgttacacattaatgaaaatgtatgtctgtaatccataaataataagattgctcctgcaaagctcaaggtctacatttacactcagagtgaatattattatgaacttcactagaatcttctctgggagttctcagcagagcaccatctcccagaagactctgtctctaaggagggaagtgaaggagcataaaaggactgattttttaaaaatcagcatttaatctgggcacggtggctcatgtctataatcccagcagtttgggaagccaagacgagaagattgcttgagcccaggagttctagaccagcctgggcaacatagtgagaccccatctctacaatttcttttaatgagccaggcatggtggcgcatgcctgtggtcccagctacttgagaggctgaggtgggaggatggcttgagcccaggaagtcaaggctgcagtaagccgtgatttcgccactgcactttagcttgagtgacgttgagactctgtcaaaaaaaaaaaaaaaatccctcataatttactgagtgccttcttcatgccaggccctgcactaggcctggcacatggctccctacggtactttcatagagttgctgtgacacaaatcactacaaactgggtgggtggtttaaagcaacagaaatgtatttcctcacagctctggaggccagaagttcaaaatcaagctgtcagcaggcccgtgctccctccaaaggctctaaggggaaaatccttccttgccttttccagcttctggtagtggcaggcactccttggcttgtggctgcagcactccaggctctgcctctgtcttcatgtggccttctcctgctctgtcagtggcttcttctctcctgtctctgataaagatacttactgttggatttagggcccacccaggtaatcaaagaagagctcaagatcctttgtttaataatgtctacaaagactctttttttcctaataagatcatattcaaggtaccagaaatttggacatggacatatcttttgtggggaccccattcaagtcactatactcatcttattcaatctatataacaactctgagagggaggtgaattagccacgatggactaactgccgcaaccaccccaaggttttaatggtattatacaataacagggcatttctaactcgtgggaagtccaatatggatgttcctgcttgggaggctgtcctctaggtggttgctgggggaaccaggcttcttccatctgtggctgcaccatcctgtggccttgaggtccccctggagttatccagcaggtagactgggagcaggagaggcagagagagcatgtgaatcattgaacatctgatacacagacacattggcctggaagtgacatacgttactgatccttacatcccattggtgaggactagtcatgtggtctgcccagctgcaagggagtctgggaaatgtagcccctgaaggctcagtggcttctcagcatgagtatcacactcttgggatggaggcagggggaaagcaccacaccttgttggtcagctggccacggctgccacagtgtcattcatttacttattcttcattcatgtaattcattatttcactcatttttcagaagagaactttgaggctcaggaaagttaggtgatttcactgtcacagagcatttaagtcacagttcaattattatttattaaggggtgctgaattaggtgcccctcgttcacgtacgcctgttccatctttggatttaacccactatatgatttatctatatgcgtgccaggaacatgattggtaagactgatttacaccacctcccaaattgtactttggctctcagttctcctccctctctcatttgtccctttggagaatgggtagagagagctagagctggaaaggcaggaggcagagaggtaccagagataagagccagaaagggagggggtgacagaaagatagaaagaaactccacgtgggccagatgtcctagaaaagttttcctagtttgacatgtatgggattttggagcagattcagttaggaaagattcaagagcagaggaaaaatacgagaaacataactgagaattgtgaacatgatcttcttttatgtgtttatggaaaagcagtgactttcttctgaatttgtttaaagtccttttgtgtgctagactgtacatcttgactatgaccccatacagagggatggggctgtaggcagcatgaccacaggtccccatcagccatggaaaggccctgtttactcctgtcatctccttttactctcaaatgtgccctagtttgagtaaatgaagtggccatcctaactttggaggacagtggcttttgagtgtataggtctccttcccaaggccaagtgctcctctgggatggaagccgtggtcagcttatctctgaatgttcaggcatagctcaggccctaatgcatagcaggtgcccaagaaatgaatgcagaagccaggaagaaccgaactatagtttgagctcaggcctttacactccaaatgccagattcctcctactacgccggctttggttgaggagctctttgaacacagtgaagcaattaaagagtgactcctggtgtggagccacctgcactgcataccagagggattcacagaggggagctgcatattgtagtagaaaacagctcctaagcttcccacttcagagcctgtggggaagaagcagagtggggctgaggaccgccctccagaaaccactgtcttggtcctgcactagagcacatggcttaagtctcctcctgcatctcttgtgggcaggaggcaggggattataatgaggtcctaactctgaacacaaacatgccagagaggtttgaattagaactctccagagaggaaaattaagcttcaggttttagtttttaaaatgtgcatttatttatcagtgtaaatagcttaagcacagtcttaaaaattggaaactaataaaaaatcatctataattctaccatttaataaatgtactatgtgcatttataaatttttttccaagatttttttttccctttgtaaatggtttttctgtacatagttatcatcataggctgttgtattggttatccattgctgtgtaacaagcagcctcaaaatgtagtggcaccagatgctcaggattctgctgagtggttcttctgggctgggctaggctgatctcagctaggatcactcatgtacttgcagtcagtcggtcccaggggcctcccttgtgtcaggtggttgcctggctatcatgggtgacaggctagtgactatgccatgtgtttctcagcaggctagacgagcctgttctcatggtgacaagatgcagaagcagtagggaaagcagaagctgcaagtcctctagaggtccaagcttgaaactcacactgtcacttacaagcatttgattggtccaagcagatcatgaggctagcccagactcagtggggtaaagaaagtttatttcttgatggaggaactacaaaatattgtggccatttttgcaatctatcaggactgcgtgaagttttttacctttccatttttaatttattatcgcattatgattttttccttactaatacaaaggattcatgacattatttggatagtagacagactacagtttacttaagcatctcccaattattaaacataaagatgacttccggttctccagcacataaataaagctgcatggaacatcttgatgcagacaggtatttctgtaattttgattgtttccttgggatagactcccagaagtggattcaaccaggcataaatggtttttgatattctgataaatgaaagaaatatggattaaataatacatatgccaaattgccctgcaaaattatgctgctttacctccagccacagagagaaaagggattttcttttcttttttttttgagatgaagtcttgctctgttgcccagggtggagtgcagtggtgcaatctcggcatactgtaacctccgcctccaggtatcaagcgattctcctacctcagcctcccaagtagctgggactgcaggcaccaccaccatgcccagttaattattagtatattttaattttttagtagagacagggtttcgccaggttagccaggctggtcttgaattcttgacctcaggtgatctgctcaccttggcctcccaaagtgctgggattatcagcctgagccgttgtgcccagctgagaagagggattctcagcagcagcctggactcaggcatccttgcagggcctcctggcttctcttgattcattttgttttcctggtgcctcatgccaggaagctggaatgaagcacaactgggcagacccttccttgggcaaaagtattagtgtctgtggtcattgttctctgacagtcagttctgtggtacataacgattggttcaggcccctgtgatcttcttgtccatgtgagactggatgaggagtctcctggaccagtgatggtaacacctgcaccctgagctggggagcaggtggtatcacagacgagctcccatcccaggctggctctcacagtccctttccacagctgtgttaccagcccctgctcaatcatgtttccatgtgattctcatggaaaccttgtgtgattggcaacaccaagatttgtcccacatccagatagagactaggggctagaatacctctcccctgcccgtttctccgggcttgacatttcagccagacacctcttccacttcctcaaaacttatctgtctcctcttttacttcctcagttccttgtttgtctaaaacaccagctaactgataattgcatttatagttactatgttttcctcctagataacaagcttcattgaagattttctaaaaatatttggctctaatataagggaaattgggatcaccatgagcagtgagttggtgggagagagattgggggtacgtttatggaaaatcacggatccgtgggtctggaagttaaaagaggactggccctttgagcaaataaatgaagagtaagctggagagcttgtgtgtatagcatttgagggcaagggctctggagttcaacacactcagcctcaaatcacctacccattattggtcgtgtaaatgtggccaagttacttgactgctctgtgccttggtttttccatctctaaaatggacataataacccatacagggttattataaggattttgacaagaaatggcaggtagcaataattacacctactgaatttaaaaagtggctcaggcacaagaggtgagtggcctgttcaaggcagcatggcctggaagaccttcagcaggggccagtaagcttactagccctcatacccaggaaagcggtttatttctcctcccacatcagcatccctctcttcttcctatgtcggccccagaaggttcacaccctctccctcttaggctccttcctcattccgaggcctggagggtctttgcacagagaggaatctgcttcctgcctagagcttggagaaccccaggccttccgcattcatgaggtccaaggccaggcaggaggcaaggccatgggcccaaatctgtgccatgagtgtcaacagaagatcccaaagctggagaccccaaataaaaaccccaagagatgtgggggcatcagcttcctcagactcaacccagcaccattcagcagctttcaagaccaagaagtccatactgttctcttgctcgcaagatactcagcctatgaaatcctcagctaatggagtcctcagagcagcatggagccttgggggtgattttgaggaactgacactgggaaacagcctagggtctgtggtgcgcatggtgggcagcagcccttgcctgtccacaccacggaccagctaaccatagacgagttaagagtgacagcatgctactgctagcgggggaagctgcacgtgccatggttaaggaccccagggctgggtctgtgccccatcatgttgcgtaacaagaaagacaaggattgcaggtgctttcccacaactaaggtgggtgcagctgctgggaatgggagaaacatttatagatctaaggatgggcaggaatttagaaaggtaagggtactgtctgccttggctgatacttttatttccttctatccataagtgtaacaaaaaaatttttttaaatgctatgtaaagatagggaggtttgaaatttttaccaacaatcccaatccttgaacacaaagactattatcatatttgtgactgttgaatattttttaaagacatgttaatactacagggaactgcatttctatagaatgcactttggaaagcattgccctacagtatttataaatttcagaacacattttaggatctgccttgtgttgtttctgtcatcattttacatttgctagtcttgacttccaaccacccaacacgcttcctgagggcagggcaaacttggacattattgacagaacaagtgcccaatctgaaaatgtgtcacattcctgctcaggttccaaacatgtcatagcggatttatgggtgtaaattatactgtttgctcaaaacactacctcatcttcagtggcgtagtgacagtgaccttcaaactatggtggcatcttagctataggggtgtccctcaaaaagcatgggctttgttgaagcacaacttactctgctgtgtgacttaagtcaaatagcttaatctctctcagcctcaactttcccacctgtaacctgggcaggataatagtttttagcttctagaacagattaagggtggtaatatgagtggaccatttagagtagctcatgagataaaactcaaatgctagctgttgtcatttggctgttaatgttatcttgaaatcccacagtagtcaatagtggatggcattaattggaggagggaattgttagataaaagatggttactagatgatagaaggagattcaaattattgactggcagagaactgtttatggaagagttcttggctcgtaagagcctcagttagatagagcagggccattggagggagaccagttgcttgaatgcaagctgttaatcctcagggaatctccatggctcagccagatcctggtctgtaatctgctctcaccacgggctgactgaatgagctcattgtcatgtaatttaataggagccaggtgtctgtgatttccaagagcgtgagcagaatcatcctgcaccccaaactaggagggggaaaaacacctcgcagaagcacacttgtccctagctgctttccatgtgtcagacagagaggaaattgtccaattccaaatgcattcctatccttctcgggcgatgagagaaagtaattggcatagtttgagtgaaatgaaggtggtggtttggggtatttggtatttcttattggcataaaggaaaacttgtattttaaataccccctggcttcttgaagaacgctttctctgctgtcactgcggcccttgtcaaaaaaaccttagctgaaaagaaaaaagaatgcacagaaaaagagcagcagagtgaaggctcagtcaggcggtgggtctttttgcgtgggtatttgaaggaagaaggaaggtgctggagggaaagtcaggctgctctggaaacatttcagtcctggaacacctggtctctaaaggtgccatcaatagcacacactccccaggcactgcaaagtgggcaagcaggtggggtttgccagtgagcaaccctcagggctgcagaggcgggaggggcagtacggggagaggctctattctagggacccaacaatcagtgactgttcatctccagactcagcctgattactgatgcacccgagctcacacagacctaagaggcagatccaggatgtgaacactggtctggctgatgctcaagactgtgccattcctctgccctcatgccatctcctgaagttgaaatctcaaacttggctgtgtcaccactgtcctccttggctgggagtgggttcataatttacaaaaatccatcaggacactcccctgggaccacctgccttcagggtcttgaggcctcaaaaagttgccctcagggattagacctggggtcacaatgtgtgcaatgtgggtgtgaactcatgtgtccagttgctctcagcaagccaacaagttcaagtcacttctccatcccacggctttgctcttgtaacttgggaacaaacagtaccccatgaataagttcacagaggcagggttgtgcagtagtgacacgcacaggctcttgaggcagtctgggttccaatccacccctgccaccaggatcgccatgtagggttgtgtggcttatggcccgttccagagctccaggccaagatgacaaggggggcccagcctgtgccactctactaagccatggtccctggaattccaccgacagcagggtgtcttatgccagttctacaaagtattcacatgggcgaggcctggccctgtgtgctgctaagagctgaggaatttggttgagttacataccctcagtgtgcctcagtgtctttccctgtaaaatgggcaacataatgtatttctcctctgggttgtcatgagcattcaaggggttaatacccagaaagaacttagatcagtgcctaaagtctggtaaatactcaaaaacaagtagtaaatatctaagaggctagctgttagcatttgactggcatttttaagtgtgttttgctaaaggccaaatctgaatccatagtgttttccagttttatatgattttgttctaagatccagtgtaactatcaggaatcctgggcaaagccatcagagtgctgtgagcccctgccagccatcccgtctcatcagcctgccctgtgcagggcctcctgagtcccccactcaggggatcacagacacagtgcagggcctcctgggtcccccactcaggggattgcagacatagcatgggtgcacctgggtcccccacacaggggatcgcagacacagtgaaggtgtaccaggtcccccactcaggagatcgcagacacagtgaaggtgtaccaggtcccccactcaggagatcgcagacacagtgcaggtgcacctgggtcccccatgcagggtattgcagacacagcatgggtgcaccgggtcccccacacaggggatcgcagacatagtgcaggggcacctgcatgttgttcttgcaccctgaaatggaataggaaggctggcttttttttttttcttttttagctcatcttctgttttggaccaattaaaataaaggcattttaaataggccctgtggaaagggaactgaagttgtttccccaggctgagctctgcaccagaggtcagggcaggattaataaggaagctataaatacaaacaatggcccatgtctctgtgggcaatgtgctctggtttgggaggaagggagaaaattaaattataatgggaaaatataaattatttggatcaggataaaaaggaagaaatcagtggtgtctgaatgaatctcagtgaatctgtcagaagagttgtgaggttggctcagtgtaggtgcacaaagatgcctaggaggatggtggaacagggccccacacagacgcaggtgaaactccagagtcctgccttttactgttagccatgccccacctgtggaattcagtgctattctgagatgagagatgattgtatttgtcagattttctatcaaagtaaatatagatggtcacccacccagtgaatgtgattttagcaccttccctgttgcagaccctcccaggtactggaggtttagagggaaacagagccagctctatgttgccctcaaggagcacccagacatatcatgtggccaagatgattgcatccaagcgatgctaattgattgcagccttgcatggacctggccaggtgctacagctccttggtagcacttgctcacttttatttcatggtacctcctctccccgctagggggcaaatgtcattatgatgcccattttacagataaggaagctgaggttcaaagatatgaggggacttcctcacagccaatatgtggcagagtcatggttcaaacccaggggttcgtaccttcaaagaccaagttctcatccactgtgcagacaaatgttctgacagaggacaggcaggggacagagagtgagagaaagagagagattgtgtgtgtacatgtgtgcacatgtgtatggcagtggctctgtgtcaacctggaaggcttcttggaggtggtgatgtctagtggaatcctaaaggaaaggtcttaaatgctacactaaggaatttggattttatcaacattttttttcttttttgagcagaattcagacatgattatatccccccaacaaatctatatttaataagcaactccaaggtgccagacaatcttctaggtgcagagagggttgcagacacttaatataagatgtagtctctgccctttcctagcttcagtctagctggagagatgaaacacagatttatttagaagataataagtaacagtgtcaataaaccaatgccgagcgccaaataaaagtcagtgagtaggtgagtggaggtcagaagagggggcagtctgggctctgggttggtcaaggaaggctcccagggtagatggagagagagaggttggaggggttatggaagattccagaaagggtgcactttgagggctggggcctagtgtttggcagtactagttcccccatgcttagcagagggcctgcccatagcaagtgacggtgcatgctggctgaatgaataaatgttggacccaatgaaaagaaaggacaaacggttgagagatgaggcataacaaacggactgtgggttgcagggatgtgtgaccactgagcctctacccagcccaccaatacagtttagttgacttgtggccccaccagtcagatgaccttccttggctttccatttttttttaggtcatgcaggcacatctgtgggagaagcaagtagactctataggggaaaagcaggagaaaagatgggagaagccttgggtgacagaaggaggaagccttgaatgtgagtccaacatgttagcttttttcctgcaggcaggaggcagccattgaggcctctggacattcaagtagcaagaggtaaatgatttggggagattgatctggccctccaagggggaaagaggaaaaatgctataggagagggtttcaggaagtgactcctgctatttaaaacgtgcaaaccctttcatccagaaatgtgacttctggagatttgccccaagatcgtggaacaagtgtgaagaaacaaaaacaaacaaaaaccagcaaaatgcctcctggaggtccttgcagtgctgtcttgggtggagaaaactagaatgcagctttctccaggggtgcagtgcagagtgagggagcttgctttttctctgctgcctctcacctcagggcctctgcaccagatgttccctctgcctgaaatgcttttccctgccaggtcacatggctcaatccttatctttgctgaaatgcccccttctcagcaagaccttccctgatcaccctattcaaattttcttctgtagccccaccccctcatttacaccacacacctgccgccccaggcacccagcctcgtgactatctgacatacccttcattttatttgtgtatctcctgtccctctggaatggaaactgcagtggcgattgttgtctgttttgcacacaggcagtatcctcagtgctaaagcagcgctgggcgtagtaagtgctcagtgaagatctgttgaatgagtgaatgaaggaagggaggaaggaatgatggtgggtaaatcggcgagtgtgtggcctacacaggacattagcttgagcaccagagagcagaccaaggcaggtccttggttcctgtgccgacctgcattgcggaggactgcggggtcttggtagatgaagcctggcctgggtctttcagggccctctggctggggccaggaggcacagctgcagtggacactttcaaactcatcgtgcctggccttggcactcggtgggctcatttctggtcataatgacacctttctaaacatagctacacaaaattaaaatgtcacagtgcaaatgctgcagctgtgtggtactagaaagaacactaggtcttgagtcagaagagatggactcaaatcccaaatatcaagccatctctctcctgggtgtgaccttgcacttctctgagcttcagtttcttcatctgcaagatgggaatggtaccagtagctgtgtcacagactgttgtgaaggccgaggaattaagcacggcgagagatttttggaagctgcaaagcatcacacattggacatgacttttacacataaatatgtaaaaatggtctcctgactgcgtccttggcttcctggcctgccacatggaatgagggcagggcctccctctcagcacagactggtctcctccaccagcccagcctccccttgtcacagtgagaaggagccattgacccactcagaagccactcacttctctcttacatggggaaatcagcaaaccacaaccatttatgaatcctgcatgttcccctggtcttgtccaactgtatctgctaccattcctgagtggaagttaaaaaaaaaaaaaaaaaaaggcagagcaagttgaagatgggaaagaggtgacctaaggtgacaaagagtcaatgtagaaggcagatatgtctcatcctcgcagtgactaagattaatgggcatggagtgtcaggagccctgccttaggaagaactctgagactggctccagaattctgtaaatccaatcaagagtgttgcaatcagttagcaatgtctgcctcaggcaagggagaagaaactatggtctgtatgtcatatctaatattctcccttatatctaaggtaccctctgctgtgagacatgcaatcaacccgatgaagctttttaggaaaaagtctattgttacatcaagtttaacgtaaagctgcctccttacatattttaaggtcagcctaaaggtttctctgcacatcgtgaactatagcaagtagagatgtaaacagactgtagcctacacttgtgccgatcaatgagttttggccaatcaaatgtggccaactgtttgaaccatgttcaaacagggcaaatgctgagctataaccaacccagctgtttctgtccctcacttctgttctctgtgcatcactttcctttttctgtccataaatctttttccaccacgtggctgcgctggagtctctgagtctactctggctcaggaggctgcccaattcaaaatcattcattgctcaattaaactctttcaaatttaattctgctgaagtttttcttttatcactctattaatgctagatgttgactattgaatggatccaagtttcaggaacttacaaaatgtgtgtgtgtttgaaagaaggaaatcattacttgctatcccttctctatcaaaatctacttgagcttttcaactaaaaattcaatgcgtattctttggggtataaataaatgtgctgaatctacctgggcttttcccactctgtggcttcttgtttctatgtgtgatgcgaaaaggaagctgtggaaatggggaggagattcttccaggtgttgggaaggcttccaatgcccagcatgtagtaggtgctcagcaaatgtttgttgaatgaattttcaatgatgacctcagtttctgcataacttttcatgattcataaatgctgttaccttagctaagtttaaatgtagtattttatctcctgtcatatatatttttctctctttttctgtgagtagacgccatgataatcaatcgggataacccacgaggacgttgtttcattctttctgagtgaggggatggggctgatagaggaagccggggaggggtttgcctgctgatttcttcctgcttttgtgtttgtgtttgccgtctgcctgtccctcacatttccctcagtgtgttcctatccttggatccctaatcctacagcccaggactttctacaacggtactactgacattttggatgggataattctttgctgtggggggactctcctgtgtgctgtgacatttagcaatatccctggcctctacctactggataccagaggcaccccccacccccagccgtgacaactaaaaatgtctcaagacacaccacccaggtgagaaccactgcttagcctccccggggaacatggctggttccttctttctgaacagtttcagaaggaacatcaagtctgcaacaagtcttctgacttcatggtccacaccagtgtcaggcccaccgtcctatcaaccctccaggctcatgtctccaaggagctctctgatcattccctggtgtctctctcgtttgctgtctgcccctctcccctgggctatgagcgccacaggagttttttctattttgattatctctctatccctggggcccagaagtccctggcactcaataggttctccagtggataaaggtgaggacgaggtgactgggggagcctccctgtggagtgacgtctccatgccatgaaattgccagccctgggaagtcatgaggaagaacactccaggcagagggcacagtcaccgcacagctctcaggcaggaacaggtttgccttgtggaaggctgctggggaggagaggggagcgggattggagaagggtgctccaagagccagaaaagctagtcaggaggccacagtgaggggtgcaaactcagttccaggagtgacaacaagccctctggaaacctcccagatgtcccaaggtccacccctggcccactctcactctcctctctccttgtcgcccagcctcactctgggaaggctggggaggattcctaaatctggtctgaactcctgaggctgaagccagagctggtgtggcccccaagtcatatctcagggtgggagagagtccttccatcaaggaggcaacgctatgagggcagctcagtgctcagcccacccctctaaccctcatgggcgggccctcaatcagaaaccacaaattccaggctcagtcagggaaggcctggatcctccacttccggctcctcccggaagtcagcttaaagaaatgatgcggaggaatgatcactgaagagactcgtcattcctggtcaaaccatgctggaggtcaggggtttgttaactcagccttgtcacaggggccttcccttccacctcaatgctacgacagagctggtgttgaaggtctttgacgaaaaagctacatttctgcatttaaaatggagaagatcaggccactcagtatctccggtgtaagaagacatttggcaatagtaacagctaattttttttaatacttaccgtaactcattttacccatttcctgcctagaaaaaaaaaaagtgcagctcactgccagcactcatttcttggggcaaacaggaaataagttaatcttaacaacaaccctgtaaggtgcatagttttattatcatccccattttacagatggggaaactgaggcagtgaagtttagtaattttcccagattcactaaaatttctaagatatgtttaacaaagaaatccaccctttaactcttaaataatatcctctttttaaaattaatgctagaatatggtgcaatatctttttaattgagtgtatcttttgccccagcaattctaccactaggaactgagcctaaggaggtataaatatttagttagaaggatgcagtattatttagtatgtggaactcaatgagaatctccactaagaggggttatttaaataaactgtgatgcctccatataaatgtagctgttcaaaatgacatctgtttgtatgtaccaacataaaaagacatctaaatcatatattttaacagaaaagtccagaataatcacatttttgtaagcagtcattttgtctgaggactgggatttctattgacttttaatttcttattttcacgtgtctatagtctctaatttttctacaatgaacatgtactacatttataataagaaagaaactcaataaaagttattgagtaaaagaataagcagccagaaatctgtctcttctggggaattagtgagcctcttcctccctgagagtagacgctatggctgctttgctggaaccttccatttgtcccaaatgctccactctctgccaatgggagacggggtctatattcacctggtcccttctgcgtgaggccaccttggcagaagtcactgcccctcccaaggcatctgaccctgcaaaaccctcttgtcgtctgggttctggtaaactccccattccctgttttttttgtgggtatacagatagtaaaagctctgctgccctggccctggttttaaatgccccctggtgttttctctatacgccactgacaccttgatcatgagtcaaatcacctgaacatagagtagcatctgcttcctgttgagaatccaacgaatacatttacctgatttgctctctcttcttttcctaagtcctaacttcctaaaataaaatgactctccaattcacctgtccaccttggccttctctccttatacccagtcttgcccactagacgtcttcgtttgggcaaccacacagcttataagcctcctgatgcccaccacaggagtcttattttgtgctgccacgttaaattctctcttccatgagcaccactctttcactttccacccactccaaacctgaaaatcacctttctccacccctcctttaattttttacatctcatcagtgcccaaaacttctgaaatcaacctcagtaatgtttccttcaaataaccccttcccggctgggcgcagtggctcatgcctgtaatcccagcatttggggaggccaaggtgggtggatcacttgaggtcaggagttcaagaccagcctgaccaacatggagaaaccccatctctactaaaaatacaaaatttagctgggcagggtggcatgcacctgtaatcccagctactggggaggctgaggcaggaaaattgcttgaacccaggaggtggaggttgcagagctgagactgcaccactgcgctccagcctgggctacaaagtgagactctgtctcaaaaaaacaaaacaaataccctcttcccatcatttctccagcccttgcctcctcaagtcctcctgactgggttcccttggctccctgcttccccctcagtctgttatgtgtgacttctgggtaaaggttcttaaaatacaattcagatcctatccagtcccctactcaaaactgtgcccatgggatcaaaaccaaactctgcaacattccattcagagctttaagagtacttttcagcctgaggtctcctcctcaccactaacacccttccctccaatcaaactgatccattgtacctacaaaaagcccgtcccacctcctagcctttgttcacactgggttctctgctggatcaccatccctccacatttccaggtgtccctcaagactactcagcagcagctatccatacaagttcctcaaccctggctttcttgccctcaagtaaccagttcatcctccccagtcatatagccctctatttacatttcttttctggaagctatcatttttcacgtgccatttgagtgagtgtcctcgctaagacgatattttctttgagggcagtaacctttcttatatgtctctgtatcccatgaacttagcaaaaaacaagggacagaacaggtgcaaagtctacgtggttagtgaatttaacagatcttcctaacgtgtaaacgtcgttgtccaggtgaatggaagaagtgagctgagatagaggggacagacagagtcagtgtccagtgctgacctctgaaatggaaaaacatggccagtccttaggaggctgcagaggccaagaccccagtgaggtttgggggttccacagcagaggaggagctgtggaccacagcaggaccccgatgccatcagcaggggaggaagtaatcagagaggtggaggaaggaagccaagggaagtcaagtaaacaccaaatattccctcccggtccaatgctgtgacctgcataagccaccactcccccagtctagactctacccatggaagaaggaagaagatagaactctggatttgaatataattctaaaataaccaaatttatctgaaaatgactaggctgagttttctgcttcaaccagaaatggagcttggagtcagaaattatgtgaaattatagaagagaaagtcaccatcttccatctctgagtcgtatgatcattttagacataaaattgtgcacttacgatgtaccaagtgcttaatatacgtgatctcatttcaccagggaaactgtataattcattgctttaactgacaaaattctgcaactgaagaaggtgctgttaataattgcattgggacgcaggcctgagcaggccatgatttgtggctgtcctacatctgaccctcacagtatccatgggagaaggcagcatgtttatgccccctgacagctggggaaaccaacacttaaagtgattaagtcacaagtccaaaataaatgacagagctgcagttcaagcccaggtggtcatttaccaaaggccatgctcttttcactttgcatgggactgtgaccgctggctctacccagcttcccagtgcgacccttccccgcccactgtttctcttctctggccaacggaaacacaatgagaccacatatgtaacattacattttttcatagccacattgaaaagaaaaaggaaccaggtaaaatccattttaatatgatattttatttaacccaatacagttgaggcttgaacaacacaggtttgaactgtgtgggtccgcttacacatggcttttgttcagtctctgccacccctgagacagcagggccagcccctcctcttccgcctcctcctcagcccactctacatgaaaacaaagaggatgatgatctttttgatgatccactttcacttaataaatagcaaatatatgttctcttctttatgatttctcgtaataacattttcttttctctagcctcatttactgtaagaatacagcatattcccagctactcaggaagctgaggcaggagaatcacttgaacctgggaggccgagtttgcagtgagccaaaatcgcaccattgcactccagcctgggcaacaagagcgaaactccaactcaaaaaaaaaaaaaataaaaagaatacagcgtataatgcatgtaacatataaaatatgtgttaatcaactgtctatgttatgggtaagtcttccagtcaacagcaggctattaggagttaagtttctggggaatcaaaggttatacacaggattttgacggcatggtggttggcactcctaactcccacatcgttcagggtcaactgtatattcaaaatagtattcaaaatgtaatcaataggaaatagtcattcatgaaatactgcgtcttcttcttctcccccccaaccccacttctttgtattcagtcttcgaagtcagtgggtattttaaccttacagcatatctcaattcagattactcacactctaaggactcaatagccacgtatggctggggtctgccagccggacagcgaggtctagccctgatctgagcaggagccatttgattgggttgttggtacactgccatctggtggacagatgttccttgcttgaaaaaccacctcgaaggaaagtatcagcatcagggacaatagcacagtgggcctcaggatcagctccccggaaagagcttggggttggagggggtgttgttgctgaggatgtccccagagaagatgtacagccatggagcaaactcaagtcacttatgatgtcggcaaaccttggccgtggtgcactcttgtttcctggttgcaaaaggatttagcagaaaatggtaactctttttcagaaggcatatttaaagcagctctttaaaaagcaggagtttctttcacacccagtttcgccatgtggttgtgtgaagggcttctccccagaaatcatgtggtctctcttttaattcacagtaaaaacctttcttctgtcttggcccattatggctgctataacaaaatatcataagctggccttatataccatagaaatgtatttctcacatttctgaaggctgggaaatccatgattaagagttggtgtctggtgggagcctgctttctggttcactgatggcgtcttcttgctgtgtcttcaccgaggggtagggacaaggcagctctctgcagcctcttttctaagggcactagacctatttgccatggttccagcctcatgaactaatcatttcccaaagtccccacctcccaacaccatcatcttcatgattagatttcaatatatgaatttgggagaggatagaaacattgagaccatagcatctgccaagttgtgtcttcctcactcaaattgggtaggtgtggttattccagagtttcagtgaaccaagacgtatttttccaatgtgaataattaattaagaacacttgattagggtcaatgttattctggacttctgaatcactcccacatttgaaggggagttttaaacacaactttgtgtgaataaaatgatgtgtctgcatctctccaggaagcagtgtttggagctgagatgacttggcagggagaagaatccactgggacattcaataacttggcattgagagtgttttcagcaccatgctgtcctcagaatagtgttagaatttatataaacacagatgtgacttgtgccttgaaggagaatacagtcttcccaggagagacatgcaaaaccatcatagacaaacagcaagaaaacagcatcaaggatgtacatgcaccgggcagaatgtaaactggatgtaaaaccaagcatttgagggcaatgagaaaggaacttggttctggtctcaactctgccacccacagctgcgtgactatgtctctgtcacactgcttctcaggtcttcaactttatcgtctcatactgagcaagagacagtctggacaatttatgcttctagaatggggagacaagaagaaaagaaagatagatacccaaggacttcagtgactggctcaggaagaattactcagcagtgagggggccagcatgagcccaggggcaagaagccgggacttggaacaggaaggaaaggtgctcagctggctaacctagaggaaagtgattggctggagtgtctggtttatctgtttcagggatggttaaagattgccccgttaataggcaaaaattgttgccttaaagaacctagaatctaaaggggtctttgacataatacagaataacaggtcccagagattattttacagaatgttagtacctcatgatattaatagatatataacaaaacagacttctttgccacaagacttctcagtacctttaacattttatgattttcccaaaggacaaagagtatgcagcatttcccagacttaaatttaactgtgaacacctgttatcctggggcaggcggattgcttgagtccaggacttagagtctagcctgggcaacatgacgaaaccctacctctaccaaaaatccaaaactcagctgagcatggtggcatgtgcctgtagtcccagctgctcaggaggttgaggtgggaggactgcttgagcccaggaggtggaagctgcagtgagctatgttcacaccactccactccagcctggacgacagagcacaaccctgtctcaaacaaacgaacttcagtgactggctcttaaaaacaaacaaaaacctcacagaaccctcactgctctagtcctgactttttatagatagggaaactgaaaagctaagaggcaagtccaaatttcacaaagatagtggcagagccaagattggatttttggtcttttgactctaatacccagtgaatttctttttctttcttgttttttttttttcaattcctattatacactatttaagacacacaaacagataaaaagactaatacaagatatccatgcaccaccacctagtgtaagaaataaaacatcaccaacacaataaaacccccttgtgtacctctctccatttgtctccccaagggaacccatatcctgaatttggagatataatacatgaaaattctggtggaatttcaaataagtcatattgtctttagaggatcttcttagcatctcccatgatgtctaagttgtttcaaaacaaaaccaaaaaccccacttggcccagaagagcaaagattaaaagccagcctcgaggatccccagcttggctacctgcagctcacagcatattggaaaaattttatgaatcggtgaactttttcattctcaaatgggctcttcagatggtttattaattctgttagatgcgggggtgcgtctggctttattctgtgtggaatttttggatgaattcactgcctcaccccctcccctccacaggccagatggggagccgggtgctgtataaatgtttaattgtggctcagtaaaaatatttgctttcagtagctggaagctaccaaacggaggtagcgctgtctactagagttgccagacttcattctaatgagaacagaaataaaggctgattaaatcaaattccccatagtgtagaaccacttaaataaatgtttcatattgtttgcatgatgattttaaaatgtaacagctgcttatgtaaccattaggctggacataaatcattcatcgccatcactgccgtcaaagcagcactggctctttttcttctgctgctgacatttccattactagggagcttctcagacatgctcttgggttccctgtccttacccaagtgcggggtagcaggagactgagggagggatgaggaatgaagagcaggcacgaagctgccatttatcgaaggcctactttgcacatgtcccattgggctggcattgtcacatttcatccttcccacaaggaggcattactgttcccattttatagatagggatgctgaggcctatggaaatgaagtgagctgcccccagagtagggaatacagcctgtatgtgaactcaggtgtgtctgagccttggcaactcacacaaggctgcccgagaacaaagggtgcatcccaccccgaggctccacacacctcaggccttttagcaatgatgagagcagtgaagaccagaccaagactcagaaaactgcagaatcctttcggctggggctaggggtggggcagggtagatactgatccaaaggatttggactccttttcctagtccaaatccccatcgtctctcccctgttcactgtgtcagcctcctgactcccctgcctccattcttgcccatctcaatccatcattcacccagtagcctgagcgatcttttaaaagtagaagtcagattatgtcattctcctgctcaaaagcctccaatggcatcccaccactcttagaataaagcccaacctcccaccatggccctcaaggccttttatgatatggcccctgccaacatttgctcattcgttcctaccccactcctttatctgggcgtcttggcttctttctggtcttcagacacaataagctcatgcctacctaagggcctttgcacatgctggaaccatcctcctcagacccttcccatgactagcttcaacctgtcattcagacctcagctccaagtcacttcctcagaaaggccctccctgtaccctggattgaaaacagccctcccctgcacacgctccacaccatagctctgtttcatttactttacagcactgaacactgtctctatttcttatttgctattttcctatcccactataatgtaagctccatgacagatatctgggcggttctccactgcttccccagccctagaatgctgactgtaatgtagtaagtgttcaataactattacttaaataaatgaattaacttgtctcattcttttcccctgcatccaagttgggtgaaccctgacctggccccttgaaagagacaatttgattctgaaaaccaattcttacctccaggctcaggccccatgcaggagtctttctccaggtggcctggccatgcaggtgatggcagtcatggggggaggcagagagctgctggagaaaagctaggaggccctttggggttccctgtattcataggaaggaggatcccttggatccatgcccccaactctgcaaagctgagtctaaaggatacacagaacacaagacatccttctgttgccaccaaagcttctgacaccccattttggctggagagagacttgggcacagttcttgaattggctgcaactccaccctccctcctgcaagtgcctcttcctctgccacggaagcctctgtgccatgaagaagaccaccagacctctccaggtgagggctctgggtgtcagtcccctacgccctagcaagatctggaaggcaggagccaccttcctgcaggcaggcaaggtcctggaaatataaggttgtctgtggccattgaccatcctactgcttcctggtgacagaaaatgttgcattggtggcagccatggggacagcttcctggttcctgaattgcagcactggtccgtggcatgctctaggactcaggcattttctcagcagcttttgaggtagtggccccgggcaggtcagtttggcagtgtgctggggattattcctggaggcccagcctggtggccgcttctccagcccttccagtgatttggaagcggctggttccttgcagtaagtcccttcttcctcgaaccactgactgatgcagagctcctccatggtagggactggttctcttaggcccctgtatcctcaggcccagcatgcttgggaaaatgtttgctaatgctttgtgactcaaaaggaatcacacacacacacacacacacacacaaacacacacacacagtttttaatattatcagtcatatcagccccctgaggcagctgctctgttccagacaaaccctgttaataacattcttatcctctttgtttcattttccagctcaatttggaagcctgaccttgtcttgctttgcctcctactgagagttaatactgggacatactgaagggcgaaggcttgagtcacaaagtcacagggataaatcctagatccagcagttactgtctacatgacactaagcagattagttgccactgggactcagttttaccagtctgcaaaatggagctatcagccgcatctagcactaggggcgctgtgagcatggagggcagtctgcacacagaggcttaacacagtgcctgagcttgcaggtgcttggtaaatggcaattgctgtcagcattgtctgatttacctgaaggaacagttcacactccacccagattttcactgcagcagccaagaaagaacttctgggaaagcatctgcttccacccaactcccaagaggggttcgtagagggtggagctgagagcccgcctcccctaccagcctgcagaaagaaagccatgttttggcctcagggaggagaaacccagataaaaaccaccccatgtgcagcctttgcgtggccacaggaccagctccacagggagagggaagaggcgcggccgcaggaccagctccacagggagagggaagaggcctcctttcaggggtggggagctgagggcaagacagaccttttctgactcagcccaaggagggctggagcaggggctgcaggttccctgctttctgctacaacacagggtaggggagagtcatggcctcccagagcctctgcaggttcacctgccaaatggaaataatagcatcctcctctgcaagtcacagccttaaagaggtgctgagagtcactagttagacccaagccagctgtttctggtgcattaggactatcgaccagaacccctgcattcccagcccctcctgcggcctccaacgaccaggagagaaaggcgtaaggtgtaagactctgggccaggttctggcagcttatggccactcttttcttgtgtctggacaggagcattatagctacaaccatctcatctaatcctcactgctgccctatgaggcgggcattcttatttccccagttttgagataggcacagaaaggggaagcgacttcccaggttcacattgccagtaagtggtaggactaggccctgaaaagcacagcctgccatggggaagagaattcatccccagctgagaaccactgtatcctcacccaggggttcccagccaatgcaaacagggacgtgaccagtctccactggtcccctgtaccaggtctccaccttgccggcctgctgctgggccccaggactgctcccaggctgcacctgtggggtctgccacctcctccacttccttttgagaagctgctcccaccccttcgccttcatctcaaaggaaagtgtgctgccaggcagctggagccagatggcccagagacaactcttcccatcacacttcctgcagcatctgagtccaacccccaactccagagctggcaagctgcccagagcctcccagaggaggcctatgggttaacttcacatttagtattttcagcatatggtagaaagaaaatagtgttgttagatgtacaagtgtgatttcccctttccagaatgccttcctctctcctccacgtggtgagctcctattcatacttcaaaaccatgctcaactattccctgcccacctgtttccttccactcctccccttctaatgtgggtgtgtcccagggacaacatctgtgttcctcagtgaagttgagagaagcctaaatttgctctacataagaaaaaagaataaggaggtaaactggaaacgggaggaggctgggaaacgcagggttggtggaaggacttgtggggatgtcgtggcagccacctgagggtaaggaacgtgacagccagagcagctatgcttaaggggctttgccacagtgcgaaagataggatacaaggtcctcttcagtctctccatgaaaaccacagtcaaagtacacattactcacccatgctttggagctagatttgggcttaatgctgtctttttttttttttattaaaacaatattccaggctgatggaatttaacaacaaggaacataatatctgacacaaacatagcctaagccttgatatttatcatcttatatagcaagagatcagggtgttgagaactttagagcagctccgttatgtccaggctctgggcggtttctgggattctgtctgctgtcccatcagtactcacggggtggctgtgtctgctacagacatcatagcctcacgaaaccacctacactaaagccaataggaagaaaggtgtgtgtcaccttcaccttcccaccctttatgggggaggaaaatatttgccaagtgacccacctttcccttctcaatgcccctttgatcaaagcctggttctatgtccctgcccagctgcgggtggtgctaggaaagaaggtatctggggtttgacagtctgctgtgagggctaaataaaaagggcgtgagaggtctgccctctgcttgtactcctctgctgagggagaacttgctgcttctggataccaccctttcccatcgtatgatagcctgaagtgttcagaacttttcccattaaatcacttgaacccgggaggcagaggttgcggtgagccgagatcgcgccactgcactgcagcctgggcaacagactgagactctgtctcaaaaaacaacaaacaaaattgactttctcccactgagcccaaggtgctttcctggtaacttctctttgacccagtcctgcctcctgcatcttccttcagcaaccctgttctccacatcagccaccagagggaacatcttaaaacacagggctagactgggcatgccgttgtctctgctaaacccctcactgagtccccagtgtctacaggataaaatccaagcttcacggcattggaggctcaccacagtcctacttcagcctagtctctcttccttattcttcccctacatatatatgtatatatatatatattctcatactgtaggtgaagcaactgaaatgctttttattcccctgacactttttgtttttcaaattcttgttgtacaaatttatgggggacatctgcagttttgtcacatgcatagattttgtagtagtgaagtcagggcttttagggtatccgtccccacaatgacgtatattgtacccatcaactaatttctcatcatccactcctcccccacaccctcacccttccaagcctccattgtctattatcccactctctacatccatgtatacaggttatttatctcccatttatgggtgggaacatgtgatatttgactttcttcacctggcttgtttcacttaagataatgaattccagtttcattccagttgctgcaaaagacgcctcacagaattttaaatgcttatatatatacatacaccccctttgtatttgcctacacaaaactaacaaacctttgtgaaatgtaacctacaggaaatatgatcatgtctaatgctggacatgaagcagatgcaatacacaaatccatgaggtagacccaggtatttcagatcctgaccttgatctcaggtttacttattagaccacagaccaaagactcccactgatgtccccacagatttcaccacttattcctcttgtcccacacactctactccaaagtcaccctcctctagaggatagtcacctgagatacttcagcgaccctgctcaccttggaaaatcaggtgacaggaatcatcagttaagcctgtggacagtaagcatctgttggtctggatggtgtggtgggcggaaggtaggacccaataggggcttttcatggttccagccccaaacctctgaccatgccagtgcatgctgaaggcccccattccatttatggtcggggccacatgatttacatttactgtctcaggttcttcttgtaacactgtcttctccaatttttgataagccaatgcccctgacacttctatgttttgttcaaattgttctacttgcccagcattctcttccaccttctccagctgtcaaactcctacacacccttcaaagcccagctcatgggtcctctccctgacaatgattccagctgaaggagatgacattgctacttccttggctcctatcatacccggtatggctagtgtagcacttaacattgcttggtgcttggtgacattcccaaacgttcatctgtcctcaaggatgggaacgtcctcatttcccatcatttaggaagtgcttgctaaaccaaagactcagcccctcatcaggaaccagtgaaggacagagctgggaaagagttgtcatgggcatggggactatgtgaggtcatacgcagttcctgggtcacagaggtgacccacgaatggtagctgcagcgttgattgttgcccctactattactgtgttattactgatctcagcccttctcttaagtgaccccttcactagtctcatagatgagcggccagcctgcctcctggatcccagaatttgctcactgtccacgacttcctgtcatggctgggaacattcaggcaggatctggtcccactcgtaggaggggaagacaaagagtgccatccctccaggccctcccctcctgcaggacagatcatcctgcctcactccatctgcagatgctggcaaagcacattccagccctcgcctctgaggcagagaaacagattccaattaagggacttgcggaaagtggcttcattttacaagcaattgggttgtgaattgaagcgggcattaaagtttacaagctaggctggcggaggagccagaaggccttgctgccactgcctgtcaggagacatcttctccagttactcaacaattgtgtggagtgagtgaggagtcggcacgaatcctgccctccatggctgatggtggaagaaatgtccattcattcgtcttcttaaaaccaaggatcaggctgctggagggcacaggatcatctctctcctgataggctttccccttctctagccttatgtgagaatctgggggattttaggtggtggtgagaaaatggggaaagaaatcacattcgttgacctctgcttacagctgggatccccacgcagctgagaaatttccaggaaattacctgggttcaatggaggaacttaacacttcaagctgtcacctggtgggaaagggtggtggcaagaagtaacaagatctcccaaatggatccaaccagagagaaggcctcctcatttccttctcagccaagcccacgggggccctggaagacagaggttgccggggcatccagggtctacacgggctgagctccccagacctggtgcaagggggccaggcattcccgccaaggctctgccacctacccagcaggacccatgagctcagcacctttctggacttgaggagatgggtctggttttggccttttccctccagacttccttctgtctctgcctctccactgacacctgcctctgctgtcccccaggacattccactctcttctctaaggctcaggcctgaggggttgctggtgggcagattccatctcatggttgagctgtttggcctcaatggcattttatctctctctctctctgtgtctctctctttctctttttttttttttcacattgagccatcttcttacagctgaggttttcatataaaaaagcaagttgctggtttctctttaaaagtagggcaatctggcagttctgggcttgtgtaaaaacaattcggtagagctaaaaacaggggcttctgataaagcctgagctcccagcagccaaaggacttatcaccccacaaaaaaatcccttcctgcactcatttatatcaacccctgcccctgcagacacgtattgtaggttttaactagaaacaagaggattagctttatttaaacagcaaaactgcttaaatgagataatatatgtattgggaatggtgcctggcacctaacctaatccttagttaattaatatttattgagcaaatcatcttgattattaaaaagacaggccagctggacacaataagaatgctagctcagagctggcacttgagggttcggtagaatattcatggcttggaggtgggggctatgatacgagcccatataatcagagaagttcagatgggaaatgagaaccacttggtagcctaaattcagagaaactaaagccagcctaacgctctgaagctggcaagtgttcatttttggaaatcagaaagtgatgatgtgttatcccaagagactcctgggacaagatgcagtgagcagccattcacaaagactaccttgaaccgggctctttccctacattttgttattatatcctcgctacaaccttctgaggtggaaattaatatccccattttacagatgcataaactgtctagtgagggtgacagatagtattgacatgaccagaagaataaatataaatgagataaattctctctgaaggaaaggaatagggatttacaatggtgtaaaacaaaggaagtggggcctggtctaagcgatcagggaatgtctctttaaagaagtgacatttaagctgaggtctaaaggattagatgagtgttaaataggaggagactgggcaggagggaaatcttctccatggctctcaatccagacacacaatttgaaccacctgaggttcacaaacacaaagaaagtatcgtgacctgatacagtcccagtctaattaaatcagtagaacccaggtgccgatgtttttgtttctttttattttatttattactattttttgagatggagtctcgctctgtcacccaggctggagtacagtggcacaatcttggctcactgcaacccctgcctcctgggttcgggcgattctcctgcctcagtctcctgagtagctgggattacaggcgcccaacatcacacctggctaattattctatttttagtagagatgggatttcaccatgttggtcaggctggtctcggacccctgacctcagatgatccgcccgcctcggcaccccaaagtgctgggattataggcatgagccactgtacctggctggtaccaatgtttttaaaagctttatggttgaaccactgaaatgaaacaaaaagtaaatccaaagctcatatactctagccaaacaatagccattaatagctattaagtaaatagaggagatgctcagtgataatgagcaggtagatcatcagcatccttgtcatcaccactacatctgcctcctccagatcatttggtagccaagtccaatgtcaaaggaataaaggaaatctgcctctgttgagggcttgctgtatgtcacgcactatgctaaattcttcactgtttcatttaacgtttaccgaaacccttattattttacaaatgaggacgttgaggctcagaacaaggcaccaatttacccaggatttcacagctcatcggggcagtgggggaccctcttccaggcccacctggctgtagagaccacactctttcctgtctccatgcagaggggcctcctgctcactttagctcccatttcccagcctgactgccttgattgggccgcatttctttgttctgacctcaaaaagagttttgtagatttgtgcccacttttctcatcacgcttaagaaaagtgaccaaagctgaaccaagctatctaggttcaaatgctgcttactggctatcgggccccaaactatctgtggaacttctttgagcctcaattttttgttttctataacatgggaataatatcagtacctccctcataagtttcttatgaagattaagtatgtatgtgttaagattcatattaagtgagaattacgcatgtacgcatatacatacaagattaagtatgtatgtaagcatatatatatacacacacatttagaatagagcatgaaatatagccagtgttcagttaatgtcaagtattgttaatattatcctatgggctggagtgagaggcctcctggggtgtttgctttccagcccccaatcgggtggcatcctggatagggtatcatcatacctctccccaggagatcaggatagggaattgtaagagcactcaggttggaggtaggatgtgcaccagggaagctcaggcaggaagctgctgtctttcctggtctctgcagactaggagcagcagccagggacctgggttgactgggggacgggtcggtgggtggggtgagatgactatcacacctcctctaaaaacaagatggggcctggtgcgctggctcatgtctgtaatcccagcactttgggaggccgaggcggatggatcagttgaggtcaggagtttgagaccagcctggtcaacatggtgaaaccccatctctacttaaaatacaaaaatcagccgggcgtggtggcacgagcctgtaatcccagctactcgggaggctgaggcaggagaatcacttgaacccaggaaggggaggttgcagtgagccaaggtcgtgccactgaactccagcctgggcgacagagcgagactccatctcaatccatctatcagtaaaatacaggatggaagggaacgcccagctctcagtcagctgccagcccacggccttggacgccactgatgtgagcctgtctgggctggggcagaaggggccagcgtcaggtcctcagacaatttcctcctggtagcctggcctgaggcccacccaacccagggagccggccctggccagttgcagccagtaccacctggtgcccagcagagggcagcacaggccacaggctggctttttctaggtgaaattttgctacaacgtgtagcctcttgggttcggtgtctcccctgtacttctttgcaggccggagaagtcccggacattatcacagacaccctgcctcatccccagcttctgaggtctttctggactctgttagcatatttcagaggttcactgcaaaccagaaacgggactttgagcttgtgttccagggcagagggccccagcgcctgtaggtgcagacagcgcacccccaacacccccgagtttccgcctcctcatctggagagcggggctggacaggatggtttttggggcttttttgcaagctcaccggggccaagtgagctatttccccttgccattctctcccaggaggagaaggcataagatgatgctgaaggcacaggctctggaagaggacagggccatgcttattcctgccttgttatgtgattatggacaagccttcactgacccttggagtgatggataaaatccgtaccccacagggttacaggagaagtaagtgagggaccacgtgcacggagcccagcaaggtgctcaggaaacaatgctattgtttttcaggttacatcttggggagaccacccagaggaccttctttcaaggacaggtacctggaatttctctccctttcctacatcatcttcttgttttcatgcgcagggaggccaccactacctgagccagaccactcccttcttaagccagggcctgcaaattgctgcagcactgccccctcgatctcaatcagacacccacattcctgcccaccatgcccaaagcccttcattgaccaagaccctggcctcgtcccaatcctctgtaaagtacacatgcgtcttcaatccaccctacaggactgtggagccgagaagatgtggggctgagcatttacctttccataagttctccagggggttctgaggcccacagaatcaaagagccactgctctaggcaatgagatagtattctaaaacaattaatgaaggcccatgatggggacaggagagccattatgcaaattccggccattcgaggttattaatttgcaggagagactgtagacgctgggtaaagaatgcccacaatattaggcagtcaggaggctaccctgcagggcctgttcctgctccgcctggtgagcagaaaggtctcagggaccagctttaaaggatgacaggcctcccactgggtcacagggcacagctgccaggactgaggccagaatgaaggcgatcgcccatccggctcagtggttctcagtcttgggtcagcactggaatccccaggagggaacacggaaaccccgagagctggctccgcccctagagctgacctcagtaaatctgagatgaggccagagaaattgcatttcgacaagttcccaggtgttgcagcgcaggtgtgtgcatgcatgcatgcatgtgtacttgtgtctgtgcccgtgcatgtgtgtgttcccctgttttctgctttctgcagtgttttagctcagacttcctgattggggtcccattcttgaccagaggcccagtctagacctagaagaatactaatacatgcccagctgtttagagcccacaagccctctcatggcccttgtttccaggccccataacagccccataagtttgttttaaaagtgcatctgtaggggagaaaagatttctttcctcatccatcactaggttcatggctgaggcacctgtaacaaaagacagactcacaagagaaaagcaaccaagtaatttaagttttgtgtgacatgggagccttgagaaatgaagacccaaagaaacagggacatctatgtgattttttgccaagtttgatgaagaagcagataattgtggagaagtataatcggaaaatgggggtatgatttgatggtaatgacctaagtggcatttggaaggcctgtttcttcagattcttctctgcgtctctgcatcttcatagagaaggactttccttccctgtgggtctagggaaggcacctcttaaatgaaggtttcatgacccacttgagaataaattcaggaaattcttttatggcctgcttcaggggagaagggcaggagaaggtcagagagcgaccttccttcttctgtggttttctcaaatgccaaggtggcagatctgggacagtgtgtcctgaactccctcacaaccatggctgtctgcaggccagtcactcaacggccatgaatgtgtattgacttgtgagatcctccaaacaaaccttcaaatctctgctcacccccatttgagagaccagagatgagccaagagacatgaagcaaccttcccaagggagcagagccaagatttgaaccagggctgttgggccagtgagcaagggcttgaaatccagtgcagcacaggtatcttcctcagcaggctcagagacaggaggtggaccggccggagcagaacggaccctccccttcaaagcgggactctgcccttgagccctgagcagccactctggacagggtccacagaggaaggcaatcctccagcccgccatgcttcctctgacctcttccctctctcagatggaactgcaagaagatcccaaaccatccaggtttcccctacctctgggcctttgcacagccttcagagcagccctgaggtgatctcctgggccatcagcacatgaccgaacaaaccttgggccaccaagctccttccccggagttggctctgaggccaatcccccgatttcacaccattttaccattcctagccttggtccctccacagagccccctgtttgctccccgctgtgcttcctggcaccagcctcagtatttccagaaacacatgcagagactcaaggcttggaggactggctttatcgagaggctctggaaggctctctgaccccagtggaatttggctctctccgtccctccagatgttactcaggccccaaaccttgcccagccttgttagtggcttctccttcccacacaggctgtgccaccccttctccctcagcctggaccccagaccagtactgagcttttcctgtcagccccttgggtcactgcagacaaggctctagtgttcaaactctggcttgagctcagagcagggcccactctgggcttgaaaatacctcgtgtggggacagcagggcacactggagaggtgaggagggtctcctgtcctaggctgaggagctggcccagaggcagccctggcctcctcgccactcccctgaaatcaattcctcatctgagggagctttctaaaataaaatttaaaaattgcccacggacctgcccagcttaaagcctttgcaaggctgctcttgaccccagcatgaaacccaagctcctctccatcctggctgccaaggccccaagccactcgcccagcccaccagcctcaccacactcccatagacttccccactcttgggtgggggtgggagggctacacgaagctctaaagtcagcccgtgctctttctcacccccaagccattgcacagcctgctcccttggtctagaacactccctgtatctgacttcgacatgtttcttcctccaggaagccctccctgatgccccattccccctccaaggactgcccagcatctggagcaccctgtaccgagcggcacactgtggtgctggaaacatccttgttgtactcctctgtgcctggacactgcatgtgggcctgtccatacgccacccagacccctcgggtacctttcaccatttctgagcactcttcccctggcttctgtgtgtttttgcttctaagaatctgttgggaagaaaatattccctctctatcaacttagatcctagtggtagggtggagggctacaaatcaactgacaatggacagattcacaggagaaaaaaacaatcagttgtactcacatgcctggggaagactgaacagctgggaataagggcttctatacccacttaataaaccgggtgaactgaatggggttagggctgctgtggaggcccaggaatcaatcagaagccttcagctttcacctcccatcccccgttccctgaccccatgccaccagatgcaaataagaaggaaactttaattccacaaattgaagcatttatgaagctcagcaggcaacctggcaggcaggcaggcacaagtgaggaacaagggccccgggctgggctgccttccaggcaggtcccctcgacacaggccactgcagctctctcctgcaatgtgtcaggagagcctggcacaatgtgggggacgggggcgggggggtgcggagcttggcaccacctggtggtctcagctgccactccacacgtaggaggctggatgcctgctggggcagaaggcggaatccagcctgaccacttagtggggctcatctacgcaagccttgggagcagtggcaggctgctgtgaggggcgcgctagcctgaggaaccctcagcctcagtactcctgggtcgagctgcaggagcaggcctggcaagtccctaaggcttccagcaacattccccttccccaggcttggcagtgccagcccacaactcagtcatgggacaccaggtgggctcctttcttgtgggcctggggcagtctgctgagaagaagtgggcttgcagccttgagggggattagatcctggaggagaggcccatcccttccttcatacaaccggggtatggctggctgtccacaggcggccatccccgtgccacaggctgagttctgtcttccccaaactcacgtgctgaaggcaggaccttgcaatgggactgttcttggagacagggcctttaaaggggtaactacattaaagtgaggtcattaggttgggccctcatcccatgtgacttgtatcttcatgcgaagagaataagacatagacacacacacaaaggtaagaccacgtgaagacacggagaaggcggcgtctgcaaaccaaggagagaggcctcaggggaaaccaacctgctgacaccttcatctcagacttccgggctccagcactggaagaaaatgaatttttgtttaagccgcccagtctgtggcaccttattatatcagcctgagcaaaccaatacacaagggcccagatacctaaacagaaaagtgtgataaggccatttaaaccacaaatacacagcgggggtcccagatcccagagcagggtctcagttatttcacagatcacaaaactgaggatgctgaggaagggggcctccccaaggccacacaacaacttggaggaaacacggaactgaaggaaattgattcccaggggagggcccttgcctgaccccctcctaggggagagtcagagggtttccaggagcatgaggatgctgagactacaggactacagatggagggtgtttcatggctgagtgaaggggtagaagccaggcgagtatgacacaggatccctcttgacagaattagaacacagagatctggagttcccatcatgcccctaccacagattcatggtggaaacttgggcctcatctgcttatctctgaagtgcagaaatttatagcacctacctccagggagagttgggggttaactgagatcacgatgtacaaacctgtaagctgtaaggcaatggaaaagtggagggtatgtccttggatgaagcttccgctctggacagcatggaggacccaggagtcaggctgggctgctggctcacaggtgttctctccccctggcccaatgccctggttcccattgccgtctgagctcctcccttccatgtctctgttcttgcttccttccctcggtctgccgtcgccctttgtcagtgatcagacgtgaccatgggtaacaggcatgaattttagtctctgcatgctcaggtgtgtaagaaacatggcttcctttagttcctataactaaactttattttcagtttgcactgatcttcctccagctgccctcccagcccagcagggcctctgccctggcagggatgggatcagaactcaaagcccctttcatgcaaccgtgtgtgcacagttacacacagatctgtctaaaatctaactagtaggaagcagtgagaacttggtgctttgtagagaggctttgtgattcagataacagggctagctccagggagtgtggaacaaacgagacccctgagggcacagacacctcagagcatttgtacctctggtgctggggaggggtggggggcccatctgtgagcctctggtgcccatgtgcccacgtgcagggtttgtatctttgtgcactttgtacctctgtgtggcaggcgatcaatggtgtttctatctcagccagggactcaggtgcgagactgagaagcccaggaggcaagaggcacctgcagccctagagcccactgcagattttccttgagggccgtatatccagaaccatcccagggcttggcttttgagagaaaatgtagtcttaaagaatgaacaagtgggccgggcgccgtggctcacgcctgtaatcccagcactttgggaggtcacgaggtcagaagatggagaccatcctggccaacacagtgaagccccgtctgtactaaaaatacaaaaaaactagctgggcatggtggcgggcacctgtagtcctagctactcgggaggctgaggcaggagaatggcgtgaacccaggaggccgagcttgcagtgagccaagatcgtgccactgcactccagcctgggtgacagagcgagactccatctcaaaaaaaaaaaaaaaaaaaaaaaagaatgaacaactgctgactactgtttactacaataagcatagctgatactctatccaggaagaggaagccaccactcagtgccccagccaagattgttctcaagcttttgtccgtcccaaacctttatgaagcatcctcacccactgacatgtgcagtacttaagacggtgcaccctggagtcaaatcccagcttggccccacatgagctctgaggcccttgaggagacagcgttgcaaagaccccaggggccgagtaagcagaggcctttcagagatcagagaaaaggccacatagctgggagcctttgtgaaactggagaggtcatcggggccagatcctcaggggcccagtggccctggaaaggaatctggtcttgtacctagaaatggtggcattaattatgtgactttgtccaagtcgctgtcctattctgagcttcagttttcttgtctgcaaagggctctggaccaaaccatctaggatccaccctgaccctgggccttcatgtcaggttaaggagagacagggcctcgttctgcgttcaggatgagtttctccagggaaaggccttctagctccgccctgccctgtctggctctggggaccacgcaggactctcaagacactaggtcactacactcaggagtttcccatttctgccaagacaatctggagaagacatcaccccacttgagtcatgagatgtcctcaacagcaccttctagagtgcagatctttttgctgctgtgagagaggggcttatgcagaatgatattgtcagtgtagacatgtttcacacagaggagaactcaggacaggggacaggaatggaggcaggaactcgatctattagaacaagttttctgatgtggttatgcatcagggatgtagaatcctgtgccttcaggatttctgggattaaagacaatcccagaaaacaggcctggacaggtcctggaatcagccccaggcctatttggataggggattctggggtcctcgtacccagagcctggtctagacagaaggagggagtgggctctgggtgggcaaacccaccttggccctttcccttccctcatcctgtggggaggggctcagctagtggagggtcagagagggtctaaagcaggggttccatggtaggcacccctcttgtccagacccaaaggtggcttggatcaccaccgaggcacagctgagtgataagttgatgagcagctgtgttttgctgccacataaaaatggctcattccccaccccccggccctgaagtgactatttactgagagaggcaaccctactgaacaaaagcctgctatttattacacgttcggtgaacaccccacagttccaatgcatggggagggcttggaaaccaaatcaaccttgggaaaaggaggtgcagaggccaaggtcaaaaccaattcatggaagtgggaagaaagcagggctggcctcaaccttttcactattagagagatggccatgtaaagtagtgagcctcctgtggaaggcatatgcaagaacaggtagaatgattatttcttaggggttttgtagaaaggattccttacacacaaaggcacaggattctacatccctggagcataactacatcagaaaacttgttgtaatagattgagttcctgccaccactcctgtcctcgtcctgagttctcctctgtgtgaaacatgtctagactgacaatgtcattctgcataagcccctctttcacagcagcaaaaagatctgcaccctagaaggtgctgttgaggacatctcatgatgcaaatgaagcagctgcttgcaggagccatggaggggcttgggcagcaggcggggggtgcccacaggcatgtgcccctccagaaatgggcaggaagtggaaggaagagaaagggagtcaggcccagggcaggggtgggggctggggtctgctttctccacactgccaggttctggtgaggacctcccaggtgggtgtaaatttgcaaacccaaatggttaagaagatatatctgttaatgtagaacattttgtatttaaccagtaattgacttgattcataactttaagtatgcagatgtggtaagtggacctcagtattagcttcctattgccactggaacaaatgaccagaaacttcgtggcttcaaacaacacacctttattatctgacatttctgggggtcagaaatccaaaatgactctccctgggctggatccgggtgttggcagagctgcgttccttctggggtcctgggggaagcctgtttccttgccttttccagtgtctagaggctgaccccattctttggctcatggcctcttcctccgtcttcaaagccagcagtgttgggccgagtctttctcaggctgctacctctgttctctctctcgtgcctccctatgtcatttgtcaagacccagaggattccacaggcctacccagataacccggggtaatcttcccactttaaagccagctgattgacaaccttaatcccatccacaacctctgtgaccctctgccatgcaaggtaacatactcacaggcatagggatgaggatgcggatgtctttagagggccactgttttgcctaccacagcttccatttggattcttgtcccaacccctacaaaagtgaggcatataatttgttgaattctgaataaaatgctaccagtgtctacaaattatattttttctttttttaaaaaaaaaaaaaaaccttcttccccaagtctggtttcctttagacctcaggactaagtacctgagaagatctgcgggcaaggatagttatgtgattatctggacagaatggcatttctgattgacattgttgcattactttggctccagatgcagtggcctgagagcagaaataaaaccccctccagctgcctcagcccaccctttgcagagggagaattgagttggggccacacggtgggaagcactaatcctcagtccacacaaaccctcgctttccaattattttgatggaagtcatgaaagagcactcagctaggcattattaatccattttttcaattcagcaagtattgattgagcagctaccctgtgccagtgaggttggaaacacaagggtgatgaacaaggtacatgtgcctggccgtcactggccagctctgtcactgcaggcgggaactttccttcctgtggggcccagggttttataatcacatgagcacctacacatccggtacagagccccgttaagggggcagggcctggcctgcctccttcactgttgtctccaattgcctcagatgcatgtggatgctcattcgttgaatgaatgaatgaatagatggtccttgctgatcggagagtcaatgactgtatcaggccaactggaaaagcagagggcaagccaagagaagacttggacagtgcctgccaccatggctgcgagtgagaggactgcggatcccgaggtggattcctggggtggcagctactgtttacaaagcactttgctggtatttattaggccacgcagttcccttccaagtttcctcctgttatcattctcactttgcaaatgaagaaactgaggtactgggataaaacttgctgaagaccacatggctagtaagtgtcagagcttggatgtgaacctgaatgctcgctgaggagagagcagctcgcctccttccctcacaggcacatagtcagccttcccgaatttcatccggcaacaattaacctctcccttctcactatcccccgctccctttccatctgtagagatctccttggatctaaattatcagggcctaaagccaggccatactaccgaggttaaagaaggtgaaagggctgcattgggcaacattgttccttcaatcctaactctttaatcctaattcatcactgcacactctgctcccttccctgggtgaagacagtttgatttgcccagtatccagaaagtttgtgctaagacaagggaaattgccacatggctctctgtttcattcagtccttcataagcatgcagcctgacctggagaaactgacagtgtaaaatgcatggagcagctcctgtccctctctttcctacccttgagcactctctaagcagtagctggccgatacagtcgcccaggaagtctccctgtagctcggccgtcagtcattaccctcactggcagcacgggacagagaacgggatatgttctccccttttattttgtgtggtgagacttggaaaactctgcgcctagaaaaatccatttctgaaggttgctgctattgagtagtgcagtgagactgggtttgaaggtattggactcttacataggctatgtgaacgtgggcaaattgcatcttctctttgagaagtctgagctcaagtcttgctttgagttatttgtgtactaacctttgaccttgctgacaaaaaaaaaaaaaatcacagtgctgggtacagctcctgacactccacctcccctacttcttttttagatacagggtcttgctctgttgcccaggctaaagtacattggtgcaatcatagctcactgcagccttgaacttctgcctcaaacaatcctcccacctcagcctcacgagtaggtgggactacaggtgtactagtatgcccagctatttttatttatttattttgctgtccatcctgatctggaactcctgggctcaagcaatcctcctgcctcggcctcccaaaatgctgggattacaggcatgaggcactgcacccagcctcaacttctcccacttctatcttctccccagttctaggtgaggcaggacctgccacatgtccaaatctccatctgtccccagcactctactaaatggcttaactgggccctcacgtccctccctggggatcctgtgaaaagacttgtgaacctgctccaggtcctgactgaaccaaatttcctctctctacatgccgaaagagtaataggtgttcctgcattaagcaatggcttaatttaggtttattttcattcttcagatatctctcccatttgatgtttcacccccttgaagctcaggtgaatctccatcttcttattcatctgaatattcctcatgcctggcatcacgcctcactcatagagtaggaattcaaaaacatcccagtaggagctgggaaagctcctactgcatgtcttgtacatctgctgtatgccagctgggaaagctcctactgcaagagagaggcaaaccacaaaggggactaaggggaagaattgggaggggggcatttattgccccaaatgactgaatttgggtcaaataacaggaccacgggcactcacatgttcaagttatgttcaggaatcttcctgttttctttatgaagcagaccctacctctcatcataaagctggaaatgccacgttccctccattccagcctctcttgcagctatggtgagcctaaatgagctagactcagtcaatcaaacccttctgccctagagtttgaatgggaagttctgacttgaagaattaggaaccacacaggaccccgtttgtgaagggggtggcacaaggtgcgtggcctctagctcccaggggcagcatccagaattcagcctcagggatgttggtcatgcaagccaccaaatcagtgccagcagccaagacgggggtgtcttcacagggccagtttcgtcatgttatttcaagggttgctcctggcccgtagcctctgaatttattttagtttctcagagatttcagtgggccaacgaatgtcacttaatcgatcccttttctgcttggaggagccagactccgtgtttgttgcttacaaatgagaccttgactgagacaagttgtcttgagtttccagttgaagtcatcctattccctttcaccttgaggcctttgcacatgtcatttctctcacctggagcaggcattcaccctctttttgtgactggatgactcctacccagtcatccaagggtcaggcttgaagactcttcccctgagaagccctcccagatcaccccaaatctgggctcccacaccaccctgcatgttcctcttagtagcatcctgaccctggattttactgtttatttctgtgtttcctcactattctgtgagctgcatgaggacagaagtgcatctatttcatcattgttagtagtagttagtatagttgcccagcctattgatattgttgaatgagtggatggattgaactctcttaggccagagtgatcccccactatcactgcctggcagcatggagcagcttcagtttttggactcagggcaattgccctgttccaggaaaccccaaaatagagttgcctcatttcacttctaccagcatgtcttgtacatctgctgtacgccaggccccgtgtcctcttacgcccacatcccagatcctgcaggtagaagtgctcacattgctgtgctcccttttctctgaccagccatggaggccctgggggcttggaggagtggctgcttactccctgggggaagtgtgggctgcaagccccttgagtgggcaggttgccatggtgatgctaatggagagacttgcctgaggaatactgaccaccaaaaggaacaattaccagagaaggcccatttctttagcaattttcaagaatgggcaagataaaaagccacaagtgaaaaggcattgcaaacaaataatagtgtatgagctggtctggacccaacaaggcctgtttcccacccctctttccctctggttgtagtgaataaagccatacttttcagtgatttataactgttcaaaaatgactcgtttccatatcttctttcatctacccagcacccattatgtaccaaatgcctaacagacacttaaaatatactctataattatgaaaacaaccctacaaggtaattgttcccgtattacagatgagaacactgaggctcagggagtgtaagggacccgtctagggctacgcagctgggaagcacatgcagcactctacttcatgcttaattcaaggaagcgaattctccttgtgggttaacatcatcacagtggcaattccagtgcctccataagaaagtgtccttggaaatgagacactagccctctcctgtctcatctgcacaatatcctattgccatctatttagaagagaggtagtgagttggttcattcattcattctccatttgttcattcatacacatttattacactcaaacttctagggcaaaaccagcaagccccgtactggacacttcagactcaaagatagcaacttgctaagttacaggagcttcctcataattgctgagcttctaagctctttgtcccaactcctgaaaagtagccctcaacttccaaactgtgcttcgggcactgacattccctgagctccacacacccttggaccacagttttctgaggcccagatgagcacaatgtgcagggcagagcctggcacttccagggctccaaggagtccagaggaaaatcgggcaggtcctgaatcaggctgctgtaggttgaactcctgccccacttagcagctggatgatgtgcaaattgctcagcctctctgtgcttcagtttcctcacctataacctagggctaaaaattagaagcacctactccatacagctattgtgctgatacaatacaataatccacataaggaacttagaacagaacagtgccggcggtgtatgttaaatgctgagtggacaccagttgggattagaagtagcagcattgccaggtactcctgagcaatgggtcagctaattccactctaccctcagaccccaccctcctttgcagttccttctcctgctttgataactagaagcagtcatatagggcctggggtctctacttgtaggagttcagtcagggtggtaggaaaaattataaaaattatagaaagactcaaaccttcttggaaggccgggaggttttgcaaaagttttgggaaaggatttggctgaaggcagctgaattttctcagagtaaataacaaggaagtgtaagggaattaatctagataagttagtttacttaggccttgaaacatggcctttaatcatccatgctcaggactgctctcttgggggaaaggatcgcccgaccccccaccccaccctcaccccaccccctgccaccatgttaattacccacaagtgtgttgactcaaagcctttgtcattaaatctgtactgaatatatgcccacagcaccagcttgtcaaggctgcagctgctgactctttacagcaccctcctcggtgcctgtgagtggcccagtcccttagccgtgcagccaggcaaaaaatctgtgtctgcatacattttttcatccatcactcagccagggtctgcgggttggaccccgcatctactcacaaatcaagatgttcagttccgccacccacccctgtctgtcttcctttctcacagtcactctgtaggtgtatcctgaaaatgtaaatcagaccacagcattccctagctgaaaacccttccgtggctccctattactcaccataggctaaattccgcccagactcctctgaagggcttgcaaggcctcctgtgttctagctcctgcctgctatccacccacacccctcattcctgcccctgtaaaccccttgtagctctcacatctcaagaattaaagatttgacccagttgctccgaccacctccgccccgatccccagaaacagtttcccccttctctttctctggccaacttctatcggttttcagaatgtctcccctggccacgcaggatcccttccattttgaggctgataaaatcctgcggatcgcaagctgagcgctcatcacaccccatcgtgattatctcccctgcaaggccaggggctttgagagggtgggactgtggctgacacgttcagtgctccagtcccatcacctgacacttgccatagagaaggtgcttagtatttagaagagtgtgtgcgattaccgagagcatggatatgaagaaggggatcacaaccttgaaaaagtttgttgctgagaaagaggcaagcagccccaactgacgggagctggcctggtcctcacagtttgtctcctgttgaacaatttcacagaacattgacatcagacaaggctattctgactgtgttggagcaagacaaaatcgagagcacttcgtagtcatgtctaaacgcagataaaacaagaacattgtctaaaccacaaaaatgaccagacatcccgcttttttgggctaatgggagtaactgtttaccaatgtttataatgttggccctgcactagtccttctaccttatagataagattataggtacccaattatagaatgattcctactgcctgatggcatccaattgaaccctccctagtcacttaacacaagcccccatccttttgtaagttcttcgtaacaccctctcacaaagacccctcactgttccccacagtgcacaatctccttgctgcaatgagccaataaacccagctccgttcaactgcaggtgtgttcctggtctttggctaaagggcattgacaccacccatttcccagaaacctgaacttgcaaaaaaaaaaaaatacctaattaaacaatttctgcaagctaattgatagtgagaaatgtatttctgatagggagcatcagctggagtagacaactttgtacatactatatgttttccggacagttgcttcagcttctcctgcattgtgtgtgtgtgtgtgtgtgtgtgtgtgtgtgtgtgtgtgtgtgtgtttgcagggggaagatgcaagctttgctgtcctgggtgtccgtgactgggcatgtctcatctggaaagagatcagctaatattccttgagaaaaagaatgttatcactggatgattacatctgcttccagagaggtaagagcatgcagcatggagcagacactctctatcccaggagctgccctgcccaggcctgggctggtggctattgtcatggagtggtaactgtaaggccatcctcataagtcctgctgatatcactccaatccatggacacccctgtgactccgtctccattcctcaggcctgcttcccatggaaagacccagagggaaacgtggttggtggcattggggactgagaacagaacaaaattcaggctttgagtgtggattagagacgcactgtgtggtgcttgcatcacctctgacagtggttgggtaatgggctgaatcacccaatggagacagaatgccaacagatgttagttgaggaggatgattaatctccttcttcgaaaactcagagaatctttattggcaacgttgaagtcaagatagggcttctccttagcaaccggaaagcgcctagtgtgcatggctacagaattcaatatgaaactcagatgatgaaggtagccatgggcacctctgattgcccattgtaaatttctgcctggaatgagggctggggcctcataaatgtcaacaaaagctggtgatgggtccagagagggatgttaggccagccttgatggatgaggaagtttcatttaggggctcctgtcacttcccatcttcaggccaagctgacatccatggctgtaaaattgtcacccttctcctttgcctctcaggaaagcaaaacttctttacgacacttttaatcaaatctgtcttttgccacttctctccccaccctgctccctctgcctttatcctgacaaagaagcgaactgttactctctgtcagttatttgtctgagtaatttcttgatgaaattgcaactataattgaattttctgaaaaccaggaattcaaatgaggcgacaacagaggaaacagcgtgattaaggaattgttattcactcgttgtacatcattaccacccagaattcatcgctggatcgttcacagatggagttgctgaactatgattatattttagaaaatgaagggggaaaaatctaaaaaggcaataaaacatattagaagccttcttgaggaacaggattattactgattaagtatattttgcatgaaaaatgtgctagcactttggcagtttaaattatacgtccgtgcagtcaacatttttgctggtctcaaaattctttgttagtttggtcttctaatcacattcctcttcaccctccaaattgacgacttgaaagaacattagaaatgatcattcctgaaggagcatttgctctcaaaatgcatttacgctcagcagccattaaaaggatatcatccagtcacttagtttctcaatttaactttaaaggaaagttgccttattagagaagtggcctctatttcaatgtaatggtctttgtcacatcttccaatgtgctggcttagtgctgaaggatggggaaaggcagttttcacatattgcagccaccataccaccaaagaaaacaggtgcacttccaggcatcatttagcggggtaccacattcctggttccagtttcctttttagaaaatctgaaagtaactttggggcatatcttttaaggagtactccaacacgactagtggacagaccctaaattaattgccaatcagctctgccttctggtatttacacctttatgtaataacctccacttgaaggtagatgagatctgtgacttgcttctaaccagtggaatatggcggaggtggtgggacgttactcctgtgattacattacatcatgtggctcctttatgatggaagattcatgctagagattctccttgctgacttgacaaagtatgtaaccatgatgaagacttccacgtggcaaggagctgtgggaagcccaggtgctgagactggcatccagcaaacacccagcaagaaacagacgtccttggttctacacatacaggaaatgaattctgccaacatcctgagtaaggctggaactagattctccccaagttgagcctgacaagtaaaatacagaccagccaacaccttgattgcagtcttgtgagacctggggaaaaggacacagctgaaccgtgtccattcttctgacccacagaaactgtcacatcataaaggtatgttagttgttacacagtttagaaaactattacagctgctcaagaaggttagctagctccagatttcaatccattcacaggaaagcaagctttattcctagaagaataattcatgctttgcaaaaagaggaaaacgtcctgcagttttagaaggtcttttctttctcaacacacccaaatttctttaaaatcctcaagaagtgcatttgttttcatggttgactcgaagaagtgagtataattaactcacaaaaggtgggaggaagggacaaattaaattttggtatgcatacaggtagcttcttccaagtgataatgagcaatgtgaaacaaagagattggcattaaatgtaatgaaggactagaggagtgtacctaaacctgaaacaaattccaagaagtggccttgacctaaaatgtttgcatcctgccagagacccttacttataagtcaggagatacctgatgcccaggagaactggtttttgtactctgtcttacacagactaagaattaagaatgcaggtgagaagtttagaaaacttcctgatgatcatatgaaaagacattaaactttacctggtaaaactatgaaatgttgcctgtagatttctaagaaaaatgagtaggaagttggaaatatttcagaattaagaatgtttttatataattagaactctttaagctatgtaattctgaaatctgtgtgacagacttctgtgtaaacataaagaactagttatttttacagattatctagtctgtgtattcatttgatgtttctattacttttaccctcactacaaagttcaatgaaggttaaaaaaatattgttcttaaaaaaagaagagataaacctggagtagctatttcaatgttagacaaaatggattttaaaacaaaaatgttaatacagatagaaagggacattttataataataaaagtatcaaaatatcaggaagataccacaattataaacaaatatgctcctaaaaatagaatctcaaaatacataaaacaaaaactgacaaagttgaagggataaataaataggcagctcagcaatatttagaaacttcaatacctcactttcaataatggatagaacaactagacataagatcaacaagaaaatagaatattttaacaaagctatacaccaactaggcctaatggatatctatagaataatccacccaacaacagaagtcttcctcctcctacttctcctcctcctccccttccccttccccttccccttcttcttcttccttcttctctttctccttctccttcttcttcttcttcaacaggatcttactctgttgcccaggctagagtgcagtggtgtgatcatggctcactgcagcctcaacttcccaggctcaggtgatacatgggcctcagcttcccaaagtgctgggattataggcacaagccacatgcctggcccacatattcttcttaagtacacatcaaacattctgtagaatagaccatatgctaggccacaaaacaagcttcgataatttaaaaggactgaaattatacacaatctgttccttggccacaaagaataaaattagaaagaacttttggaaactcacaactatatagaaattaacatacccataagtaaccaattggttgaagaagaaatcacaaaataaatgagaaaatactttgagatgaatgaaaattaagacacaacatataaaaatttatgcaatatagctaaagcaatgcttagagggaaatttatagctccacatacctacattaaaaatggagaaagttacactgttggtgggactgtaaattagttcaaccactgtggaagacaatatggcgattcctcaaggatctagaaccagaaataccatttgacccagcaatcccattactgggtatacacccaaaggattataaatcattctactataaagacacatgcatacatatatttattgaggcactatttccaatggcaaagacttggaaccaacccaaatgcccatcaatgatagactggacaaagaaaatgtggcacatatacaccatggaatactatgcagccataaaaaagaatgagtttatgtcctttgcagggacatagatgaagctggaagccatcattctcagcaaactgacacaggaacagataaacaaacaccacatattctcactcataagtgggagttgaacaatgagtacacatggacacagggaggggaacatcacacaccggggcctgtcggagggtggggggcaagtggagggagagcattaggacaaatacctcatgcatatggggtttaaaacctagatgacaggttgataggtgcagcaaaccaccatggcacatgtatacctgtgtaacaaacctgcacattctgcacatgtatccccaaacttagagtaaaatttttttaaaaaaagaaaaaacatctcatatcaataagctagacttctatcttaagacgctaggggaaaagcagcaaactaatcctaaagcaagcagaaggaagacaataatgaaagtggaaattaatgaaattgaggacagaaaaacaatagagaatatcactgaaaccaaaaagtggttcttgttttctttctttctctttctttctttctctctctctctctttttctttctttctttctttctttcttgtttcttttgagacaaggtctagctctgtcactcaggctggagtgcagtggtgcaatcacagctcactgcagcctcgatctcctggacttaagtgatcctcctacctcagactctcgagtagctggaaccacaggagtgcaccaccatgtccagctaatgttttcaattttttgtagagatgaggtttccctatgttgcccaggctggtctcaaattcctaggctcaagcgatcctcctgcctcagcctctcaaaatgctgagccaccacacccagctggttatttcaaaagatgagcaaaagtgacaagcttttagctaaactgaccaagaaaaaaagaatacttaaattaccataatcaggaaagaatgagagaacattactaccaacctcatagatacaaaaagtatagaggaatacaacaagccaattgatatgccaacaaattaaattacaaatgaaatggacaaattcttagaaagacacaaactacaaaaactgactcaagtagaaatagaaaatctaaataggtatttaaaaaagattattaaactgagagctgaagacagggcagcaaaactgcaggggccaccaccaccaccaccacatgtcaggaagagtacggagaggccctggaggggcataacgactgcaggaataaattaggagagccaagagaacccacagaccctctgaaggaagtggattgctcctgcaggacctgggagacacctcaaatactgtgctggtatctgtggctgagaaacccacagatggtttgcatcacaggactctgtacagacaacccccagtaccagcctggaacctggtagacatcctgggtggctagatccagaagagagataacaatcactacagctcggctctcaggaagccacatccctaggaaaagggggagagtaatacatcaagggaacaccccatgggacaaaagaatctgaacaacagcctcgagccctaggccttccatctgacagacactacacaaatgaggaggaaccagaaacccaactctagtaatatgacaaaacaaggttccttaataccccccaaaaaatcacactaggtcaccagcaatggatgcaaaccaagaagaaatccctgtttcacctgaaaaagaattcagaaggttagttattaagctaatcaggaaggcaccagtgaaaggcaaagtccaacttaaggaaatcaaaaaaatgatacaacaggtgaagggagagattttcaatgaaatagatagcataaataaaaaacaatcaaaacttcaggaaacaatggacacagttatagaaatgcaaaaggctctggaaactctcagcaatagaattgaacacgctgaagaaagaacttcagagctcaaagacaaggttttagaatgaacccaatccaaaaaagacaaaggaaaaattataagaaaatatgaacaaagcctccaataagtctgggattatattaaatggccaaacctaagaataattggcattcctgaggaagaagagaaatctaaaagtttggaaaacatattcgggggaataatcaaggaaaactcccccagccttgctagagccctagacatccaaatacaagaggctcaaagaacacctgggaaattcattgcaaaaagatcattacttagacacattgtcatcaggttatctaaagttaagatgaaggaaagaatcttaagagctgtgaggcaaaagcaccaggtaatctataaagggaaacctatcagattaacagcagatttctcagccaaaaccctacaagctagaagggattggggccctatcttcagcctccttaaacaaaacaattatcagccaagaattttgtagccagtgaaactaagctttataaatgaaggaaagatacagtctttttcagataaacaaatgctgagagaattcaccactaccaagtcagcactacaagaactactaaaaggagctctaaaccttcaatcaaatcctggaaacacatcaaaacagaacgtctttaaggcataaatctcacagaaactataaaacaaaaatacaattaagacaacaacaaaaaacaaggtatacggacaacaaatagcatgaagaatgtaatggtacctcacacctcaatactaacattgaatgtaaatggcctacatgctccacttaaaagatacagaattgcagaatggctaagaattcaccaaccagctatctgctgccttcaagagactcacctaacacataaggacacaaataaacttaaggtaaaggggtggaaaagacattctatgcaaatggagtaactattcttatatcagacaaaacaaattttagagcaacagcagttaaaaaagacaaagagggacattatataatgataaaaggccttgaccaacaagaaaatatcacaatcctaaatatatatgcacctaacactgaagctcctaaatttataaaacaattactaatagacctaagaaatgagatagacggcaacacagtaacagagggggacttcaatactccactgacagcactagacaggtcatcaagacagaaagtcaacaaagaacaatggatttaaagtatatcctggaacaaatggacttaacagatatttatagaacattctatcaaacaactgtggaatatacattctattcaactgcatatggaactttctccaagatagaccatatgataggtcacaaaatgagccttgataaatttaagaaaattgaaattatatcaagcactctgttagaccacagtggaataaaactggaaattaaggccaaaaggactttctaaatcatgcaaatacatggaaattaaataacctgctcctgaatatcactgggtcaaaaatgaaatcaaaatgcaaatttaaaaattattcaaactgaatgacagtactgacacaacctatcaaaacctctgggatccagcaaaggggatgctaagaggaaagttcatagccctaaaggcctacattgaaaagtctgaaagagcacaaatagataatctaaagtcacacctcaaggaactagagaaacaagaacaaaccaaacccaaattcagcagaagaaaggaaataaccaagatcagagcagaactaaatgaaattgaaacaaaaaaattacaaaagataaatgaaacaaatagctgattctttgaaaagataaatacgattgatagaccattagcaagattaaccaagataggaagagagaaaatccaaataagctcaattagaaatgaaatgggagacattgcaactgaaaaccacagaaatacaagagaacattcaaggctactctgaacacctttatgtgcataaacttgaaaacctaaaggagatggataaattcctggatagatacaaccctccttgcttaaatcagggagaattcgataccatgaacagaccaataacaagcagtgagattgaaatggtaattaaaaaattaccaataaaaaagtccaggaccaggtggattcataccagaattctaccagacattcaaagaagaaatggtaccaatcctactgacactattccacaagatagagaaagaaggaaacctccctaaatcatcctaggaagccagtgtcatcctaataccaaaaccaggaaaggacacaaccaaaaaagaaaactacagaccaatatccctgatgaacatagatgcaaaaaatccttaacaaaatgctagctaaccgaatccaacaacatatcaaaaagataatccaccatgatcaagtgagtttaataccagggatgcagggagggtttaacatatgcaaagtcaataaatgtgatacaccacataaacataattaaaaacaaaaatcacaggatcatctcaatagatgcagaaaaagcattcaacaaaatccagcacgcttctatgattaaaactctcagcaaaattggcacacaagggacatacctcagtgtaataaaagtcatctatgacaaacccacagcctacataatactgagaactggaacaaagatgcccagtctcaccactcttcttcaacctagtaatggaagtcctagccagagcaataagacaagagaaagaaataaaaggcatccaaatcagtaaagaggaagtcaaactgtcactgtttgctgatgatattattgtttacctagaaaaacctaaagatgcctccagaaagctcctagaactgatcaaagaattcagcaaagttttgaatacaaaattaatgtacacaaatcagtagctcttctatccaccaactgcaaccaagctgagaatcaaatcaagaactcaacctcttttacaatagctgcaaaaaaaataaaataaaatacttaggaatatacctaaccaaggagatgaaagacctctacaaggaagactacaaaacactgctgaaagaaatcatagatgacacagacaaatggaaacacatccaatgctcatgtatgggtagattaaatattgtgaaaatgacaatactaccaaaagcaatctacaaattcagtgcaattccatcaaaatactactatcattcttcacagaattagaaaaaaacagtcttaaaattcacatggaagcaaaaaagagcccacatagccaaagcaagactaagcaaaaagaacaaatctggaggcatcacattacctgatttcaaactatactataaggccatagtcacccaaacagcatggtactggtataaaaataggcacatagggttgggtgcagtggctcacacctgtaatcccagcactttgggagaccgaggcaggcggatcacaaagtcaggagattgagaccatcctggctaacatggtaaaactccgtctctactaaaaatacaaaaaattagccaggtgtggtggcagacgcctgtactcccagctactcgggaggctgaggcaggagaatggcatgaacccgggaggcagagcttgcagtgagctgagatagagccactgcactccagcccgggcgacaaaacgagactccatctcaaaaaaaaaaaaaggcaaatagaccaatggaacagaagagagaacgcagaaataaacccgaacgcttacagcaaactgatctttgacaaagcaaacaaaaacatatagtggggaaaggacacctcattcaaggaatagtgctgggataattggcaagccacatgtaggagaatgaaactggatcctcatctctcaccttatacaaaaatcaactcaagatggatcaagggcttaaatctaagacctgaaactataaaaattctagaagataacattggaaaaccccttctagacattcgcttaggcaaggatttcataaccaagaaccaaaagcaaatgcaataaaaacaaagataaatagctgggacttaattaaactaaagagcttttgcacagcaaaatgaacagtcagcagagtaaacagacaacccagagagtgggagaaaatcttcacaatctatacatctgaccaaggactaatatccagaatctacaacaaactcaaacaaattagcaaaaaaaaaaaaaaaaaaaaactaccaaaaaaaatcatcaaaaattgggctaaggacatgaatagacaattctcaaaagaagatatacaaatggccaagaaaaatatgaaaaaatgttcaacatcactaatgatcagggaaatgaaaatcaaaaccacaatgtgataccacctcactcttgcaaggatggccataataaaaaaatcaaaaaataatagacactggcatggatgtggtgaacagggaacacttctacactgctggtgaaaatgtaaaactagtacaaccactatggaaaacagtgtggagattccttaaagtactaaaagtagaactaccatttgatccagcaatcccactactgggtgtctacccagaggaaaagaagtcattatacgaaaaagatacttgcacacacatatttacagcagcacaattcgcaattgtaaaaacgtggaaccagcccaaatgcacataaagcaacgagtggatatatatatatataaatggaatactactcagccaaaaaaaggaatgaattagtggcattcacagcaacctggatgagattggagactattattctaagtgaagtaactcagcaatggaaaatcaatcatcatatgttctcattcataagtgggagctaaactatgaggatgcaaaggcataagagtgacacagtggactttggggactcagggggagagggtggggagtggatgagggataaaagaccacaaatatggtgcagtatatactgctcgggtgatgggtgcaccaaaatctcacaaatcaccaccaaaggactcactcatgtaacaaaacatcacctgttccccaataacctatgaaaataaaaaaaataaaaataaaattttaaaactaccaaataacaaagaaattgaatttgtcattttaaaacttcccacaaagaacagcttaagcccagacagcttcactggtgaattatacagaatatttaaattaaagaattaatgtcaattcttcacaaagtcttctaaaatgtagaagaagaggggacattttccatttcattttgtgaggccagtattatcccattaccaaaccatacaaagccactacaaagaaaactacagaccaatactgcttatgaatataaacataaaaatcctcaacaaaatactagtaaactgaatccagcagtctgttaaaaagactaacaccatgaccaaataggatttatcaaaggaatgcaaagttggtttaacatttgaaaattaattaatataatacataattcaatagaaaagagaaaaaaacacatgatcatcttattagacacagaaaaatcatttaacaaaatccaaactgacgtcatgataaaaacactcaacaaactagaaatagagtggaactttctcaatgtgataaaggacatctaccaaaaatccacagctaatatgataaataatggtaaaagactgaatgtttttcctctaagatcaggaaaaatacaaggatgtctgctctcagcacttttattaaatattgtactggaagttctagccagaacaattaggcaaggaaatgaaataaaatgaactcaaattggaaaggaagaaataaaactatttccggatgataccaccttatatagagacaatcctaaataatccattattagaattatcagaactaattaacaagatcagcaaggttacaggatataaaattaaaattcctatacactagtaatgaataatccaaaaataaaattcaaaaaacaatcccacttacaatagcatcaagaaaataaaatccttatgaataaatttaacagaagtctaaaacttatatatactctaaacacgacaaaatatcattgaaataaattaaagatggaaataaatgcaaagacatccatgttcatgatcagaagacttatattgttaagatggcaatacttaatattataaagtgatttacaaattgatttataggttcaaagtgattcgatgcaatctctgtcaaagtttcatagcattttttgcagttatttatactgcaaagtgatttacagatttaatgcaacccgtgtcaaaatcccatggccatttttgcagaaatggaaaagctattgctggaattcatatggattgcaagtgaccccaaatagccaaaacaatcctgataaagaacaaagctagacaaagtccatcttgcacttcctgatttcgaatcttacttcaaagctatggcagtgaaaacattgaactgagtacggtaatatttatcatctcaaaacctcacaacaatgcagtcaagtggaaccactgtctcagtatttcagatgcagagcccaggctcaaagaaatatggggaattgcttgaggtcagagagctgggtaaccacaaatgcgggtccacattcagatctgccctaagtataaagacattgcatcctctcagccactacctacaccactcttgagtttcttcgacacaggacctgtgaacagacagcccaagacgcttgggaatcatggaattctaacccccaaagcctggcttagggacctcatccagcgaccagacagggcgtgttgtgcctcatccacatttctgaaagtgtccactcagtggacagcctgctttctagtctctgccctactggcttgagtgtggatgcccagacggttaggaggcaagctccagagctcccatatgatcacttccactgtcacctgtgtgccacaagtgctctctgtacacatgctccacctgttctgatgatctttcagtctttcaacttccaagccatgtgagggatccttcaggaacatgagcactgggacatgctggacgctggagagagatgcagacacccagagctggctgagctaacatgctacagtttgtgaggaggagacacaaaatttcatacagatgataaaatttttctgtacaacaaacctttgctatagatcctacaatatatccattattctcactagaatgtgaacatgattctgcaaattcctagggagaaaacccagcctgccccttatcagaggctataaaccacctgtttttctttccatcctccttcccttgcttccctctcacacatcagtcctttagagaaaactgagcttttccaagctgttattgctcaaagaaatgtcttcatccaagggaaccaagggatgtgaagggcactggcctccgaagcatttgccattgtcaacttttattgagcacctactatgtaccaagtactgtgctaggttctgacgacactgaagaaacaaaaaaatagatacttcctaatctcaagggacagtccactggtggagtcagaccttcatcacgcacacacacaaacacaaagagagagacagaaagagagagagagagagtgagagagaaatacatgtattcagatactgctctgaaccttatctgggtccggagggcagagaaggcttcttgaactaggacctaagaaatgggaagaaatttgctagttaagcaggtgttgggggaaggtcctcagaagaacattctagaacaagtgcaaggtcccaagagggagggagatggtccattcctgcaactgaaagaagaccaatgtttctgaaccacatggagcaggaggaagcagcaggagaatccaacagggggagggtcagaaagcccatgtttgtaactaaccggaacgatgaatgtggtttggaagacaagtgagaggatgtgtaccacgggccagatgtgggagaccaaggaggggactagtgcatttttccagtaaagaaataatagtgcttggggctagggaggctcaaattgagaagaagacaagtggggaggtttaagagagatttctaaattaaaatgtacagggaatagtgacagatgatgcatggggtagagagagagaaggcaatgtcaagagtgactcccaaatctggcttgcaaacagaatgaacggtggtgtcattcactgagaaaggacacccaagaggaggatgtgattagcaggggagagagcaggagttcaagctgatatgtagatccacattaatatgtctagtcagaatgtggatacgtaggtttggggcttagaagaaaggtctggggtgaagatctaaccctagcagtcatctgcaaagagatggtaataaaataaatacaatttttaaatggatggaatttccagggaaaaagcagagggtgaaatgagtaaaggatctagggccaaggctaaaagaaatccattattagaaacagaaaaggtgtcttagtgcattcaggctgctataacaaagtaccatagcctgagtggcttataaaccacagaaattcatttctcacagttctggaggctgggaagtctaggatcaaggtgcaagtgagagtctgccttctggctcatagatgctgccttctggctatgttctcacatggtagaggatgtacggaagctctctgcgacttcatttatgaggacgctaatcccattcatgaagactccaccctcatgacttaatcacctccccaaatccccacctcctagtaccatcaccttgagggttaagatttcagtatatgaactttaggggtcacaagtattcagtctatagcaggaggaatagccaagaaggatgaatgaaaatcatacaaggatgatttcatggaaggcaagggagtacaatgtctcaaataaaccaagtcctgagtcaaacattactgagaatgtgagtgtaataaaaccgagactcaaaagtaggcattggatgtgatgacatgactatcactggttaccttagggagagaagttttggcggagttgacaagcacagtcagatggaatgtgctggcggatggcaaagatggggaaatgaagatacccagtgtagacagcttctgaaagcagctggccgtgagtcagaggtagacaggaaagtgactaatacagtgcagaggtcgacgtttttagctttattgtatttaagagagagacctgagcacatttaaaatgctgatgtgacattgtccaagctgagaggaaacaattagatctatatgagagaaaagaatgatgaatatcaggcaagtatggcaaagaccaccattacttttgcaccaacccaataagaaagttggaggatcttcacaaaacaaaggtggttttggcctgagtggggaggaggaacagcttctttactaccagtggaaagaaggagaggctggtgcaggggcagggaggtagcagggagcagagggaggccccatccacgctcaggttcttagaatgaggaagatgacattggcaggaccataggtgagcatcttctaacccaaggaagatttagaactaagtataggctgggcgcggtggctcacgcctgtaatcccagggcttcgagaggccgaggcgggtggatcacctgaggtcaggagttagagaccagcctgatcaacatggcaaaaacccatctctactaaaaatacaaaaattagccaggtgtgttggcgcctgtctgtagtcccagctactcaggaggctgaggcaggagaatcgcttgaacccaggaggtggaggttgcagtgagctgagatcacgccattgcactccagcctgggcaacaaagtcagattccatctcaaaaaaaaaaaaaaaaaaaaaaggaaactaagtatagaagtatggaatagaactatattctttctattaagatatttgtgctttgaaataagctatgtttacacacttgtaatgtttaagaatctgtggcctttcagagtcatatatgaacttttccttctaatataaaatgtttaacggagcaattgactttgacatcagattctaagttgaaatcttactgtatttaaataagatttggaacctgtaaaagaatttaagccttgccgtctttagaagtttaatgaattagatttataacaattacttaaatatctgagaaggtttgttagacaattgaagtacttaaaaaggaattaaaatatattaagcctataaatgcagtttacaatgtttagagcaatttaattaaaaacatttgtaaatgagacgaaacatttctcaaaggtactcttaaatgtgattgttaaaatttgctagacctataaataaataataagattcgtaagctgaatttcaaagcttatggaggaacttgggtccatatgaatttgttactttaataaattgaatgttaattttgaaaaacaaagaaacctttcatcaatatttttggcgcctaagagctgctcttgagggcatctaattaatagtttttttattatttaaaaaatatcattaggccaggtgcagtggctctctcctgtaatctcagcactttgggaggccgaggtgggtggatagcttgagcccaggagtttgaggccagcctgggcaacatggagaaaccttatctctactaaaaaaaaaaccacacaaaaattagctggatgtggtggcacaccgctacttaggagactgagatgggaggatcacctgagcccaggaggtggagggtgcagtgagccgagatcgcgcccctaccctccagcctggaagacacagtgagaccctgtctcaaacaaaatttttttaatggctataatgaaaaaaaaaaatcaaccagtatgtaaggaaaaagctgaagccctttgccccatttcccagaggtaaccatcattacaagttccttgtgtttctgcccagaaatgttatttgcataagcatagaatctctccccagccccatttttaaacaaagagatatattctgcatctaacattctgtactgcttttgtgcttaacaagataacttgagccgggtgtggtggttcatgcctgtaatcctcaagctttgggagctgagacaagaggattccttgaggccagaagttcaagatcagcctgggcaacatagtgagacccgatctgcaaaaaaacatgtaaaattagctgagcatggtggtgtacacctgtagtcccagctatttaggaggatgaagcaggaggatcacttgagcccaggaattcaaggctatagtgaaccatgatcacgccctgcactcctgcctgggcaacagagggagaccctgcctcaaaacaaacaaacaaacaaaaaacaatatatcttaaaaacatgttcatgtttcccataagaataaagattaacatccctctctcccttcctcatcgcctttggggtgtggcctcatgcctcccctctgggttgtgcccaaacttctctcaagagtggatcctctcactgtctctacttcctgcctccccagctactgactgtaccaagactgtgctttctgagggcaccaatgccctccaccttaccaaacccgctagaggcttctcagttctcatatctcttactctccggctttcaacacgtgagccatcttttccttgctgcattgcaaagccacctttatctagcaatgaattcccatttgtatctgggtctatttctggcctttccattctcttccattgatctctctgtccttgggtgcaagttttctgatgacctgacttgattcatggataaaacctatactcttgcagaatgaatgtccttcactcaatcctccataaataacaattctttcaatagagcttttctctctttcttaataagagatagggacagcagaggttcacgtatttcctggcaaggcccagaatgccgttattcttgattgagggcagagttatcagccaggcagatagtggaattgatatccctgtgtgaaaatggaagagccaatctgagctgtcgccccattcctacagaactagctgcccgtctttgaattcccagtgctcattcaggcctctgcactttcacttgagcacatctggcccccactttctcctttcctcctctcttctactaaatagtaaaagagctcttcttcacatctcagctcaggtgtccccttgcccaggaaacctttcctgaggctcctccctatgccccacattagccactctgggcttccctctgccccagcccttaacacaacagaatcaacatgcctgtaacagaattgccctatgccccctctcccctagaccaccgtgagctccccaagggcaggacctgtctctcagcagacttttactcttgttaccgaactgatcttgggtctgcccacccggcacagtgcagccaaacactgatattgggattgcagccagagaaagtgaggcatttattgcagggcgccaagcaagcagaattgggcagctcatgcttaagatcagaactccctgatggcttacaggtaagggtttttaaaggtagagggggagaggttacaggcaaaatcataaattaatacatggagactatgtgttggtttggcctaaaaaggcaaagcatcttgaagcggaagtttgggagtgtggcaagtgaaaggtggattcaaagatttttcagtgttgtgatgggttaaggaggtgaagttttgtctaaaattttggtgtaggcagaaaagaacgttagctcttgcccgtgggcatgatctcttccaggtccctcagcaagaaacttaggagaaagcatggtggttggagttcggtcctcagcttccccttatccaaggtctctgtgcctgcagatggcactttccatttggtggaggtctgggtttctgaaacacaactcagggacgtaggttgagatgttatctttagtttctacaggaaaccaaatatcctatgactctaatttccttggctattgtcttaagctactattaccttcttgcttgtcaagttgcgcatttacttttcaaggcttgctacgtgcctggaatttctagattttcctttatttccatgcttggggagaggagtgcctggcaggctcctaagaggggtctgtgctccatctcgccccctatcttgaactatcggttgggtgctctagaatctgtatggggtggaagtgttcattcattttctgtacaaaagcaatcaatgcttattgtggaaaacccaaataagagagttgctctaaacaacaccctccccagtcccaataccttgtccagaagaaaccactgtttggtgagtatattagtcaatgtctgcagaccagatcggatgaccaagttttccataaatggatggccatccacttcccttcaagggcgagggtagtttgttctgatccatctcccttttcacagctcagggagggaggaagacccaggaaggagagctgccacagttactagtggcccagctgggatttaaagtccgccgtgactgaagcttggctccacatgccagtctgcaaggccctgagtgccctcagcagtaattccaagcaaagcagggaagcagcgggccaggtgctgaactgaactgctgctcagggctcctgagcctccccctgcctcctccctctcttctccaccctggggcctctctctctgtccctacttcctcctttagatcctctttcccctgaacccactcatttatcaccttttgatgagttccaccaggcagaccatgtcaggaaatttcttggtgttcattttaataaaacttaattattaagacagcctcacaagtcatgatacatttactggttcatttttcacatctccgtcagaggcctcctggcagccacgtgggaggcatgaaggctatggggtggaagtgtcagagccttttctggcctcctgcaggagctgggtttggggaagcagttcctgacccttcctctgccggcccacccccgttattctccagacgctgaggatgggatggaatgagcaccaaacatggagtcaggagacctgggactcaatcctcctcctgctgcagactatgctcagaccctgctgaaggaaggcatcctctctgggcctcagctgtctcatgtacaagatgggaatcatctcagtccaaaccagacagagccactgtgagattcagaagaaagctctcgcaatgagaggcctccccaggcagatggaggcaaaactgcaagggtggattgacgctggggcggcgcctgccccacagtcctgtaggtccgcccgcctgggtaagggatggggtgaaattgggggtctctgatgatcacagtaataactgactttttaaaaaattttatttttccataggttattggtgtacaggtggtgtttggttacatgagtaagttctttagtggtgatttgtgagattttggtgcacccatcacccaagcagtatacactgcactccatttgcaatcttttatccctcgcccccctcccaccctcccccccaagtccccaaagtccattgtatcagttttatgcctttgcgtcctcatagcttagctcccacacatcagtgagaacatacgacgtttggttttccattcctgagttacttcacttagaataatagtctccaatctcatccaggtcactacaaatgctgataattcattcctttttatagctgagtagtattccattgtatctacatataccacagtttctttatccactcgttgattgatggacatttgggtcggttccacgattttgcaattgcgaattgtgctgctataaacatgtgtgtgcaagtatctttttcatataaagacttcttttcctctgggtagatacccagtagtgggattgctggatcaaatggtagttctacctctagtactttaaggaatctccacactgttttccatcgtggctgttctagctgacattccaacgagcagtgtagaagtgttccctgttcactgcatccacacctacatctactgttttttgattttttattatggccattcttacaggagtgaggtggtgtcgcattgtggttttgatttgcatttcccttatcattagtgatgttgagcattttttcatatgtttcttagccatttgtatatctttttctgagaattgtttataattgacatttattaagtgctttgcagacgctgtgccaaggatgtcatgttgtcatatgtattagctggctaaatctcacagttgctgtacttgttactaatattgtaaaatgtgtaccagtgttatgcccattttatagttgagaaaactgaggcatagggaggcaaaagcaacgtgcccgaagttacaaagccagtcaatggtggaaccagaattagaactctggccaactccagagtctaccttcttaccaataaagtcatcacccctgagaaatcagggaggggccaggagtttttaataatcaaagcaacctcacaccgaagtctaagggaaagcagaggttcggctgagcaccagggcccctggcagctcagcatgggggccgtcagtgacacctgcactcatgatatcccacacctgtggtcttccaaggggacagactgaactcttgccacttcatccacaaagcccccctctatttcctcctttccctcgactgcacttccttgataacagacccaattttgttcagcaattcacccccagggaagctgacccacaaatcccatgatgccaacagggtcccagtatctttgccagttctctgacccagcctcacaccagggtgtggcatgagcaacgagacagggtagtgttggtgcaggtgacacagggctaggatatggcacaggaatttagaaaataattagactgcgttgggcgtcaggacacaccactccaaaatatgactgtaggcgaccaggaatctgccacagcaaaatctactttggcatttttcaagctagttattatgagaaactgcagacacaggagtagctctgaaaagctgtccttttgtaaaagaaatttacatctataaaggaaatccacattagtaaaacaatctgtatcaggaagagggctgctcagagacagcttctattacccgagaggctttttatctttataacgagacaacctttacttatcatacatttcctccccttaccctccaagaactccaccatctccgagaaacccaaagcacccctattcctttctgtagctcaggatgctacattagcttcaatcatctggccctactttgagtctcatgtattgtgggaacccccgccccccatacctatgcaagtaattataaatgtttttgcttctgctaatctgtcttatgtaaatttaatttatagctcagtcaaagaacctagaagtgtgggggttaaccaccgttccctcccctgcaagaggattggtctatgagagaagtcagcttccatttatcgagcacctagtaagcaccaggccccagaccttaagctttacatgtgttatttctgattcccatagactcctctagcttcagtggtattacttgcattttgctgatgaataaacggaggttcagagagggtaagtgacttgtccaaggtcacacaaccaggaaacagcaatgctgcgagtggaacccaggtgttgtgtccgtgggtctgtggtctcgctgacttcaagaatgaagccaccagaccttcacggggagtgtgacagccctcaaaggtggcaaggacccaaagagtgagcagcagcaagattttttgtgaagagcaacagaacaaaccccccaccgcgtagaaggggaccccactgggttgccgccgctggtcagggtagccagcttttatttccttatttgtccctgcccatgtcctgctgattggtccattttacagagtgccaattggtccattttacaaagtgctgattggtccactttacagagtgctgattggtctattttacaaacctctagctagctacagagtgctgattggtgcattttgacagagcactgattggtacatttcacaaacctctagctagctacagagtgctgattggtgcattttacaatccccttgtaagacagaaaagttcttcaagtccccacccgacccagaagtccagctggcttcacctctcagtgtgaccaacctccaagcttttttatttcattgcttggcttccctctctaccatgtccatttctgcacatttatttcagcctcacattgaccagctcctgcgtgccaggcatggcctaagtgttattcgaacaaagcttcggaagctagtccacttgcttctgtctagaagaggagggcggtgctgggaggaacctccctgactcctgctgcagacccactgagaggtgactcccacacggctgtcctggaacaagacagcagcttttcttaggttgttctaagttaagggctctcactgctggtaagacagggaaatagaggagataaaaataacaaaacaaaaggagaagtcacaaagttacaggaaatctcaatatatctttctgttctggatgctgctccaaacacaactgcagcagggcctctttgtggggggttcttatttgagagccacaaaggacctcaaagccaaaacagactgattatctagcccacctccatgtcctcccctccttccccctacttccttactaacagacccaattttgttcaggaatccaccccctgccgagaagaaactgatcctattcccagctcagagccaaatcctgaatcatccaatattacccccttgtcaggagtaggttgaggggtgacaagtggcccatgctttttctggggtcagggagaagaaatgattattagaacaattttggtttaaactttttttttttttttgaaacagggtctcactctgtcacccaggctggaatgcagtggtgcgatctcagctcactgcagcctcaacctctgcagcctcaagtgattctcccacctcagcctcctgactagctgtgactacaggcctgtgccaccatgcctcgctaatttttgtattttttgtagagacagtgttttgccatgttgcccaggatggtctttcacttctgagctcaagcaatccatcagccttggcctcccaaagtgctgggattacaggcatgagctactgcacccagcctaaacttgtttctaattagcagttccaaatttttagatgctcatatctctgactaattacaataacagatgatgaaatatcgaagtgttgaactgtcctctcaattccagccggaacaaacagattctgttttctctacattttgactgaactgtcttggtgtcatacattagatggtaaacttctcctctgttccaatctcccccttcttcatggctaattagttaaaagcacactgttgataaacacaatatgaatagaaaaatttttgtttagccttaaaaaatagcagtatgacaatttgtcttgaattttgacctttcagtggtggcttgtatcaaagttacggtcttgggatagtgctatgacccgctgaaatggctgcgggcctgaaattttgatcgtaaggcaaattttggtacagaaaatcgcctgtttctgctgacttctgctttagacatccactcttaaggaaaagcattgttatcccaccagctaacacatcactctctaccatatatcaaagagtctcaagatccttctattcatgaaaaatgaaaatattctcaccacatcctcgcagtaatgttcaacataaattaccaagcacagagacagtttgggaatgtacattataaatggccttccctacaagactaagagtgaatcctaatgtaaactatagactttgggtggtaataatgtgttaatgtcggttgacagattgtaataaatgcaccgctgtaatgtggaatgttgaagtgagggaagctgtaagtgtatggagacagataaatgggaattctctgtactttctgctcaattttactgtgaacctaagactgctcaaaaaagtagaagtaagtaaatacataagtcagtaaataaatggccttttcttgggctgagaaatgaagacatttcctatatgttacttggacctgtaaattcactctggggagatatatatatatatcagaaagtatatgttacttggacctgtaaattcactctggggatgtgtgtgtatatatatatacacatatatattacatatatatatatacacatatatattagaaagtaaatatttcttgttaaaatctgagatataactgccctctaaaggtgtttatttcctgggttggcttttttgttttgttttgttttgtttatttgtttttgaggcagagtctcgttctgtagcccaggctggagtgcggtggcacagtctccactcactgcaacctccacctcctgggtcccagttcaagcaattctcctgcctcagcctcccaagtagctgggattacaggcacatgccaccatgctcagctaatttttgtattttttagtagagacacagtttcaccgtgtgggccaggctggtcttgaactcctgaccttgtgatctgcctgcctcggcctcccaaagtgctgggattagaggtgtgagtgaaagcacctggccgggttggctcttatctatttacttgatagccaggtttggagtcattagtggctgttgcttactccttgaacaaacatttttgagtgttgtgctgtacaggccactggatagatagcgatgaatcccacacagtcctgtcctcagagcccacatcttcatagatctataaattaatatttgcagtagagtatgacaaaaaaactccaatagaagtgcctccagggaagatggtaccaattgaactggttgctggggaggtgtcaggggagggttcatggcagaagcctcattgaaggatctcagaatttcatgcctcctgggaggttcagtccaagacacctacctccatctttcagtgcagagggcacatgaggggacctgccaagatgaagccagagaggcaacagtggtcaaatgatagaaggcctggggcgggaaggggcaggtaaagatttggggctttatccaaatggactttattgtagttgtattcatttgataccttttgtaagttccttgtttagttattacatgattatcataaagtttgggagcataatggttagaaagatatcacagacttaggaaaaggatgcatgttcctttaatttggctcttttaatggactgagagactatgcaacgctcatggctggaggacaagcttccccggccttccagtcccataaggacacctgctgttaatggcagtcctgatggagtgtagatccctcgggctgccatcctcacaaaggtgtgttactttctggctggcagctccagatggccctagggactctgaactcagcctgtgtccgaaggcttactgcaagactgtgcgactccaccatggtcagtttccccggggaaccatctctctaccaagcccagttttccattgcaagaacaattgccaagatgtctaagtttctatgtgagaattttggcatcttgggttccttttaaataggacacacttgtatgctctaaagaaaaaaagaaaaggtttctcatgaagcattagctttcaagattacagttcggtaggatgttcaagatgcttagggtgaataaaaatgacagacagctgaacacttcctataaatgaaacaccaatatagatctaagtttcatgcatgactctcaatgtggttaatgaaaaggaagataaaaaaaaaaaaggttggccatatttgcagggcatttgctcccaaatgtttcaatcctgttttctttagactttgaaaagggggattgcacgttatctgtcaagaaggcatcaaagcagagaaatccacaaatgtgtagtgtcagatagaattcaagccttcagaaaggactccactcctttggttactaagagaactaggggcttgtatttctaagatgtcactagctggaggcgctgagcaggtaatggtctatgttttcctagactataaaatcctgattatatggtttaataaaataagaatctcagagttctgatggaaaacaagtaaacttcaggtcttagcaggcactagcagaaagcaccagagaaaactgggggagaggttaggactcctgtcccaaagatccccctcaattatcctgccatgttatcagttccctctttacatgttaccaaacatgactactaatttctatttttttccaagactattagatgtattcaaaattcactcttcttacaaggatagagaaaagtgcctatcgatgcttaataacccaacatatatttaatagaagaattaaatcaccttctgcaaaggaccaagaaaagctccatttgatcaattcctttaagacatgaagacttctccttttctaagaatcgccatagtaaaatgcaagctcagcatgacataccccaaggaaaaatgtatctgtcccttctgcttttactacagttccataagggtaataccgagttgttttgcccacatgggggctctggaatcttggctgtgatgcattggtaggatatttgtcaccaaaactgactcagcaatcagttaaatattaaacaaagcactgattagtgttcctgattcatatttgtgctttgtttaacatttaacttccgaattttatacatctattaaacaatattcctcttgacattcgaacactatctgcacaattaataaatcaaaaacttattaaaaattgaaacaattaaaaattcccaaacttataaaccattgtttacaaaattatttaaccacactctccaacacttttaaataaaaccataagtttaatatgtcagacccttttaaatgtttcaaacacctaaaaagtcagcaaaaatgcacacaaaacgtcatactgattgaaaaatatatatgcacacttacctttacactggttacaaaggcatgaagattatgggtatatattggttttaaaaagtacttttatacttattcttatattttctctgttactttcttagagtcaatgcgatcgtttcctaggattagagtatgaagtgatacagtttctcctaagaatacaaatttctttcagaaccaaaagaaaaataatctcaggccagccagctctggggttactgattcttatttgaaactgataaagtgtctcccaacattattgcacttgagcttaaatgtggcctaagaatataaaagtccgtgccttcacattggtatccttttctgagaccagagtgtttcctaaagtgcgcttcatctcctaggagactagggattttttttttttttttttgagacaaagtctcgctctatcacccaggctagagtgcagtgttgtgatctcggctcactgcagcctctgcctcctgggttcaagagattctcatgccaccacgcctggttaattttttgtattttttgtatttgagatggggtctctccatatttcacaggctggtctcaaactcccaggatcaagtgatccacccacctcaacctcccaaactgctgggattacaggcgtgaggcactgcacccggccaagacgaggaatttaaaccctgcagtttgctgtccttacgagcacatttggccaattatccttccatgttatcagttccctctttacatgttaccaagcatgactactaatttctatttttttccaggactattagttgtattcaaaattcactctttccttcttacaaggatagagaaaagtgcctatcgatgcttaataacccaacatatatttaatagaagaaataatatcacccatatataaatctgccattaaaaataatatgaaataaaaccctatcgcatttgccatttacatcaacttttctcttcatagcttcattaggaacttacagctcttcacagactccatgtgttttaattgattatagccatcaatcttatttgatattcaaaatctcagagcttgaccagaggaaacctctttaatctagcttcttagtccttccagaaccaccctgtgatattctagaaagcatccttgctttctggttacaaaagaaacttccaggcttaaaccatttgttttaccctactcaggacaacccttccaaagagcccctgtttctttaagtggagaaaactgttagagacaaagtctggccatttaggggtacaggagagttgtggtgggcattagtactactcctgctgctgctgctgctgctgctgctgtgtccactgttagtgacagaagtgggaaaatatttaagttgagttcacattagtgttcccagtttagcgtgagcattgctccattatgttgttctaatgtaaaaatgtcaaacacatttttctcaatgagatacttaacattttaacccttcatccaagctatatgttacacctcacttttctatagttgtatatttagaaaataaatatttatgaaatacttgatatttctcatcaatccttggtcactcaattgaagggtgtagaagtaaggtcaggttcaccttagtgaggggcctgcatctaaccttatctgaaggggcttatgaatttgggatttattaccttgacagaaagaaatattgagaatgaccccacccatgctttatagcaatcgctctttatagtttatttcatagtgacaagaaggaactcatccatggtgggtttttccctgagtggtctgtatggtcatatcagaactgaaatcatcccttcttgcttctgagcccccgtttccaagtcttgttctttgtttctgtaggtagtaaagtgaattctttaaatccctgccctccatcagctgctaaagcattctgcttccctctgataagattaacagaatgttggctgtggttacgggatgctttgcagtctatgtcttaaaccaagccagccatgttagcatttcctctagtggtggtgttttaggccaattgagaatgtgggtgatattaatattttccaaccagctgataacaggaaagacacttctgcttggagtccactttgagaagagatttattatttaggcagcacaggacacctccattaatcttcccccagcagtgcccatctaccatcaagttcatatactttccccagggttcaaagaagggtataattttagccagcgattagtcaatatttatcaataagaataataacagtaaaattacaatggccaatgtttgaatccctaatgtgtgccaggcacagtacggggccttttgcagctattatatcataaaacccttacaacagccccatgaaatttgcaccatgatttgcttcattttacttttggggaaaccacggatcaagtaactgaagtgatttctctaggactcacagatgagcggtggcagagcctggaattagatatatctgatgttagtgttttgaggaatcactctccccaaaagccatagctcccagacattcttatgtaatttgtctttgctgaggcttgggtattgatgatttaaaagtccccagagaccagatttcatctggtatgctgtgggagtcaagtaacgtccaaggccaagcctgtctgagagaggtttttattagctccaaaattataataacttccacagccttcttccaccaattctgccttccactgaaacagcgctggtgatgtttagaggtatgagtttgggacaattatcaggagaagcattttggtgctattgtcccaccccttctgtcctgagaggttttatctggtctttcagtatttcaaataggtcatgactagattccatgcatccctagaaaacatagcctaaattttaaattaaagtatgaggtggaagaaacagcctttcttcccttttgtttccaaggacagatggagtcaaaagtggaactggggcccgcagagccggatagcttgggcagtacgtgtgtgcacctgcaggctgtggagacaggtatttccatggagctcactcgccctgcctctcatccaggcctgaaaatcataggtaactatgaggcaagaggaacccagggtggtgggaacaccctagggtgatcccaggctggggacctttggactaaaaagatgaaagccaacattccctccccaggaggagatgcaactcctgcactctctagtgaccatcactgggatattgcacagatctgcagtcaccttctaaatccccttaaagtggacctagccatcctctccattttaagaccacatctcctgtctgctacagcccctctcgcttctttttctttaaggatatctggctggttgtattgggttaacatgcaagaagagagtaccaatcactccataacttgggtaatgcatgtcaatggtgatctgtgtggggccgcaaggttccagatggttgggacaactctacaatcagtcacatttgggttggttaaatcccccactcatctttacagctgtatcctgcaagttagtggctgcctgtctctgaacttcaccttccttatggttgtcaaaaatacctccatgggataaaaacgcagcatctgtagattcccaaataggtgcaagtagattcccaaataggtgcaaataggttcattcgttggttcattctgcagtcagggagctttcagtctactggcatgcaagacgcaatgataatgagaatacttcacaatgagtgtgacgtgatgactgatgaatgtgacaaaggagaagtaggatgcacttagacagcctgggggaattgagttgtggccagaagggagagagagtgtccattctccacctcatcactttgctgccaagagaaacaggaatttcttagacaagttctcaggtccctcggtgagactggcagcctaaaaaaggcaccagggagcagggggcactcacatcatgccatccccccacagagcatcccgctggccatctgcatcagcccgacccccacaggatagaagactggcacatccaagttgctccttccacaccctctccccactgaggcctcgtctcctccgccctgtggccaattgaaggtgaactcctaacgtgcattctgcctgggatcccagaggttgtggcagccagatgagtcacctcacaaatacagcacgtgttcctcgggggcggcggtgggaggaaacacgtgaagagctctctctgtgataatagaccatttagagcttcagatggcgaaaacaagctgatcaggtgcaggccctccaggaggctggcaggtgactcccagccagcacgccctccatcgcacgttggggaagctggaaagagcctggtggctgccgggcctccctctggcatcctctctccctccaaggctgtgtgctccccaccttgtctctccttttttcattccattgctctgttctgtttctgtctacccattcgtcttttcttcctcttctctttctgttgccattctctttctcttctcctctcaacatgtccttctctctacccgtttccccctccccttctctctctcctccctctttccctctccctctcttcctttcccaaatctctcttagccaggctccttttcgccctttgcctctcaaaccctcctccacctttccaccctctctctgcgttctgcttctcccttcttccttccgtgtctctggctcacttatctgccctctccacatcttcttccatttgccaccctccctctctgtagccacacccagtgggctcagagctgggtctttcttttttttgttttttcttttttctttttttttttttttgagatggagtttcactcttgttgcccaggctggagtgcagtggcgcaatctccactcactgcaatctctgcctcctagtttcaagcaattctcttgcctcagcctcctgagtagctgcgattacagtcatgcgccaccacgcccggctaattttgtatttttagtagagacgggatttctccatgttggtcaggctagtctcaagctcccgacctcaggtgatctgcctgcctcggcctctcaaagtgccaggattataggtgtaagccaccgcacccagccagatctaggtctttcatccccctacacaaccctggcctggcctgggcctctggtcttgggcctggaagggagtcccatcctccctccctcagctggatttcttaaggataaaacctttgctccttccttcaccacacctctccacatcccaaactcaagcccacagagcccagctctgggcccagggtgtggacggggagggtggctggtggcccagagctgagccctgtgagtcaacagcatgcctagactcacacacagacacatggcccaccttcagggtcatgaggattcataaaccctattctgcgaagtgcctccaggaatcatcaagggagctagggcagctctgagtctccaccaggcccaccctccgcctctcagggctgagcttcacttcccttcccaaaggggccagggagaggggctgctgatgacatgatctcagaggaaggccaaggcctccaggctgcctctgggcctggcacaggaaggaggaggagaaaatagggagcccaaggaaagatcaacccagcccagcccaaggacccccagccccagccccagccccagctgggctcaaactaattgaaaacagactggaaaaggctgcttttgcccttcctctagactcagcatcatcaagactggagggacagagcatttgaatcatcagacgctgggccagacgtcaccccacgcgttttctcattttatcgtcctaagaagcccagaaggtgcgtaaaatggcctgtcccaaacagatgaggacattacctttctcctcttcctcctcctccttcttcttcttcttctttttgcttcatttttctttcattttttcccccagatgttgcatttcagagaggctgagcgtgttgactaaggtcacacagctacaaacatcagggacctgcgaaaaagctctgttccctggtgacaggtgttctgtgatcctaacacagccggaggtggggacaacgtccttgcagtaacaaaggccctgttgctcaactcagtggacatcaggccctgttttcattcattagcaggtcagggattccagtgtcacctgtgccatgtattccagctgatctacctgcaagcctctactccccattttcccagcagcagccgcagacaccacccaactggcagaaatttcaaacaaggggttctgccttgcactccggtgcaagggttgggcacgtggactcacatgtgaccaatcacattgtctttcctgagatcctgcattttgaccagaggaatcaagaacaaaaagtggtggcaactgatttatccttaagaaatccaagtaatgagttcctgctgccaagatttctgggatttccctggctcctgccagtttctggatttggttcttaagcattttctgggtgtgtgagccccatacccttctcatagcttcttcagccagagtcagtttctggtttttgcaatcaaaaataacccaactaagatttgctatcctgcaggcaagagagggccacagcttgatagtcaaggttagccattgtctgggccctgcctgccccagccagctttctttcctccccagcctgtacctgccaccctgagcacaccacactggtacacgcctgtgtacttgtcttttatggtctcactataatttatttaatccctcattaatgaacatttctaagttgaagtataattcatgtattagtcagggttctccagagaaacagaaccaacaggatgtgtgtgtatatatattatacacattattatatattacacacatgcacacacacagacatatctatatatctagagagagaaagagatttcctttaaggaattggcctacatgattgtaggggctggcaaattcaaaatcggcagggcaagtagtcaagggaaattcaaaattggcagggcaagaagcctagggaaaagttgcaggcagaattgtttcttcctgggagagacctcagtctttttccctgaaggccttcagctgactcaatgaagtttacccatattatggagagtaatccactttcttcaaagactcctgctttaaatgttaatttctttgaaaaaattgccttcacagcaacatctagactggtgtttgaccaaacaactgggtactatggcctaggcaagttgacacgcaaaattaaccgacacaattcacataccgtagcataaaatgaacccttctaaagtgcacaattccatgtttttagcatgttcacaaggtcatcatcatcacgatatagtcacggaacttttttttttttttttttaagacagggtctggctgtgtcacccaggctggagtgcagtgaagtgatctcaactcactataacctccacctcctcagttcaagcaatcctcccacctcagcccctcgagtagctggaaccacaggcgcatgccaccaaatccagctaatttttgtattttttgtagagacaggggccatgttacccaggctggtctcgaactcctgggctcaaggtatccacctaccctggcctcccaaagtgctgggattacaggcatgaaccactgcgcacggcccagtcacagtacatttttcttgccccagaaaaaaaaccctgactcctcccagctcctggcaaccaataaacacattggtctgcatgttgttcatgctggttcaccttcctccttgcctccctttgactgcctcataaatttccactcattcctcaagagttagcccttctgaaatatcttccttgatcccacctactagaagcaccctgtcccacctcaaactgagtcaatcactttattttctgtgaacccccaatataagctgatggtgcctcctggaatagcctttagcaaaagatattaaaattgcctaatcaacttgcttctctttctcaccaaaccagcagttcttaaattatgatttcagggcttcttgacacttaccccatatttttaccatttgatgtgcttgtgtttccgggaagagagttcagggtttcatcagatcttcaaaaggatcccaggaagggccaagagccttgagattagggcttctcgaagggcagaggcatgcttcatgagttcccttgtgtccttatgcctggtgcagatgaggtctgctggatgagcctgggtgatgaatgagtagtcacatgtaggaaaagtgtccttccttcaagggttttccatcatcactctctatgaagcagtgaaaaagcaaaacaaagtaacatacggttaagcatcagaggaggaggatagacacataattacatattcatttgttcatctgctcatccattcacaatttagtgtatgcatctacaaggtacaaagcccagtgctcccagcagcgggtgttcagagctccgagaagcaagcaggcaccacatgttggtctcagaaggtagagagagactgtaaagtaaaccaaggaaggctccctgggggagaggccgcatgacatgagcgaagccaagagcaaggactgggactcagccagatggaacagagcccggggaagggtgtcttgagtgtgtgtgctggggggagcatccacgtgagcaaatgccaggcctgcagaggacccagagaagggagagaatttacacacccacagtccctgaagcctggagaggactttttaagattcccggtgacggtgcagagaagctgagccggggcctgactacagtgaggtgtggggtgtaattaccaagccagagtgcagagctgagccaagcaggtaagagtactgaccccgagcccactcgggctctgagcagaaggaagatttcattagtgttagagaggaaggatgtgccttctcccccggaggccagagggcaggagaccagccaggcggggaggctgacccaatggccccggaatggtgatggagcagcctgggaggctgcaggcactgaaggaagaggtaggggacgatgactccatctgtcacctcggcacttaccccaaaagatggaggactgctggcagaaacagacagaaatttcccttgagaaggagaaagccatgctataggcaatcaagatttgcacattgtcagcagagaaggaatgagactgtctggttgccgctagactttggccagggctgtcctgcaggtaagggcctcgtgcaggaggcccctgggcaagggccggcccttctcctctccctcagtgtcctggaaaggccccagggctgccccaacccctgacctctctccttctttctccatattgctagacccccttctcttggtcccctgcctcctcccactggtgtgcacccacaccttcagacagttctgagcagaccacgcaaaatacaactgtgatgttatttgcagcaggcattctggacccagaactgtgcttggtcttgaagttgaaaggtagcaatcactcatactcctctcccatgaacaatttgagaaaaaatggaggctcagggcagaagttaccccctttacaactgacgggagctatcctggggaatgaagcctgaggctaaaacctatgccctatttccagcctcatgaagtaaacttagccactgggtccctagcaaagaaactggagaactgagggtctcccccaggtctgccctccaactgccccaagccccacatgcctgcaggcggccctgggatatctgccatgtgcagggaataatgagcctggcagctgcaagaaggagatgagctccagggtttgagggttaaggacattcaccagtctcccagcacactcatctccaccccaccccagtgaatgagactgagagggctcaaggtgggggcaacaggttctctccattaccttccagccaatacctgcatgtacattgagatactcagtaagccatgagaagcgctgtgtgaccatgactgagttgtttaaactctctgttcatgctcctcccctgcaaagtgaaggcattcaaaatcatctgtattcatggtgaacctactttgttctaaggcctctgggacatccaaagttggataggccatgtccctgacccagctgactgctctcacccttgctttcactgtgtgaaattctcccacattgacgggctgggggtagggcaactacaattgagaagcacaagggagccccccgtggtgatgaaacagttggtatcttgactgtggtgtttacacaaatctatgtgtgtgataaaatgacacagaactacacacatacacacacccataagagtgcatataaaactggttagatccaagcaaggtgtgtggaccatgccaatgtcagttttttgactttgacattgtcctgtggttccctaagatgttaccactgggggaaactgggtgaagggtgcaagggcctctcagtattattatgggaattttctgtgagtctataatcctttcaaaagaaaaggttattaaaaaatctcacatgacttctcactactctgcttataaaatccacactcctcacggagcaccacaggcccgctgtaatctggcctctgtctcctctccaacctctccccaagctccctaggcccagccccatccccttctctctgcaccttgagcacacccagcccactctgtgaggctgtaggccttgctgtttcttttacctcaagttctctcgccccaaatcctaaacacaagtaacttctgtcattcaaatttcacaatcagtctccttttcttgtaaggccttctttctcaggctgatcccttcagccctaatacagttggcccttccactgtgtttagggtgctacatcaccatcacctcttggtttttggctaagatcaagtgtagagtcctgctatcatcagacatgatctgattcgtttgtttgcttacctatcactgtcagtccggacctcccctccctctgagaatgaagcagagaaaatgttatcttggtcaccagtgtatcctggaaactgcaacaggggcaggcacaggcaggagtgcagtgaatatcaatggtagatgaatgaatgaatgaatgaagaatgaatgaagaatgaatgaatgaatgcaccacacaaagtagcattctagcagaagtgaaaacaaggttacctagtgcagactttcccagccaggactcatactatttttaaacacatacacctgcttcggtgatgtactgaaggcctcaggctactctccccgcccacatctcccacccctctaacaggattcaaatctccagtgctcatatttcctcctcatcacttacctagcaaatctggctcacagtataatatcagtcatttatacttcagtctgaattccaggtcagtgccaacttcctccagatatttgtggtttaagcttcatgtgatattacgtcatcttaagggcatttagtaaaggggaagaaggaacatttttggacagaggccttttcctgtgctcatttgtgcctcacaggaagccaagagtaaatgtgcatctagacctacaggggaggtcttggcagttacagcaaactcagggaattttaaatatgccggaaactttccagagccctgagttgcagtcccagctctgtcactgtctctctgtgctttgctaaacagacttcgcccctccgtgggccgtctgtgaaaatagggcccagctcgatggcatataaaggccctctgacttccagtagtaaaactctagaggagcccttgttttctggggagactctttctgagttttcataataatgttgagtagttctcttttcttgctcacgccgacttttctccagttctcggacaccagttctgggtacccaacaattcaatccagttctgacactaactatccagagttagcagaggccccacaggttaaaggcctcgtcccacaaaactgcccccacttcagacaccagtggccagtctcagaccccctgtacttctgaccaaccagctataagtcaaggattcctaagactccttcctcaggtctaataatttgctaaagaagctcacagaactcaggaacacactttacttatgtttactggtttgttttcaaggatgcaactcagaaacagccaaatgaaatgactgaatcaggcaagatatggggttgggggatgaggcatcgagtttctatgccctctccaggcatgcctttctcccagcacttggacgcgttctccaacagggaagctctccaaatcttggtgcttaggggtttttatggaggttcaattacataagcatgattgatcaaattattggccaatggtgactgactcaatctccagcctcttccttctctccagaagttggggatggggctgaaagtctcaagcttccagtcaaggcttggtctttttggtgaccagcccaatcctgaagctatcaaaggctcaccaagagtcacctcactggaacaaaagatgctcctataccctcatcactcgggaaactccaagggttttaggggctttgtgctaggaatgggagacagagaccaaatatctatctatttatttatttatttatttattttttgagacggagtctcactctgtcacccaggctggagtgcagtggcacaacatctgcctcccaggttcaagtgattctcctgcctcagcctcccaagtagctgggactacaggtgcccaccaccatgcctggctaatttttgtatttttagtagagacggggtttcaccatgctggccaggatggtattgattccctgacctcatgatccaaccaccttgacctcccaaagtgctgggattacaggcgtaagccacctcccccggcccctttctatgacaccacagatgggcacagtcagaatcagagcctgaggtgcaggtcaaatcccttagccctccaccagtcccgcccacttggtttctgtggtagaaagttttgtttactatctgtatctgtatcccccaccaaatgcgagctcccccatcccaccctgatgctgaactgaggacactcagggctttgtgtggctctggcagcttgcacaatgggttctcagatgaggtattccatgcccttcttcctggagtagtaagagtcaatgcttttcagttcagcagaaattcatgagatattagaaagcacttcctagatctgcgtagaagttggaataggttgcatatagaagctaggaaggttccatccctggagatctttaggaagatcccattgctctgggtgactcagtcgctcatttcaatcatgaattacaggcattatcgagttaagtcaccatggtggctggacctgctttctccaaagtccctccagctgcaggttggtgagcccatagatggggttagtgaagcattgttggtcagctcaccagggcacccttatgagagtgaagtagaccgtgactcctctgcagttggttaaggaagaggacactgaacaaagtcatgtgttaagagtggtgtttggctggcaaattctgattcatctttcaggaccctgctcaagcatctcctcttttgagaagcctggcctggccctctccccatgccccactcttccttccccaggtttaattaaatgtctcttctcagctggtgtgacctcttggttgattgcaaatagtgcatactccactctctctccacggaactgtgagctttctaagggccagaaccatacccacctcatctctcactgcctccctggtgccatcgcaggacaggtggggcagagcaggggcccggtggctgctggctaaattgttggagggactggctgggagcccatacatcacagacagcagataccccagggactggcagtgtgggaaccaggtgagaagccccagtctcaggtctgcagccttcctcagtctcctcactcagtagccttgattcccagcaaaccacatcaatttctcattgcacaccctgctcaatgctcatctgcatagtgtcctccatccagagcagccctgagctgtgggcacgaatactaatggatcatgcaaatgccagcctagggcaagagtgccctggactgtcaattagctccccccagcaccagctacagtgcccaaccccttcacttgatacaggccagcccaatgcaagaaggagcaacagaaaaagaactcggcttgaaggactgctctagtcaaggtagtgtgttgtggcagcctggaaagggatcttccatgtagagtgagggaagaagagagccagcctggcctctcaggaagaggttcccacaggcactcttgggaggaaaggtggtgctcttgggggcccaggtaataattgctacacgaatgccacggctcttggaactgctgcttcatccttttccctccacctggccatctatgtgccaggccaccagcgtacgtcctgtgttgtcctctaaaccaagaccaaagctcttcacagccactcttctctgacccagtaccaactccatcctgggagggaggatgacaggctccccgtcccctcacctcttcttcccaatactgctgtttcctcccagttctttctcttccctccactgctcccatctgctttccttccttagtggataaaagcattaaatttgaaggcagagagatcgggttcaaacccagactctacagatcactcaagctttgtggcttgggcgaattacaccatgcctctgaacttcagtttgctagtctataaaatggagaaaagagaagtacctgccacagtggcattgtgaggatcattttatgaatagctaagaatttcaggtaactcactctgatgtaccagaaagttactttgcttactgcttcaatcactgaacttaatttctactccaagttcccattcctctcagtggcagagaaccctcaatcagttcaggatgccccatccccagtgttgcctgaatgttttggggtgggcttacggagcatggagcctgaagtgggctctacctctggtgggcagccctaccattcctacagaaaggcaccccaagaggttctgcttcctgtgcattctgtggtcactgtgccattcaggtcgcagctggggcctcccaggctctaggagggtttcctggaccgcaccactgttgggtgcaggggaagattccccttctccttaccggacttgcccaggagaggtaggtcaggaacccctgcctgaaaaagacacacaagtcagtggctgtgcaatgctcctgctacacacagaggtggcaggccttagaggggaaccctaggctgtgttcactctcccaggctccactttggaaaagccagggtctgctctcagctcccacattccgccaaagtctggggtttcagtgccaaacaggccaccaaccctcgaactctgcctgaggtggaggacaagggcaaacccctcttgctcctgccctccaaccagtcacatattcttccaggcctttcatctcaaaatccaagatgtgaccattgtttccgtgccacctctgccacaggtagtgaatgccgcagctcaaatgtgcggcaggttgtgtggtcacaggaaataacagaaggagccccggttaatatctcagttgtatgtggcctcatttttgcaggccctgtcccagagtcagtcctcagcacgagggcagctgagactcttttctcccccattccttcctccttccctcttcctgggtttcttcctttttcaggctccaattgcagcagcagcaatgctgggagcggagatcctgggagcccggagccagctctgacatgttcagcgggccgtgcagggtcaggggcatgctcatcggctcatcactggcatgattactaatcatcaggcagcggcagggttactgttccctcctcccctccctgctcacttcctcagggtcttcaggctgcaggagccgaagagggaaagaccctgcgtgcaccctggcaggctgataatcacagctgcagcccccaggcactaaaaggatgggtgggagcatcatccaccactcaaagggctggggacccttgtccctcccatgtgcatccatctctcctatctctgagtccccagtgaactgctgcctccctagagaaacagtgctagaagtcagtggcaagagcagcaggaggacttggagctacatgcagagtgtgagctccggagtcagaccagctgagttcaaggccagctccaccatctattcactgtgacttcaggaaggttgcttaacctctctgtgccttagctgcctcatctataaaacaggaaacaatgagagtctttccttatggggctattgaaatgattaagtgagatcaggcatgtgatggcacacagtaagaactccataaacagaggtcaccactgctaatgcaattattctatcacctcaggagactaaagcaggggaggaaacaccattgactcctggacatttacccaaggagattatggatccatgttttgcacacactttagaaagacaaggaattctaaccacagcatctgtctccactgcccccgtcatttcagtctcacccgtccaccctcaacctcaccactgtggcccggaaatgcggttgcccagggccactctcaccccacctcagccctgctctgctcaagtctcacttccactccttccagctcccatccctttctacccagctccaccctgatttctccaccatgacctttaccctcctagtctgatctagacccctgatcttgccgagtatctaggactttggtgcctttgaccctcagcagcagaggtagagagggatctcggtgaagtctgggatgttatagtgacttgtttatctaagtgccctgagactgtgagttccctaatgcagggagcatcaacctctgcagagagccccagagccctgctcaggtgtgatgaacaggaggcactcacttgatgccctcacaaagttgtgagtgaatgaatgaatgagtgaatgaatgattgaatgaagattagtgattatgttaatgacctgcctttttcatgagccttgcaacctcccaggtaccacactaaagcacttaaatgcttccactcatttaatcctcatagcaaccctaagacataggcgtaattattgtacctattttatagatgttgaaactgaggatcagtgaagttaaaggcacacagctaagggatgaatggataaaatcctttaccataacctttcctccttaggacaaagtttcttcaccaactgtccaaggctgtgtttcactggggagagtctgaaattctacaccaagcatgagcatgtgttcatgcagcatggtaactctgggggaaaaggttcacaggttttatcagatacttacagtttgttagaacatatttgaatccatccatctaaccacccgtcccctttcaatccacccttctgtccacccccagacagccatttgatcaatattcatgaaatatctgccttgcgccaagcatagtgctggcacccatgaattccctggtctccagaaatatccttccccctctccctgactacccctgcccccgcctcaccacacacacactccttgcaggatctgggtaactgggagggctttaccgccagtgtcccagctgcgtgggtggctgcactctgtctgaactcatctcagctctggtggagactgtggcagcgcagaagcgtgcagggggaatcctcaggcagcgcagccatcaggacatgaagggcagagcctgtgccccggcttccccggcttccgctgcagtctacatcagtcctgctccctccagaacatgatcaaccgggacagatgaggccatgcttgatgcataaggatgcagccagggagagctgcctcccaaacccaagtcctattcaaaggtcttttcttcctcctggggaggtaggggagaaggtccaagcaaagggaactggaaggggaaagtgaggcatggagtttgtgttttctgaatcaggactgtgttccagccagggagaccctgtgtcaggcacttttgtaatcacgatcactttcagcctcaccctgcgacctccaacgacattgctgagattgttctccttgcaaacatgaggaaattgaggggctcaaaggtcaaataacttgcccaaagtcacaaaacaaatccgggactttaagcctgatctgcttgacctgaaactcatatctacttccctgccctctgaagatctatatgtcctatgtcatcacttcactgttcacacaaggtgatacctggcttctccaagcacctgctaccctgaacttactgcaccactctttccttcctagcctgaatgcaatttgcaatgaggagatgatttgattttcttcagccctagacctccagcttcctgagagcaggtactcttgcctcttcttgctcattattgatccatatatttagaatagcgcctggcaggtagatggtgcttaataaatattcattgaataaatgaatgaatgaatgatccaatgagccccaaagcaaataacaataaaggacatttgcagagtgctctacagagagacaagtgctttccctttactttatcttaccccattctcacaacaatcccctgacatgattgggttcatgtttcacagatgaggaggctaacggccaggtgtacataccaggggacatgggactgggttcatatgagctcaggggtaaatgatgacaccctttcccctgccctgaaggatctcagtttgagtatttgtagcacacttaggatgttctgggccaggctgagtggcggtggatgggggcggtggaggtggggtatgcaaagcaggaaactcggcctttgctttctaaaagctcccagtctatttgaggccagacttatgcatgcagaacatttgggaaatggtacaagacagcagcaagcatagtgctgaattgcacataatcaggtgccaactgcattcccttccttaactaatctgagtcttttaataccagatggggaccctgagaatagatttcctatcaaacagatgaagagcaaagatgggagccgagggaaatgctgtggcttactcatttttatacccctgtaacccagcatgatgtctggcccacagcaacaggaatagggcagtccaccttcaataatgggccactctatgtgccaggcacctgctaagggccccacaaacatcatgtcaccaatccctcacagcaacactaccacttactaaaggaattatgaaagtaatccacaagaagctgaaagcagggttcagagatcgtactcatcatgcccacagtctcagagtaaaggggcaagctcagtgtttgaacccaattctagcagcctcccaaattaatgctctcaatctgactctatgctacctctgtgcctggaaggaactactgttgtccataaggatgagaagaaacatggctaagggagcactgagtagggaggaaggaggcagcagggaggaagaaataaattaagaaagaaagagatacaaagaggaagaaaggagagggggagggagggaaagaacagggcttgtgtgttacataaactcagacaagcacatgcatgttttaacaggattcctgcaggtctgacaatctcactccttcctccctgaacaaccttagaggggttgcctaaggagtcctatatagaggcttatggcagaaggaaggccttgcgtccagaactttctgagctcatggattgacactggggttgcgcatcagtctgcttggaatgccttcaaaaaataccccagtctgggtggcttatacaacagaaatctattttctcatggttctgaaaactggaagtccaagatcaaggtgccagcagggttggtgtctggtgaggcctctcaccttgtgttgcaactgccttttccctgtgtgctcacatggtatctttgtgcgtggggggtctttggagtctctccttgtaaggacactaactctatcagatcagggccccacccttatgacctcttttaaccttcattagttccttagaggtcccttcttcaaatacagccatacaggggcttagagcttcaacacagggattttggagggacacaaacattcagtccacaccggggtgcatgagggaggggtcagagctggagaaagtgcatgagctagttcaccttccagagtaaagggagcaacagccactgaagctcaggttggatggggctggcaaggtcgctgtattgagtacatcatgggagggacaacaggacaaatggctcctgcagtcagggtgactgatgggaggcttcttcagcactccctctgcacattcattttgtcactccctctctccccatgcagttctttgctctctgttgcaagttcccaggaggcaggcagagggcctgttatcatcatctttctctcttgcccctcacacttacctgtgttcttctacttagacacattctttgtgagcatctcatgggtgatgttggctgcattgtacagtgggcacgtgcgtatgtgtgtgtatttatctgcaaataatacccatgtcacaaggcgtccgcaggaataaatgagctattgtgcatgtaaatatctggtacatggtagatacatgaatgaatgaatatttgttgaataaataagtgaatgaatgaatcttcacttggcagagcatgtgtcttcctttaaggggcaaggatgatctggtaatcatcagtttctgcttactaactgggtcactgagcaaagaaaagagactcactcattcatttattcagcataggttggctgcacccctgtcagaaaccggaggttaagcagaaagtagagagttaaatcagtatgtaaagcagttaaaacagtccagagggagagacaggcaaggaaaggaacaatgagaaacaaagtaaggagtgctctgataagaagccctgggtgctatggaaaccacaagcagggcaccgactcagggccagggagggatccctggaggagatgacatctgcagtagatattccagggtaagcagcaggtggccagaaggagaaagaggtgaggaacattccaggcaaggggaacagcacgtgcaaaggccctgaaggagaaccacaacacgcatctgagaaatagtgaggggtctgggtggctgagccacaaagggaacaccaggggtcagggaggatttgtagaagaagccacaggccacaaaaaagacctcataattcatgttcaatggtttggattttattttggtgacttcactttatacctactgttcagaggcagccaattgcaaacacgtccagaagcactttgctatttctgatctgcaaaatggagcaagtcatctgtactctgcttcttcagtgggttgtggggaagcagaaatgagaggatgacattctagccttttgtgacctctcaagtgctgtccttatggtcattcaggtaccatgaaaattagcagagccccaagggggaagtagcttggtgctcacccagtggtatccctgacaagttggcaaagacacccagggtggcttaactttctcctcagcaaagagctctcctctgttccctgaatcctggatatcccactgggtcctctagtgaccccaagcttcagcctcgcatgccctcttctcgaacagagaaggcaggagggaagcagggaccagcccctgctccatcttccaggattccaggcctccctggcctggacaagccctgagctggcagttaggagagcagaggttgtgaatctggtgggacccccagcaggtctttctggctcagtgccctcatctgtgagcaggggttccccaggagaccacgacagaggcctggaacccaagttctaatcccacatcctggctgggcaacttcaggcaaatttctaacacaaggtaagcctcaatttctctctggggtaatgatcaggcacctgcttaattcacaggggtttggtgggcatcacgtggacaatgtggttgcacagcagtgggcaatgcaaaggaaaggaagtatgttagtaagtgcccctcccctgttgcacaaaacaggacacatgctgggattgcagaaaagcaataaatgctgcacaggtgaagaaaactattcaaggaccctggccaagtcacaggctacctgtggccctgaggggacagctcatgggttggcattaggggaagcagctctcaaggggcctgtatcctggggattcaactctgtgcctatgtggcattgagcctgtgtgaatgtggtgactgtcatgctgttttgctgtgtgtgcgtctgcatgcctgtgtgtttgtgtgtctctccaccttcgtggggggcaactgtaggtgtattatgagccttgggtctgtctgtgtgtacaatagcaatgtctgtgcggacttaaggacctgcgcccatatgtttgtgggactttctgggcatgcatgcttgtttatgaggccatacatccgggtattctgtgaactgctagcatggtgtgtatctgtgtggcagacagaaaatggctgggtgggattgtagggggcagcttgggcaaaggatcctcagtgtcaatcaaaatgggtctcagtgggaacccaagcagctcagacttgggggaggggaagctcttcctccaccttccagggagcaaaccttgcaattcaacaccacaaggctttgagtccacaggcagggacgcaaactttgcccattgggtgagacgccactcacagaagggaaatggcttcctaaatctaatcattgccccttcaagcactaacaacccgtgcccaggagctgatggctaatgaattattgagctggaaagggagaagaggtagaaccaaggaggaaagaaacagaaaaatgagagagcaggccgggtggggtggctctcgcctgtaatctcagcactttgggaggccaaggcgggtggatcacctgaggtcaggagttcaagcccagccagcccaacatggcgaaaccccgtctctattaaaaaatacaaaaaaatttagctgggcctagtggtgggcgcctgtaatcccagctactccggaggctgaggcaggagaatcgcttgaatctgggaggcagaggttgcagtgagcagagatcgcaccactgcactccagcctgggcaacagagcgagactccgtctcaaaaaaaaaaaaaaaagaaaaagaaaaatgagagtgtaagggcccagaggggctgagggctcctttctcctccccaactccctgtcactagaaggtgggccctgccataggaggattctgcagaaccctcaaggacccgcggagcaggacggcaccttcttcccatgaccacccatttggatgtgtttttcacccctttctgggtggggcagactttccccctccccatgagttcaggcagtgggttaaataagatttcccttgaagtcgaatgaaatcacaatgcaccacacacagggacacacacacacacacacgcacgcacgcacatcacacacacacacacacacacacacacacacacacacacatacacacacacagtctccctggggccaatctactgccccctgaacctcacccatcagccaggtgcctggccccgggtctgtctcttagggttacatgctcccggggctcccgcacataccccggcagatgagggtgcgcaggggtgagggcgcagggctgggcgtcccccgcccccaccgtgcagccctcgcccccgccccgcccctccgtagttgcccgcccgccgccccctccgccgccccctccgccgctccgactctcgccccgagcgctggcagcaggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaaggtaagccaccttcttccttttgttcccctgtctgggcttgggggtgctaggcgccgaggtgggctgtgccacctgcctcccttagtccggactctcctctccacgaggagcccggacaggtgcttgtatccaaaggagagagaaatcggcgggagggctggtgtgaacacccagaggagggagccggagtggacgtctgccccagcggcaactggacccctctggggcaccaggtgtcgggactctcctcctggggaaatctctgagagccgaaggaagcggcatgttcacaggtgggggtgaccggattctctggtggaagtgtggtgaagctcttcccattcccatgacagctggcgtttgagcactcagtgagggtgctgccacactcccacactcctcctaggcggctatgccaggtgcagacctgcgagtcccttcatcaggaagagtgctctgtctgcacccccaaaacctctgcaagccaaaaggaatcagctgctgccaggggtaaaactcccaggcctcatgtcctggtggctccgggagtcaggaggagcaaccgtgaagggctggctgcgagctgagcttacatcaaggattaaaaagcataatatcgtggagtctcttctgcctggacgctgttccttcaccacctgtccccagccgaggcatggctgatctcaccatccgtgggagagtcctcaaatgggtccaggtgaagttggaaccagtgtgttgggccctggaggacaatgcaggtctccttaccagcagttcaaaagttagtggttggaataaagagactggaagcagttaggaaacgggaaatgatgggttttgttttgtttaatgttcaaatgtcactacgagtggtaagattttaagcagcttgacacttaaacattcaaattctaccatcagagcccccatcctggatacaggtgggagttaagctcctaccctacaggcctgatagtgagtagaagtgtaatggggtaagggaccccaagtgaacaataagtctcctcttagaacttggttggtctcaccctgtttagaaccacagagatctccataagtaagctgtccttgaaaccccctggaagaaggggtcccagcttctggcccagctcccaggggcatcaggctggctgagccccgaggaaagagatctctgggtgcagatcttaggtgctgaagctgggttggcatttacatcctagaacataggaagaggctttggcccatttgtccagctgagttacatgtcctgctggcaaggaagggactggttgtcctgttaccagtcctgaccagaacaggtctgcaaagctcagcccaaggccttgacattctaagcctcacctctcacagatcctgggatgctgcttgactggggacaattttcagcgccaaatataggtcttctccctcatcatctgtctgaccaccatgcggtctcagaggccaggggactgtggggacaggaaagtcaggggcttgtttttaaatattttcaatgcctgtggctctcctgggagctgggtgtcacagaaagatctcaagccctagagtcaagtggagtctgggtgtgaatcccagctccatcactccctgcctctgggaccttaggaaagtcccccgcacctccctaagcctcagtttttcatccatgaaattcgtatgctacttcccggagggaagggtatgtaggaagtagaggaagggaagactctgcctcatatactgtgttggctgcagccaccagggacccagaggaagttgttgtaaggatgtgagaatcaaatgaatgatgaatagggagctccgtgcatagggctgggaaaagagtaagagctcagacattgctgtctaccatttccttctcctgccccaaacatccaggaattcaccctggatgaattcctgcaggattcccagagtacaaaggtctttgcttctgtctcctcggattctaagaaacagaagagggggtactggcattcagtgtgtccctactgtgtgcttgccataatgctcggtgttttatcaacaactctcatttaaccctcacaacaatgttcgtttgaggctcatagcaggttcggggccaatgggtggactcccaagacaagctatcgaagcactgggcactcagcccttcctgcacaaagcccactggcgtgagttgtccaggggtccagctgcatatgttcccccaggtatttgcccccgaagcacagtcatctcactgccttgcatagtggaatgctaatcagcagaagacccttctatgggaggcagcttggaaacctggaggaagccctggctgaggaggctagtggtcagggagcctatcctggccaggtcacttttccccactggggcctcggtttcttctttgtaaagggagaaacttacattaggcatttcctcaggttccatttggttctcaaattctaatatttttatggttgatgctctcaccagagctgctgctatgatctcagagacgtgaggctcagatctaattagaagcaaccggaagagagcagttgggatttttcaactcaggaatcagtctccctgctgggttcaaattcaggctctgccacttactagctgtatgactaagccttgttttcctcaactataaaacagagatagtagtagttaccatcttaaaatagctgttgtgttgtgtggatttcaaggatcatgcaagtcaagcatttagcacagtctctgctacataagtggtcagcaaatttgaggtactattcaatttatggctctattgtttggggcttccaaatgtccagagtaaggccattttcgaagtaggcagtacatctgagagccttaacagctcatttctggaaaccttatccagccctatccagataactaggaccaaaaaccccagcacacagatgctcgtcccttgcttcaaccctcactgacctctactctgtggcttgtcctgaaaacatcaaagcctgctcaattaaaatcctgaatgccttgataatacaatttagaaacatacatagtttttaaatagggcaaaaactctgcatgattagtgctgcaagaagatatccagcccaacctgggtgttcagggagcgctctctaaaggcaacagaaatctaaagtaatttaagagccatgccactgaataaaaatattcaggttcatttcctgtccttctctctgtttgggatctttgtgtgtctttaattaaaagtaggagagccctgcttttgggattcagcctctgcatcccagtcccagatagaatttctgactctagcagttttgcatgtgcatgacacaccaaggacactgctcctggccttgaatgggtaagtgagacaggctagggcattgaggagaaccagaggaggaccatacaggtgcagctgctgggcttgtcagcggggcaggagaatttagggacaacatcactagaccaaggccatctcaacagagaattgcctagaagcaaataatcccacactacaggggtggctgggttagaaatcctccatgaccgagtgcaagcatgcagaactttctgaaagggctgagcttcggatctccagaatagtcatagcataggtgagctatgactcaaccccatggctatcagatgctttttctaaggccacacggtgagttaatagggtactggttaatatagggccaaacatgggaatgttcccgatagtcccatatttgctcctagatcaatgagcacctcagggaacttatggaagcagagtgtacctgatgagactgggtttagggtttattggtcagggcagcattttcaacctaaagatatgggagagtgacaagagacagacaggcatagagaagcagtagccgtgttgtcacatagtcctgagcccaaggggcaggcctttggcaagtcatttcaccttgtaaatgctagtttctttatctgcaaaaggagaatcctgatgtatagaaatgtttgtgctttggtctttacccatctttgcatctttgcctgtccctttaattctataatgctctcccaccccaccccttgctgccttgtctaatagttaaaattccaccgacattccaagacctcactcagcaatttccatattcaggaagccttctccaagccccagagagaagtgatttctcccatctgaattcccatattcttttaaggtgtacattttcttatgactcacaatcgcgcttggaattagacaatcaacggaggtgttaaccccctttccccaccaccagaggtcagggttcttgggggtaggagctcgtctaactcatccttcacaactctctgcttggttctgtgcacatagtaggtacttaataaaaattttcctagagtaaactataaataatggaatggttggccactctccattatttgctagaattgcagaccctgcaggaaaagttagcttcccaccggaatttcagttaccagccctctgccaggaatgaattctgttgttcggtctgctggctttgaattgactttgtccatgaaatgtaccgaatctgtttaccatttagcaggaaagtgctgagaacagtgattctactcccactccctcataatcacaaaggtatgaggaacccacacccagcaccaggcacagttctggtccctcaatcccagaagaagctcaatggagctcaagataaacagaaagagagagatggaaaagaatggaagacagaggagaaggacttactgcctaaaatcagtgggattgttttgacttggtctctggaaaagggccaaggcttagacctctttgtctgcctggaagggccttgctccatgaatgctttgtaaatctgtaagtgaataagtgagcatatgctttaacaaataagtgaaaagatgaatgattgaatgaatgggggaagcagtaaaggagtgaatgaatgaagcaacaaatgaattatcaactgaatgacagaaagaatgatcgaataaatgaccacatgaatgaatgaatatgtccataaatgaatgaatgatgaagtgccagaacagctataattaacagcctatcttttcacaaagagcattgatagtcatctccccaaagttgaaaaatataaattcagtcaagaagagtcctggtaattttttggatactggtaggtgtatagtgtctttggagaaggtgaggagatgtctctaagttttcactcttttgctgaaacaaaagcagggactgactcacagtgattccccttgtcttcccttatatttcaggttcgttcacccttgcctgggtgagatcagaatctgtatatttatccactcatttatttgttcacttagccagtcccacaattgtccttcagcattgcttccctgcctaagatccactctggcttcctcatcctccctcttcctccatctcctcattcacctggccaactcctacttatctttcaaggcctcattcaatgccaccgctctgggaagcctttcctggcttctgtaggcagagcacatctctgccttctctctttccccatagctgctgctgcttcccttaactacaattctgaacacactatgaggttgtcattatgggtttacacatttatctctctgactagctttcaggcactgagtcttatcccagggcctctgtcaggcctgacactgcatccaggcttgatggatgctggcggcatggaggtaaggatggatgggccagagtgtgcgttcttgatggctctgagcggtgtgagaatgcggcggtgcagatgaggaatccaggtctgctcctggggagaagctctgcaaaattctgcataatggccgtggagctgatgttcccattcatcaggcagggaaggaacagtttttagaaaagagagagagagcctaagagtcctagggccttcagagaaacatctctttaaatgcttccccttcctccgggtagtattttaaataggtcaccttctggaagtagtggtagtcagttgggatattgctagcttcccgtaccccagccatgggagtagtactttggattaaatcttgttattcaaggccagactaaaagcctcattggtgcggtggggggaagtaggaaccacattccactcaaatcaggaagctagaagtaggattgcattatggctatgagcaccgcgttaaaataagagtcttgggattgaactccctttcattggttcatagctgagcctttccaggcctcagtttcctcttctataaaatggggacagtgggccaggtatggtggctcacatctgtaatcccagcagtttggaaggtcaaggtggacagatcacgaggtcaggagttcaagaccagcctggccaatatggtgaaaccccatctctactaaaaatacaaaaattagccgggcatggtggcatgctcctgtaatcccagtcactcaggaggctgaggcaggagaatcgcttgaaccgaggagacggaggttgcagtgagccaagactgcaccattgcactccagcctggatgacagagcgagactccgtctcaaaaaaaataaaaattaaaaaatggggacaatgacagtgtctccctatagggccacgtgagggccaagaaggaattgaacatggtgctgcacaccaggtgagttggcagtgctggctttgctgctgccttttgtcccatctcaggacaggccccttccttctgccttgctccacttggatgatgacggtgttacccttggtaatctccccatccctttgagctgtggcctctgattccagccctctgagatcccgagccaccatatccatggtcactggcattctaagcagtttctctggtgattcctaagggaagctgtcaactttagatggtaaaagcaattcccaacagtgaggtatgaaaatgcaggtcacccgccaggaaggataataatactagctcaaatgactctggcctccacccagtgccaggcaccttgctcggctctttcctgtgttattttattaaccccaaccctggaggacaagatgctattacagttctcattttgcagttgaggaacctgaggctctaaaaagggaagtgccttactaagggtcatagagcttgggaatcgcagagcctggttctggttgatcccagaccctgagcttctaactgccatactaacctcctctcctcctggctttgcctctggaaccttagggacctgagtagaaaaacagtcaaaacgggtgcatggatgttggggagaaggcattcaaggatagactgaagcacctcattagccacacggaacaactgagctacgtgcaggccctgagcaaaatgcttttagccccatcccaaccccgcctccccctagatctgtttccatttcatctgacactgtggaagcctgaatatgaaatgattgggggcagaaggccaattagcaaattcattaataggattaaacatctctcctctgctctaatcatttatgtgaactaaaattttctctctttgttatagccatcattgcctgtcagtgaagatagagtgtttaaatatcttccaagtatgttagaattgcaaacgttcagaaccagggaccaggatcagagttttcacacggtccaggtgggcaaggagatcagtcggtttacaagtggttatcactgctaagaaaaaaacacaagaacttgctagtacatttgcaagtaccttactgctcatctcctttctctccttagccacatgttggcccaaatcacctgcgtatgttatacggttgttatgagcatacactcctggttaggcagacctagaattcaaatcctggctctgcaactcattagctgtgtgacattgagcaggttacctcgcttctgtgaactttcatctctacataatctagaaaatgaaagtattgttgataattccctcccaggttgttatgaggattaaatgcagtcatgcatgtaagatgcagcggtcagcactcagaatgcgctaaaggtaaattgttactatctgggtctactccacttaaagtgtgctcctccaaccaacagcctcagcatcagttgggagcttgttagaaatacagagtcccggccaggcgcggtggctcacgcctgtaatcccagcactttgggaggccgaggctggcggatcatgaggtcaggagatagagaccatcccggctaacacggtgaaaccccgtctctactaaaaatacaaaaaaattagccaggcgtggtggcgggcgcgtgtagtcccagctactcgggaggttgaggcaggagaatggcgtgaacccaggaggtggagcttgcagtgagccgagatcgcgccactgcactccagcctgggcgacagagcgagactccatcttggaaaaaaaaaaaaaacctcaactcagtgagacctacccagtcagaacctgcattttaacaagatcaccagatggtttatatgcccactggagtctgaggaatactggcctaaagtacagattatggaactatgtgtattgtattacacaaaattatatatcaagccagaagaggcttttgctaagacttctgatttaagcctcattttacaaataagaaaatagaatccagagaaggtgagtggtttgcccacaatcacacagctcaagtgttaggcctgacatccgaaccccagccctggtcatctcatataaattgttaagaagtcagatttccagatttgcatttctgcaatcaagcttgtctgtttttctttctctctctttctttttaacaacaaagaagtgcaggatgatgtacgcccattaagttttagtttactcattttaaatgttattccagccaacagagatcctgaatcttgactccaccagccatcatcttagctgtacctccaagttttctgctacctgaagaaatgataaggaggcattctaggtctttatctaagttgcttctaagaacatgggccagaacagggtgcaggacagagccatgtggactgcaactagagacttgcctgcataatggatttcactgataatgttcagaatcccagagcaggatggcagcctggtttacatacagagcctttgtgtgggatttgaagccagaaaatgtgactaaagtaggagtctaaacagacacaggtagggcctggggaatgaaagtcaaatgccttttccagggggtctagtaggacctctctgttggtggggatcccccaaaaaagtaatctttttatttttgtaggagtcctgtaatggtttcattattattctcactttgcagagtaggaaacgtagatgcagggaggttcttgattggctagtgattagtaagcaaggacttgaagtggatctgattgcgaggcactccaccacctgggctcctgcctgcagctggagggcatatccaggacaagcaagcctctgagccccaggaagaggctgagcagttacagctagtttcccaactcccaggaactgaaaatgacagcctcctcttggccccatcagctcctcacccatgccaaccctggacccagagtgagggatgttctggtggagaccatgaagctcccagctgcctgggggaagctggcacatttgcatccgtgtggctgaggctgcactttctctccatctctgggattcgcccatgtatgactctcccagatgtccaaattgtgcactcagcaggggtgtcttcaggaggcttccccacccatcgaaatcagggcagcaaggggctccccttgtcttcttccctctttgcatacatccagccctgggctgattaggactctaagccctgtaggccctgacactaaaataatcaggtcctcccaccactgccccgccctgcctcaccccaccaagggctacacaggcatttcaaaggagaaacagtaaaataagtttaaggaagtctgccaaatttggatttttcccatgttgactactttagtgacttttctgaaataaaatgtgctttcaaaacacaatttttgatgcctctactttgctagtgctttaagcatctcttgagtgtgcctgtgaggtatttcagcattggagttggaaccagacaggaaaaggaaagaaaccgatctgtatcgggcacctgctgcatgccaaggactgtgcaaggtgttgacaaaataacaacagtaacaaacataacatttaaatcgtccttgtgacatttatatagcaatctgtgccaagtaccactctaagcgctttcggtacattaagctaatttaatcctcacaacaaccctatgtggtaggtagtgtgattattcccatgtaacagatgaaatctcacactatgagagacaggcactgatccccctattttatagatgaggaaactgaggcttgggaagaagtgacttgcccaagtgccccgatgcctggtggaagaacagtgttcacaccagctttggccacttccaaagcccttgatgttgacactccaaatgcaggcctcactcatttcctagaagcgccttatgatttgatatgtcctcagggtgcattataagaggagggaggaaaacctgggactacaatgagcattgaatcttgtcctgatcttctcagggaccctctgtcattcccgattgcctattgcatctgttctcacctggtactaccattccctcctccctggtttttcccttgctaagtgaccactctatacgttggtccatatcatgtagcctctgctggaggcaagtctggttcccatctgccttcccctgaagaagaagctgctggaaaattagagttatgttggacacagtctttgtccccaaggaacttctctctggtcataatcattatattaacagcaaacctatagcatgctatgtgctagacactttagcaacttggttttatgtaagccttacagtatccccaggaagtgagcactattactagaccctttccagatgaggacactgaagactagagggcataagcaaatgtccaatgtctcacttctcataagtggaaaagccaggattcgaacccagatggtttgcctccagtgcctgcatgctgaatcactggactaggctggacctgagcatttagaggacattatagattatgtaacactgtggggattcagaggatggagaaagcacctctatctgaggggcaggggctggagaattagagaagatggccgaaagaggcggcattagagctcaacaaaagagctaggggttggcccaggcaagaatgtaggttagtgaagttctaggcagaaggaacaggataagcaaagtcacagaggcaggcaacaagaaggggaaagaaatgaaaactgacagtgatgttttgtatgcttgtgacttggaggatgttaacagaaagaggatgccatcagaagtgggaggcaaggagcagagtcaggctgtccatgttcaggagaatgggacaaggtcctaggaggtagtagacagcaaggatgaggaaagcaccaagcaagtagggatcgagactgtgccctctcagcaccacccttgtccccctaagtgtctccccgtgatcactgcagcttacatttgattcctccttctcctctcccagggaacttactatttgtccccatgatttagcctttgattaccttgaactgttctatcatcattccctgtaaacacgcttgactctccagcaagagtgacctttcctcagagacctggacctttctttcttcccttctcagcatcttcgagcatcccaggacagtactgggcaaaagactggtacttggtgacttgaactgatatttcacagagatgcacaaagacttgggattccttaattagaattcatgcggcagagaaacttgggcatgactttgaggatctcccccacccgccaacagcatattcacaagatacgaacatcaaagattgtggcttggtgtgaaaacatagcacattggaggccattccataacagcttagagctgatgaagagaaaaagatatggtgtgttgggtgaaatagaactgaaggccagtcctagcttaccgtttaggagctgtgtggtttgaagaaattgtttagcccctttctgcatatcagcttcttcatctgttaaacaataacaatcatggtatcaattcattggattgtcatgaggattagtgagataatatgaatgtgtttagtaagctataaggcagtgcatacgtggtggggatcagtattagatgacaataatggtcatagcaataataatgattttgatagtggtggtgatgatgtttgtgatggtggtgtgatggtggtgatggggatggtgttattcgtggtggtaattattatattatggatgtgtgagtctgttttcacactgctgtaaagaactacctgagactgggtaatttatgaagaaaagaggcttaactgactcacagttctacaggctttccaggaggcatggctggggaggcctcaggaaacttacaactgtggcagaaggctaaaggggaagcaggcatattttcacatagtggtaggacagagagagagcaaaggggggtgtgctacatacttttaaacaaccagatttcatgagaactccctcactatcacaagaacagcttgggggaaactgcccccatgatctggtcacctcccaccttgtccctcccccaacattattaactacagttcaacatgggatttgggtgaggacatagaggcaaaccatatcaagggataatattgttgatgatggcagaggtgttggtgacagtaatgacagtaggggcttcatggcaataatgatgatgatgatggaggattacaatattagtggtaatggtgattattatagtataggtgatgttgattataagggtggtggtggtggtgacaatggtgatggtggtagtgatggtgatgatgatgataatagtaatgatggtgatatggtagtatgacagcgatggtggtatggtggtggtggtgatgatagtgacggtggtgatgatggtgatggtgatggtagtagtgatggtggtgattatggaggtggtgatggtgataatggtaatgatggtagtgatggtggtggtggtagtgatgatggtgaagtgatagtgatggtggtggttatggaggtggtgatggtgataatggtaatgatggtagtgatggtggtggtggtagtgatgatggtgaagtgatagtgatggtagtggttatggaggcggtgatggtgataatggtaatgatggtagtgacggtggtggtggtagtgatgatggtgaagtgatagtgatggtggtggttatggaggtggtggtgacgatagtgatggtggtgatgataatagtaatgatggtggtgtggtcataatgatagtgatggtggtggtgtggtggtagtgatagttgtgatgaaaggtggtgatggtggcagtggtgatgatagcagtagggctgatggtggtgacagtggtgattatatagtgatgtaagtagtagtgttgttggaaggatgatagtggtagtggtgtcaacagcactggtgaatttaaggcaatcattccctttgtccaaactatcttctttgactaggctgcacagaaggatttccaacccccagaacttgaattcccccaggtgtatttgtcaaaagtaggaaagaataagacaaatcagcccatgccttcagatttcttctcttattcctggttggtactttcagaatcattttaatgtaagctgctttcttgacatttgcattccagcacgtggcacagtgccatggctggtacatcgtcaagtcttcaataaatatttgtgaaatgaagggatgaacttgcagaaagacacaggctgttctcttggatgaactcatcagagttaaatgtttcatctttgaagataacgcgggggttatcaggcacatcagaatatacctgcattaacactattgccagcatgagcaattcgataacctggcaggttgggaagatttcttggcacctacactgcccctggaagcccccggatgtcagcttggcctggcccttgtacccaccactttgccctcagaggtagggtctgttctactgggattctgtgctaactgatcacagggaacagtggggaaaatggcctctcccaccggctgcttctggagagtccaagcctccctcctcagtgaccttgctgtgcggcaggaatgagaggcacatcctggctctggagatgttcttcttggcagcaagtcctccccaatggcaggagggattacagaagtgatttcaggtgccagtgcctccacagcccacccaccctctgctctaggcaagtcagaggcacctgtagagcctctgttctttgtgtgtggaaaaggaataatctcgcaccagcattataaggttctcatggtttttaggggtgtggcatatagtgagggctccgctaatggcagcagctattaatattggtatcatttattatttccattactagtggagacattgagctgatatatgggtcaataatgatagactagagactttgtgtgtctctttggtggaacatgtgtggcttggattcaccttgaatcccctgattctggcactctggcctgagagtgtcctctgaatgagtcatgtggtgccagcggggttgttgagatagatagatggcctgcaggcatttgggttcaaatgctgttctgctgaataaggaatacgatttggggaccaaacacccttggatttaaatcccagacttgtttttccctggtggtgtggccctagggaagtatttctgctgagccttactgtcttcttgtgtccagtaaggttagtaatattgaccacattggctctttgggaagaggatggaaaataaagtgtaaatggagcgagggagggaatttgtctccgaggcagcacaggacaggaggtaatggaaagaccaaagtggtttttggattagagctgcctgcagcctttatctgtctatggagttgatttattattctcccaaatcttggaacaaagtcaagaaagggaggaaggaagggagagagatgggtaataagagtatggaagaaaatgtaaacatgtagagtgcagacagcggctgcctgcccatagcaagccctccgcagagggagaattaattggctgttgtcatttgtattgttgtgattgttcttattgttgaaagatgtagaagagaaatcaggtagaaagaattcaagcaaagacagggggtgagcgaaagcatgaagaaatgaacagaatctgggctgaatttctttaaggttataaagcactctatgcaatctgaggcaggcagtccccaagcttctagtaccaccctgcgactctacgtgtcaaacaggaggagttccttaaagggtgtttggtgtgtgcatgtgtgtagagggatgaagcatgtatacctctttgtatacatcagacactgtgctgggcactgcccttaaattatctcacttaattgtcacacagtcctatgaagcagatgctgttattgtctcagttttagagacaagaaaactgaagctcagagaaaagaagtgatgaccagcccaaggtcacatagctgctaagtgcagggacagcatcagaacccaggcccgtctgtgcccttaggtctcagagattctacacctactacctagtattagctcaatctgacccttggggaaattaagccccaggaaagctgtttccttcagttgcgcagccaacttgaagcaatggtagactgaatcccagttctgactgccagctccacagtccctccctggggcctcgcacatcattggaactgacaacacaagaatcttccatctccttccttctcttcctccttttcttggctgtcatccaaaactttaggggaatgcattataaaccaacttgagagacagagaaaggctgtaggaagatccaactcaaaaacattttggtgtttgctttacctccgcctgagcgtccctggagataaaccctcctcactctcgcccaccattgctctgctatgtcaatttcagcagccggactctggggctgacatgcattgccccttctcaacccagacaccacttccttcagggaaggctccacataatggtgaagtgcacagactcagaagccgggcagtgctgttcagaacctggttctgcctttctcgggcgtgtggccttggataagtcatctactctctatgagcctcagatccttcgtctgcaaaacagagctaatgcctcccttcttgggttgctgtggggcttaattgagaaggtatatgtgaaatgcctgctccataatagacacccgtttgagaattaacgtttgggttgttacagtgtgagcccatgggtctcaggcaacagacttgataaatacaggttcctctgcaaccacaatcctagtccttagcacaagcatgacactgcctggcatgtgctatccctcccatatccatcagccatggcagacacagatccctcattatgagacttttttattctgagctagaatgtgacctcagaatctttcttaacacaatgcttcaagcagtcactaccagttgaacatagttgacatggaagatagatgaagtttatttgcattctagttctcaccaagtccatgttcactgctccatctgctcagtgcaggctgtctctctgctctgtctcccacctgcttttgtgagtgtatgtttctatgtttgtgtatatgtgtgtttaaactcctcttccagagtgaaagaccatttcagtcttttgtgtgctgatttgtagaaatcattgaactttcagaatcccatttgcaatgtcatgtctgtggctggggatctccaagtaacatcagcttacgtctgggaaggacaaggggaatcaaagttagaagtcaggagagcaaaatccacacacagcatgcaccatcggccacctttaggagtgacacaagagatggtgtttgaatataaatttgaagtctttccaaagatttaacactcctttggctgacaaccataatctcaaggaggtaggcctaggctagagcaattatactttagggtaaccctagctgctataacaaataaaccccaatattgcagtaggctgaaacatagaattgtttttatcattcatataacttcttgatgggccagtagccttcttccatgtagtcactcagggacctagcctccttccatcttgttgctcccccaaccctaaggcatcctctacatctaggtgaaaggggagcagaaaatgtggtctctggcccaggaacaactctagtcttggagaagcacatgatatagtatggagatcacagccaggcctgccaccggcagcaattcagggctgggcaccagatcagctgggtggagtcccagctggccaaggagtctgagcccaggtactatgtggtcatcttgggcatggaacagggcagctcaaggaccagaggtcagctggcagggtccgcaccaagcctatccagggaagccctgccctgatcatggacaaggcctgtgtaatcctgatgtcagctgcttccctcccgaggacagcctgcagcagatggtcagagcctgttgccattaaacatttgagtggttccaccagcatcccgatgagtctgggttcaccaagaaacattattgtaatgtgctccccaggcagctctgcctcagggagagacaatgccaggcatgacaacttcagcattcttgttctgcatggcagttgcatttctcattgtggtttatatgttggtcacatgatctgagctaatgggagtattcgcctgacagatgagtcccttttgctgggtgtgccagcaaaatcaggcttccaagcccccaaggctcactgccagaggctggggaattcgccaaggtaaatgccaccttgtgaggtctttgggacacagccagcagcctccccagggcaccattcctgtctcagcatgaggcttctctggccagcccaatggcatttgggagccacatccacaccccacgggtctgggtctgtttccagctgcactgggacattctggcagattctccctgatctctgtaaggaagagtacagcaggaaggagaggaagcagaaaaaaattccaatgcttagagttttccctctaaagaggacctcctgagccacttctgaacaggacttggaacaaaggaatcttggcgctttgatgatcgtgtctgcagcagttgttgaaatgagtctgacactcgccagtgccttagtaggaattataattacatcaggagaccccaggcaaccaagtaaactgattagctactgctccgagttgatagatttttttctctctaggtcataaatagggctgtgggagatggtggaagcatgctggtgggaacaggtcgagatgggctgtacattcaggaagcccaaccaagtggtgtgggcagctccccctgccccaccctgccaccggaagagacagtctgacaggtgcccaaggtagagttcagttccctcggccagggactgcactcctgatcttgcgtgctgcagagagctgtcctcagagcaggctgagggtggctgaactgctaggcgatgctctgggaagccctccgccaggaaagccgatgctttctgccaggcataattattgcatggataattacacgattcagagcctgctggagaatcctgggctggtgccagagtagaaaggcagggttccggaactgcagccagtggctgattctcagagtcgactttgaaagaagagggtaatcattcctcctcctaagactcctacctggctgggccaggacatggcaaacgtaaagctaagggaggcggggagttgatgagttctctcctccacccactcccttacaggagggggtccccagagttctgacctaatccctcttctttactccctgcacgtgtcacctccctgggacaatccacccctgcccattagcacatatatgcggatgacaccaagtgtctttccagccaggcatctgcaaatgcatgctgggcatctccctcacgtgtctcctccagcccattgcactccagcctgagccattctcctcctaccccagtctgcctctcagtccatattctcttcccagccagacatacctaacctcccagacctccactaggaacccaggagtcctaacctgctagtcctttcccactccctgtgcaccatccgaagccaggtcatgtcagttctacagcagatgtgtcttggctcctgcctgttctcccagcaccaccccccagtcctccggcacagcccaggtctgggctccatggtctgccctggctttcttgtggtggcctcctccctggcctccccaccctcatcccctggggaccagcctcccactgcctccagatccaatgtcttccagtaaatctgtctacacattcccaaggttggagtccttccatggtttccttcactctcagcaccaacttggccccttctgactgtcctgaagacccttcccaagctgccaacgctccagcactgcatcccctgccctgcttgtgacacccaaccctatcagatgccacatgcacttctcccagttgtccaatgtggctttgccaagcctgagcatacatgtgtggaagggaggaatgcaagggtgaatgttctggactctggagctacactgtgtgggtttcaatcttagctctgtcacttgctagctgtgtgacccaggacaagtcacttggcccctctgttattctttcttcccatctataatgtagaaataatagtaataacagaacccatccatggggttgttgggaggattcaatgacatattcatgtaaaagactcagagcatgaccagtgcacagtggccatcttatcaagtgcctgctgcctgtcccaagatggaaacacaaaatgtgaaatccaagtgtgggtggtggaggggtggtatggggcggggcgggaattcagtttaaactagttcatgccttcattttacagagggagaaacaggtcctgagagaggagggaccttacccatggccaccccaggacccagcccagtgttcttggttctgaggcccggctgccctggcatggagcagacagctccctctgggtggtcaagttccctgagttctttgagggctgactagtggtgagagggattcctccccaccaaacccctgactctgagaagtgggttggagcaggagaagaaaagtgtgcaactcagctcagctttccagggtaaaccgatgagaggacatttgacggtggcagcgttaggaggggacttctgcacaaggccggggaaactttgcctaagatttaggccctgggctcagcctgatgcaccccatttactgggtgcctgctctgagaccaggatacgtggaaagaacccacgcctgggagccagctgtcctgggctttggaaatagctgtgtccgtaggtgagaccttgtctctgcaggcctctagcagaggggctaagagcatgcgctctgcaggctgcctgggtcctcacccctactcccgcacttagtagcccttggtgacttaaccttcctgagcctcagttttctcttctgtaaatggaagatcataatgatacctgccccatagagttgtgtggataagcgatagaatctgcattaaagcatttaggtagtgcctgagatttagcaaaggctcaatcaacatttaaaaatggcaagaaccaagcactatcatgcaggtagggcacccatctttgtgcataatccctttgccttccctccctagaatgcagaggaaggaagacctctgtgagaaccctacatacatctttgccaattggcagtttttcctctagttaatttgggagcctgtgacctttaccgccgtgtgattctctgactcagactgcagtgttgcagtgccagccaaacatggtgacaagccccttcccaggcaactgaggacaggcaggagtgttctggaatcttctcctggagtgggagtaagggtgggcagagccatgtgatgctgcactgtccacctggttgaaggaagtaattccagactctgtctctgacatctctattagccaagggtgagggtgttagttcgggtcatgttagctgcgcctcccaccctgcatcctgggcccagaaaccacacccctgtgcagggcttctgtgtcagagtcaccagggaaatgggctgctgaggatgccagcaccaaccaggctgctgtcctggggcgacatgtctgccatcttacaacctcccttccaatattcaccatgtgccagctccagctcagtcactgagcctcacatcgctggaccccactgtgtgctcagggtcatcaggcactttcgcctgtggctgggattgagacctggctcctccaccttgcacttgtgtgacctggccatgctcatgtcaccctcctgggcaccccaataccctcatttgtaaagttcaacctacatgctgtgactgtgaagtgagaaagcagtcagcagtgcttagaacagtgcctggctcctactacacactcaataatgccagctatgttgtcaatatcaactctacgcagtagcccatttctgtagatgaagaaagggaggctacaggaagggaaggcatgtgcctggggtggattcgaactcaggcctgtcgggttccagtctgggcttttctgctctttccaggccatattggaactgccattagagggactcattcattcccatacatgtcaaatatgcactgcacccagattacatccatctttaattgaagacctatccttctgggctttggagatttgctggacttggggagtcaccaatacaactcaggtagtgacatctgggaggagaagactgaggtgtcatcagctgcttcttatccccctgcctttgctcagcctgtccccactgatgggacacctttgcccaacctctcacccataccttttatctgattagctttttttttttttttttttttgagacagaatcgcgctctgttgcccaggctggaatgcagtggcgcgatctcagctcagggcaacctccacctaccaggttccagtgattctcctgcctcagcctcccaagtagctgggattacaggtgcctgccaccacacccggctaatttttgtatttttagtagacatgggctttcaccatgttggccaggctggtcttgaattcctgacctcaggtgatctgcccacttctgcctcccaaagttctgggattacaggtgtgagccaccgcacccggcctgattagttgcttcttcctgtcctttgggacctggtacaggcatcaccttctctgggatgcttcccttgtccctccctcatcacaaggctggcttgggtgacctttctccatgctccaaaactcccttgctcctaagcagccccagcatggagctccaagccatgaagctctaatatcagagtccaagccttatagagcttccagggtctgacacatggcagaagttaaattaaactatgtatttgtttatttgctaacattctgccttattacaaaagagacttgagtcaactaagcaaataaatgtttgcagagctgaattaaactgagacagggtactggcccagtagaaaagtagaaaatacctgggcttgggcatcaggaagacctgggtgagaattctccagacctgtgccttctatggaacattaaaaaggtcactttccctctcaaagcctcagttagctcttcagggcctgcgaacggcaatctattgtgaggacctggtgtgtgagccaagtgcacccatcagccactcacagctgcagcagaaccaggcagttgagtttgacattggccttttaagctagtcacgaataatcagaagacccatggcaggctgtcactagtgattttgcttaggtacaaacttgaatggtgctccttggagttctgatgtgggagagtcactgagctggacgttagcacacacagttacacgctcacaggctcaccccagcatgcatgtctcaaaacaatatattttcctctatttgtccttgggttttcagttacagcaaaagtattttcaaaacaaaacaaaatgcatcatgatacaatctcatatcaagtaacattcatttggggggacgcacttaaattaatagtttcataagcggttgttgtcctgcatttacagacacacgacaattctgaaggggtcatgttatttttcgattatcctttactgcattttatgtgggacatggcatgctgcagtggtgtttgtgagctggaggatttgggagagccttaggaaccctcccaggagcctcaaggattgactgcagtaggagctcaaatgagttttgcctggggcctgccctggaggagacctgcctctcagcagccaatcccacccaggctgctctggaactggaggctctggctcactgggccctgctccccacccacttccctctcgcctctcccattcccttccccagtctgcagcccctttgttcaaggagggagctgcaagcgggtggtctctgggcagctggataactacttctaaagcctcttagaccctggtaatcttcctcctaacaccatcgggtgactgcaaagcactgcaggccagacttcagttctgctgtgtaatttgcaagctgggtgaccttccttatctatagaatgggctctcctgcatggctggcatgaggaataaacaaaatggttgtgtccagtgcctggggcatagcacagctcaaaaaacttagttcatcctcctgagggatcaagaagatacttggaaacaaatgtccaagggcgtaatcttgaaggggcttgtgccaggcatatatggagagaagggttttgtgggatgtcagacttaatagtgccctttactccccacccccgtctctctgttcatagacaggaaatctgtggcctattctgggacctcaaagtgccacagggttaaagataccaagtcagaaatctaaggttctaaatggactttagaccatttttcatttgggaaggaagaattctttaaggggttgtgctggcgctgtctctgtatgcatgtgcagaatgtgcttccagatggggtaatggtctgagtttgaggacagaagtccactccactgcattcaactgttcaatagtcctgggcagtgttattgcatgggagaccatacctaaccccaaagattgccccatagtctctttgtcagataaagcataagtgagcatcccatctttgttagtcagaaccttttcagtttcaaacaacagaaaaccaactcttcctgtttaaaggaagaaaaggggggtttattggttcatgtaataaaatggccagggtaagattaacttcaggcagagctgaatacaggtgctcaaagaaaatgtcgacaagaacctgttgatttctctgtctcagctctgctctcttctgtcttggcttcattctcaggaaatgctctaaccttggggttccaagagtagtcaccagcagccccatatttacagcccaccagctcagcaacctctgtgggaaagagcttctcaatagttccaggaaaagtcccagggctggctcccattggcctagatagggttctgtgttatgctgtgaggtgctggttctggggacggaggagtgttctgccttaacaaccgaatggactgtatttgtggggaggtgtgggaaaccaaggagctcttaccaggagaatggatgttgggccagcagaaacaaaatatgttactgccttcttcaagtacacaggtttctgtaaagcctaacatcacactgaggcaccacttgccccaaactccagcctgaaggattatgaggagttcgagcttgcctttgcagggcgcctgcttcctgttaggactgtgctcattgtacatggaccttcttctgaacctctgagattggttctgttatctttattcccattttacagatagccaaccacaaacttactgggtggagtaacagtgttgcccagagttagagcttataaatggcagagttggagtttggacctatattaaacagtctaacttcacagggcagactcttagccatcaagcaatatggtcttccccgagaatgtctccccacttcacccttccaggcctttcttcttgttggactctagactttaaatgcccttctttttacttcctgctcacttattaaactcttccttgaatgctcctcctcctgatagttttccccaggattaaatctgagcaagacccttttctacaagaccaaggtcaccatgccactgctgactacagctggtgtatttgtttgtcctaacccttggagggcagagactaaatttattgtttaccactctggcacctagtacactgcctggcacagagtaggtgctcatggctcataacatgtttattgattgtttagatggcaacacagataaaatcaaaacatggaaggttgctgagactcaaagacaggattattattgttggtaatgatctgatagctaatgagtattatattaataatagtcaacatgtcaggtactataatagaggctttgcgtaactgctccttttagtcctcccagtaatactatgatgctgatattactcttcccattttgtagataaagaaactgggagtcaaggaggtgaaatggctttcccaaagtcttgcatataatgtatccggactgcaaggatggggccctctggccccctcaacaccctatctgcctctcatacccagggacctgcccacaaggtcagccccttggcaatcttgccaaccttggggctcaaaattcagtttatggcttcccaagatctactggatgctttttctaagtttggagaattcatgacattatgaatcctttttccccaaggtgggtattcaaactcagagttccagccacgcttgcatccagggctcagatagcagagggacctgcctgaggcttgatttagaagggtccacctgaggatgtggatgaagcgtgaattcatttctggcaggggtggcagcagaggcagacagctctgtggaggcagaggtggggaaattctggtgtctccttcctagtgtggaccatcgcgcctgtgttgagcagtggagatagtggggtctttcctgcagaggcctccatggtagggctcaaacattgttctagctggggtggcctccaagcctaataccttgaccctcttcgagattctctgcactgccaaatatcttctaataaattccttctctgcataaaccaactagaatagattctgtagtttacaaccaagaatcctgactgaaaccccctgaagcttgtgggtttaggtatgaccatgtgggaaggcagcatgagctctggactataaagagaatcagttgaggatgtggcagcaaacaggtatactaggggatcaacgaggggaattattatgatgatgggcctttggaaacctctgccttctacagcagtactttgaaactcttgtgcacacagatcacctaaggatgttgttagcatgcaaattctgattcaggagtttggggctgggacctgggatcctgcatttccaatacccttctccacttaagttttgctgatgctggtagtctgaggaccaccaatgaggtggtgaggttccagggacgcttaagcctccagcaaaacatcacacaagacagaagtgcctacttcaattgcatgagataatgagaccaaatcatccccgggcaagcccaccactaacaattattcccatcattggtaacatcctaagtcctaaggtacctggagcttcaaatctcataattagcactcttgttatgccaagcctgctcctaatgaggacactttgataattcgctttgttgaagaaacaggatctgttcctttcccctacagtacagcatgataggagtgtggtttgctatttgtacctgtaactcagcccagggagtgctgacaatgggggagccactgcaggagtcccagcctccccacctcatgccccaccccctgtcctaagccccacccttcccagcaaaggaaagtaggcccctgaagcagttgtcctgtcctctagaatcctctagaatccagctacaaacatccaagtcctgcccccatcttcccgatctaactcacaccatttgtcatagtgacctggcctcagcctctttcaacttcttctctcactgccacacctttgcgtaggcagctctccagcctggaataccctcttatccatccggccaactcctccatgacctctgagatccatgtggaaggctctagaaagccttcctcaaatttcctttgttccaggatttaagctgacctaaatcctagagattagtacttcattttcaaacttttcatttgctcaaagcctacagcaaactcagtccacacacttggctatacaagaaaggttgctttctttgttgttctataactgactttaatttcaacttcaagtccccattcttgccaaggggtagaaatggaatcttggtcaacttaggttcccctccctactctctggggttgcatttccaggccaggcagtttctgctggtgcttttgttccttggtcctcagtcttctttctgtgttgacatccattgacatgtcctcgactcccctcatctcagatcacaggcccatgctgactccaggagtattcttgtattctcttcatctgaacctcaacactttttgagaccacgcatgcatgtgctctctctttctctctctctctaacacttctggaacactcttggacatgaggagatattggtctttctaggatggggtcaactggccctgcctcagatccattggcctgtacatatcttgtagccattgtggtgccatggatcacaggtcacgatgctgtgtggctgcctctgctcttagacctgccccccatgccaccagagggagtgtctgcctccccctgccctggacactcagctggaggggagggtcacagtccctcacagtcccttctccagtgacaagcaacaaactcccagtcttcctttctttctgatcctctcctcctcttcctccttctcctcttcctcctctcccagtccaaggaagttttatgcaaaggccagaggagggaataatgaggtggaggtctctctgaccaagcatgtagccttccggatctgttgtgctttccaggagtccttcaaagctctaagcttttggaattctgcaagctcaggaaattgaaaaccttttctctcacaactgcaggtctttgtctgcagttgtaaaagtctgtttagaaactcaggagacaagcagcatcttctttgttccctgctttctggaggcagtcagcgtggaacaccctgcctgcagtctgactcagggaaagggtcactgagtgtgtgtgtgtgtgttgaggggtggataataagcaaggagaacactcagacagagagctcacagaggggcaccccagcacctccctcacctctatattccccgcctgggcatagtggagggagggttaatgccagccaagtttaacaggcatttctgattcgcggcattgttgttgcgctatcctgcaatcctacgctgcgggtactgtttttatcctgatccttcagctctggaaactaatatagagagctgagtaacttgcttgaggccatgatgccaggatccacggtgcccccaggctgaagagccttaaccactgggctgtaccacctcacaggagggcaggtggcacagtgcctggaacttgggagggtccagcacgtggaactatgctctgtcatttacttactgtgtgtcactggatcagtcactcaacaccgctaagcctcattttccacctcttcaaaagggatctaataaacctgttagcagaaggctgctgtgaacactaaatgaggtggcttaggtgagagctctggtctgaagatgctcacactttgaatctcaagacttgtgtgaaccaatatcagatttctcctattagattgcaattctcagggagtcacattccgtctccaaatgcccatctcctgatccacaaaatgagcacaacatctctgataaacggtaactagatggttccagtgggcagcgggagtgggagggcggttgactgggccagaacctcaaatgtattcctgtgtagtttctcatgcattcattcagtttggcaccagaaggtgcccagactcactttgcagccagtctgtccccatagaggtgataaaggaaaaacatatgcacatttaaacttttaaaagtttatttgaacattcagcgattcacaaacggtatagcacagacagcaagcaactagcactcctctaggaggggccaaacaggatacttttataaagaggttgcagaagcaagacaaagaaaaccattttaatgggttggaatggaaagttcctaattagaggttcattggtggctcctgattggtgcagcttctagtttcaacttactgtttacattggtctgtggtttgtccccataggaacgtaaggtgtcagagccagctactcaggagaatgaggtgaaaggatcacctgagcagggtaggtggaggctgtggtaagcagtgattgcaccactgtactccaacgtgggcaacagagtgagacccttaaaaaaagaaggaagagagggagagggagaaggaggaggaggaggaggaggaggaggagaaggaggagaaggagaagaaggagaaggaggtggcagagctacagaagcacctgttgcccaggatggagtgcagtgatgtgaccacagctcactgcaaccttgatttcctgggctcaagtgattccccccacctcaacctcccaagtagctgggaccacaggcaggcaccaccatgcccagctaatttttttttattttttgtagaaatgggggtctcattatgttccccaggctggtcttgaactcctgggctcaagtgatcctcccaccagagcctctcaaagtgctgggattaccagcatgagctaccataccatgcccggcatagatttttttttttttttaacagaggctacagacaagactgactgcctggcctagagttgaggcccgggagacttgcctcctgtgtgcagcgggctgtgctggttgcctcggtttcccagagtctgatgaacatgtttcctccacaggcagtagctgcttcatttgtttttctcccagttttcatttctcattagctgctaaatcctccccatggctgcagaccctattgtagctgactcagccagtgggcacagcaggggctgggtcccagcgccgtctccgcaacctaggagaggtcaggggcagcagtgcctgcctggctctatctccaagtgtgcctcacccccactgacaggtcagattatccactgtccccagagacgttaggagggaggccgtgtcctccactcccctagctgacacactggaaggacgttctccttgacatctgacttaatgacagtggaaccaagcggggtgcccttgggtgaaggaaaaaggagggaagacttgagccttctttaatgtcaataccctgagcctgaggccacaagcaaaggccagcagcttctgcaggatagcagaagccaggagacagggaactggggagtgtacatttatttgcttctccaacaacaacaacaatatctaggtgtgcagtgagctcccacttctgctgatgtgggactagacaaaagatgagaggggaccaccctcagaggctccctcctgcttggccccaaactctttgtaaatccagcaccccacccccagttgttccccttcaggaatcatcaccctctgaaaacctgcagaaattctcaaatcccagccccctttgcttctcacacttgtagaggtctttccctaagcaaacacctgctttgattattcagggagtgagaattaatatcattgtaaatctaactcaaacataattaagaagttaaatctacttttgagggaaaaagttctgattgctcatctccagaccagataaataagatttcaaatctccaagatctgcagctcggtgtgaactgccctccgcctgtctcagccagaacatcaagtggaaaggggcctgaggaactgcctcctccagccccaccagtgtggagatgcagctcagtcttgccatctgtgaaatgggattgataatacctacatggttgtcttgagtttagctcataaccctttctccgccagaatatcaactccgtaaaggcaggattttgtttgttccccatagtatccccagtgcctcacacatggtaagcatttaataaaaacaaagccatcaatggagatgacgaaacccagagagcagcagtgccttgaccggggtcacacagcaagttagagcagagccctgattgaaaccaagggctcctgggccttaaactaggcgctccttgcattagcctgtggcaggagatgtaggtttgctgtcaatccttccaccagttactactgcctgtgcagccttgtgcatgaccttgctttccctgggcctcagttttcccagcagtagaatgggcttattattagaggagaagaccacatccactttggaaaacgggcagaaccttgtcccaccttcccccaacagctgaccattttctgcccaggctgtggccagaacctgttctctcccatcattaaaatccctctctccttctccaactctttctttctagctccaccctccccaaagaggaaacaaaggaaggcaaacatattcctgttaccagcccaggtctcagtgggccaaggtggagtgaggggagggaagaggctacagtcctcccactctgcccccacacacctgcagagacattaaggaaagcggagctaccctgggctgcctctctgtgatttaacgctctctcactcccacacctgcagtgcaccggagttaaaaatgaccttggcaaacagccttatgtattctctgtctagagcagaggacagagtcaaagaaaacccactcagaagcctggagagcggctgaaagtgggggagggcaggaaaggagggaggcaggatggaagcatgcatctcctgggcattagacttgctggattaaggagtggagagtcaaacatgggtagctctgctcagaaaaattattactgaaggagagattatgctccacaatctcaccagaatgtggctttgcaaagtgaaacgagggttcgttcctctgccagcacgaccaactctcccgggacaccccctcaggtccgtccttgtgccacaggccacctcacttcaggttggtggctcagagaggtagcagctcccatctaaatgtggcttctagaaccttctcttctcctgctgagaaaggattgtgctgagtagtagaagcagctggcagtggagtcccctggcctggttcctacaatcccaactttgacaattgtgtgacctcggacaagtcaccttacccatctaagcacatgttgttttaactgtaaaatgaggaaaatagcattcaactcagggtatgaatgagtggagccatgtggagcaacagttaagggcatggacttgggagtcaggcagccaaggtctgtgattctaggcaagtgatgtcaccactgagcctcagtttctccacctgtcatacaggcaggagtaaatgcctcctcaccccctttgttccttgtacaaacccttgccctggatgttctgtttgtcctcaggaccccctctccactgttggctggggaggctgacctgggaggactctgtgaatgaggcccctgccttccgacttcagctgttcatgacacaggcggagactgcgggcaggaggagagtgacacgaggtgtcaactcccaggctccctccctgagggttatagggcatggctctcttccatagctttctttgctcggccttttgttgatggttttcctcattcatcaaattggggtgctgagggcacccactgcttctgtcccagggcactgccctcttcgtgtgctttcccactctctccctacaccactgtacacagtccttttgttacacggccttccaattccccaatctgagggtgccattgtgtccagctgagaccctgaatgaagcaactgtcccgtctggccacagacctggcacaatttcccttcaggcacttaaagcaggagtaatgaacactgatgagttcagctcagtgctaatccctctacatgtgaaatctcagttcttcagagagccctgggaggaagctactacagcctttcccattttaaagatgagaaaactgaggctctgagaaggtttcacagccagagctaagcctagagcccttaatgactatcctcatgccctctccagtataggcaggaggctactgagtacacgtgcttgaacttccaaggcatgttctcaagtagaagtgtcctcctcacaactgctctgaggcacatgccatcggaaagctgggctaataattaaacaggggtgattttgtcagccccacatggcctgacaaagcagaaacacaatggatggtaaatattctattacgactgttattcccaaccccctttccaatggggtggtgagtaggaagcctccctatgaccagtttcttccccacagtcttgccagctcctgttcttctcatcacaccaggcttgtggccttgattttggaccctgttggaatgagggtcacaagagggtctgtctgtccacacacacagttgttcctcctccttcttccccacctccattcttacccattctcagtccttattccagactcctcccttgcaccagctgtgtccttggcctggggatgcataatgagacccagatgctgcccccaaaactctcagtttatggactgtccatcttgaagagatgaccacaggatgctcaatgctccagcaaagaggaatcctgtggttcaccaaaggcacacaggtctttggcacttagagaaatcatttgtcatatgttcctctaagtgccaaaggcctgtgtgcctgcagtcattcattaattgaaccaatattattcaatgagtccatttctggccactccttctcagctagccttctttatgagattttcctccactgacactccctgaactgctgctagccccagggctctgggctggctttctattcctccttctgggggtgtcattcattctcttggctttaaagaccatccatatgcaatctgcaggtcctatgatcatggcctccagaatctgtctcatttcgtccacatctcatcacctcctgttttctcactagcccaagccaaactcatctctagtctacactattgcagacatttcaggattgcctcattgccagcaaatttgcctcctacaagtcactattaattcatatgtcgggttgtcacttcctggttttacttcaggttttaataagcctgaagggaaacacttgttttcattccccagcatgaaactgggacatttcctctggtccttggagtgaaatccacactcccaaccacagacttcaaggccgcacctgctctgaccctgctgacctcccatctttcaccactggctgtggcttccttgcacttttgcaacaccaagctttttcctgctttcaacccccagacctgcccgtgggttgcaatttttgggcatccggatctcagcaaatgtgcctgctcctcagaaaggccttcctggccgttctgcctgaagaagcccctgtccacatcaagggtcttgcatctcatcaccctgttttattttccccatagcgctcatcccaacctaaagtatcttgtgaacgtgctgctggtctgttatccattgtcctcgctagacttcaagcccccgaagagcagggacctggcctgcctgttcaccattgtctctagcacctagaactcaggcctggtacaggataggtgctcaacaagttgttaaggacaaatgtcaagaagtacctgggggaagtgaggggctgaattggggggaataggttctttggttatggcccaaaaattgctagaagtttaaatgtgtcttctaagcccagctctctgtgttctcaaggtcgcaaatattaagaactcagggtaaataaaaatgtatcctttccagtgcctgcatgcccacactgaaatgagaaaagattttttaaataataataataaaggaacgatctttcaacctgcgtgcgggtctcagcggctccacttgcctgctgtgtggatctgaccagtgcactttcactgcctgggtctgggttcttctgatgtaaagtaaggctcccagtataagctgctttccttctagattccagggaaatcatctcacaaaactcaaatgtgagacaaacaagatttcagggcaaggaaacagactcaggagctttcctgggggcatggctccctcaaagcctacgtcctgtagagacagcagctgctaggcttcttggatagagtgcctgcccccagtgccactcctcactccaccctgcaaaagtctcaaaaggtatgttgaggcacagtaagcaggctgctagagcccagcatacttacagccctgaggttgtcagacaatgagcctcgtgatgagttattgcaccaacagctgttgcccagccctgctatgtggatcttggggacaataatttatccacaattacactggagagcatggtgcttctcaggtaacaggtggaaattcacaagcccaccatgtgatgaagacctgcccttccctgaccacaatgctatgagtaatgactgagaagattgggcagcccatcctcagtaatgcaggatgcactgtggcccatgtctgaggcatctgaaatatcagaaactccagtgggcttaccatggtcccactcctgccataatggttgccttacagtggctttttcttccaaaccaacttgccttcaactgcagaaggtgaggtccccaaaacaccagtaggccataggatagtgtgcggccggtagaataagaacctcagacacttcccacttcccctggtagagaaggtcttagtggccacaccgaaaggtaggtggaggctaacagatctaaggctgcccagtgtgccatttctgcactggatatgaaatgtgccctctctgagccctctctctgcctcagcgatctcatctatagaatgggggtatagagatagacaatctcatatgtgatcttaggcaagttcagatctcacagtttccaaacttcagtttctccagctatgaagtatgagcttgataatcttggctgtgtgactttggacaaggcccttccactctctgagccttggtttcccatctataaaatgggccaatggtaggggtgggaaaaggatgacctctgaggtcccttccatacagctgcctctgattcttcattgcaagtgacccagtgttccatatgacccatagccatctgtctgtcctttgtgccaggcctgaagcattccttttggactggtcatttctcaccgtcaccccctggagtctgccccaatcatttctcagtccttctgactgtgaagtgtctgtctgaactcataatcagcttttagctggtcccaaacagtgagtgctaccagctccattaatcccactgacagggatttatctttctcagctgaatgaatgatgctcccagccttgccccagaaatgtgggctgggctattcaacacttgtcaccagcaagctcttttcctgaggctgcatactccagccacccaggtgactgagtactttgtcatcttcttctcagagcagtggcagaaccacaaagcaaactcccacccatgacccacccacccaccttctgacctagtttggatgctccaagccataatgataaagtaatgttgtgaagagggaaagaggtttgcagtcagacagcctgaacccaggttctgccatgtacaggctgaagcttggcaagcctctgcacctctctgaggtccatttgcacctctctgaggtccatttgcacatctacaaaaatgcgataacacctacctagcagagttcttaggagatccagataacaaattgaaaacatgccagataatgcctggcacattttagaagcttgagatctactactggttctcttccagttctcccatcgtagtaatatcatctacagagcaagatggggaaaatgctcactgccagatcccattctaaagaggtatctccatctacagatttattgcacccgggctcctagccatacgcccaaaagtcaaactgaacaacagtaataatatttattcagccatgtcacactgaactgaggacctgacttaagcaacaattcagatctgccaacatttactaagcacctactatgtggcaggccgcgtcgtgaccccctggagagagaaagatggattggaaagtgtagcatcaaaattaacagcttggtttggaagtcagacacacctcaggtgaagatatggattgagtcataaactccccatgtggcactgggcaggttcatcacttgaactctctagacctcagcttttaaatctaaaatgtcccatagagttgctacaaagattacatgagatatacacttagcaaagtgcctggctcacagtaattgtcagaaacagaaagtgtcgagactcaaccctgcatggaaaagaaaataggacacacatactatcttagtccattcaggttgctataatagaataccttagattgggtaaagtagtctccccttatccacaggggatatattccaagaccccccgttggcacctgaaatcacagatagtgccaaaccctatatgtactatgtttttcctatacttatatacctatgataaaggctaatttataaattaggcatggtaggagattaacaacaataactaataataaaatagaacaattaccacaatatagtataataaaagttatgtgaatgtggcatctctctcgttcactcgctcaaaatatcttactgtattgtacttacttattttcaaactgcaagtggccatgggtaactgaaactacgggaagtgaaactgctgattggggggactactgtaatttactataatttataaataacagaaatgtattgcaaagtccaaggtcagtgcacaagcaaattcaatgtctggtgagggccagttcttcatagatggtgccttctagctatgtcctcacatagaagaagggacaaagaagctctgttaggcctcttttgtaagggtactgatcccattcatgagggccctgccttcgtgacctaatcaccccgcagatgctccacctctcaacaccactgcaatgagtattaagtttcaacatatgaatactgggggacatgagcgttcacgcctatgtaaatactacacagaaagatgtttatcaggtaaaagaaagtagacacggacagtcctcatttttctaagaataattggtaccagtacaaataccacttaaagagaaacttcttaaaacaaatgttgactatttactgtgatagtgaaggaaaaaggttggagtagggccaaatcttgaaaaaataaaattgaaagcacaaaaataagtcttttttattgtctagtaacaaaatgtaggttttagtgtcaaatgagttaattttttccattaaaaataggaattaccaagtgttgactttgggggaggcatggcacattttttagacaaaatcctatcttagcacagtctaacagttttgattttgtttgactttcacagcacaataaataaagagggtcatttggggcaaatatttccaagctttatccattttcccataggcctcttccaatcgttagaagataacatttttctcctttgaagcacctgacaactttgtcacttttctcttcttcggttgctaactagtttaactctgccagtttctcatttgcctgtagttaaatgtgaatggaaaagttatccaacaatacttttgctatttttatgaaatcctgaatctgtttaaagatttgcacttttcctcttcatcaatttcctttgaatttccattacatcatcagacatttacaacaaccaacaagccgaaggaaaccaatagatctaggttaaatgagtaaggctagaaaccagcgttaatgggaggtaaaacttaagcgtgcataaaacgtttaagtgaccggctcattcgtaagtatttttgtgttatgaagatttttacttctctatcaaaccttgtaacctcagagaattgaataatgacacttagttgtcaaattcaagataaccgacaagagaccgggcgtggtggctcacacctgtaataccagcactttgggaggccgaggccagcgaatcacctgaggtcaggagttctagaccagcctaaccatcatggcggaaacccaatttctactaaaaataataataataataataaaataactgacaagaatttctaaagtagttcagaatagaaagcttactaagttgattcatttaatggttacccttgatattttaacatgtactattacatgttaacatgtacccactaaatgtctagatctcattgatacttcatttaactcctgaacaataatagcttttcagtgtttggactctggttacctccttcctgatgcataggctactgttcatcattttagttctatcttgttacttttagtcatttatatttactatacttacagacactgttgggtttatttttagcaccttcctatttgtttttctatttgtactatctcttctttcttcctttatttcttcattcctgtcttttcaaaaattaagtaaatagttttattattgtatttttttccttatattggcttcttgtttcacattcctgaattttgtgcagtggttaccctagaagttttaatatatatatttagtttattatagtgtatttttaagttaagacttttacttcttcctgaacaatgcaagaactttacaacagttaaactcctgtacccacttctttctttttgtgctgttgttaaacattttacttctgcatagttataaatctgataagacattattgtcattttaaacagccaatattcttttatactaacccaaatatctctcctttgtagtgtttttcattccttcttgcaattttgtgtttctggattgaataattttccttcagcctgaagattcttatttggtatgtcctttagtgtcagtgtgatggcactaaatttttgctgattttcagcatttgtgtgtctgaaaatgtctttattttgtttcatttttgcaggattttttgctgtgtatataacacaagagtggcagtgttcttttcctcttactttagcattttaaagatttttctagagtccatcagtgtttgttgaaaaatccaccttattggtgcttccttgaaggtaatgtcttttttctttgttactgcttttgagaacttctctttacctttgttttcggcattttgactatgatatgtgtagttatgattttctttgtgtttaactttttggagggcttggtgggcttcttgaatcaatgagttggtttctctcatcaattttcggaaactcttgatcattgtctttccaaattttgcttctgcccagtttctcttcttgccttctgggactccaattatgtgtatgttagacctttgataatgccccatgtgttactcatactgttgtcttttaatgttcctttctcttttctctctggttttaattggaattttacctattgttctgtctttaagtcactgaccctatagtctgctatgtccagtctgctgtaaacccatatagtaagtttgtactattttattgattccaagtaactattaacagatactagatttgagaaggctatatgtttttgttcattttgcccatctttttctctattctctttaacagaataaccatagtcaaagtcctgtctgatgaatacaatagctgggtcatctatggatctgtttttattgttagctttctttttctctttgctttgcttcttttcttttctcttcttgctttttcacatgcctcataattttgaccataagctggacattgtatgtaaaagaactgtggaggtttcagctgatacattccaccagagcagcttccccctttcctctgttggagagtcagggtgaaggctgatgacctcagtctagtcagaaatttaagaggattgcagtttgagaaagactgaatcgaccacctctggcttttcccatttccttgtgtggtcttcatggctttggctgggagcctagctagtctctgtctcctcagccctaaaagcctgaagagattcagtcctgctctttagaagttttgagcttttctggctatcttcaaaatctggcaaatatcttgaggggaaaaacagggatttatgtcaggccctttctctctctcatggaatgttgtctcctaagtcccgtgagtttagcagaaatttcattccaaccttccatcctcatttcccagccacctgagctgcatagagcacttagcagtgtcctatgcgttaaagccaacagtcacttggcttcttatatttcaggcttctcttgtttccaatccatcatgccagccctgcacaactgccaaaagtgctgcttggtttctgctttctccagtagacaacctctgcttgggccaatgccagtcctcaacccacgtccagaatcagcagttgcccacagggaagaaaactgtcaggagttatcagcctacagaggacccactttgtcctcatttccacagctttctgatgtcttcaaattttctatttttgcggcttttctttttttttcttaatagttgttgcagtaggggagtcagcctgccacaatctactacatcttacctggaagcaataccttatcttgttatttttaagtcaacaaattagacattattattattaatatatacagcaatatttagagtcactcgcacataaatattaatttagagttaatcacatatttgctttgtattcctttttgaatctctgactttctatctgtgctaattttccttctgactaagccacatcttttagaatttcctctgtgaggacctgttttatttattcaaacataaaaaatttgtttgctctcattcttgaaatgtaatttcactaagtattcatttacagttggtcaattgtttcctcttgacacatggaaaatatcattcctctgcctctggctttcattgttattgttgagaagacagatgttagcctaattgctatttatttgtagatggtctaacttttctctctaactacttttaatatttctccgtcacaggttgtgatgttactttcatcttctggaattgttcttccacatcttatcatcgtcttccattatttccatctttgtctctctagcttgttttatttataactatctaagagtttactaattgtctccttagttctttgctccatctatatctgtccattgtgacttaaaatttcctttttttaacttttattttaagtttaggggtacatgtgcaggatgtgcaggtttgttgcataggtaaatatgtgtcatgggggtttgttgaacagattatttcatcatccacatattaagcttagtatccattagttatttttcctgatcctctccctcctcccaccctctggtgggccccagtatgcattgttcccatctatgtgtccttgtgttctcatcatttagctcacacttataagtgagaacatgtggtattcagttttctgctcctgtgttagtttgctaaggataatggcctccagctccatccatgttcctgcaaaggacataatcccctttttaatggctgcatagcatttcatggtgtatatatacctcattttctttatcctgtctattgctgatggacatttaggttgattccatatctctgctattgtgaatagtgctacaatgaacatacgcgtgcagctgtctttataatagaataatttccattcttttaggtatatacccagtagtgggatttctgggtcgaatagtatttctgtctctaggtttttgagaaatctccacgctgtcttccacaatgtttgaactaatttacactcccaccaacagtataacatcgctcctttttctgcacaacctcgccagcatctgttattttttgactttttaatagtagccattctaactggtgtgagatggtatctcattgtggttttgatttgcatttctcacttaaaattttgaactaatgtatttttcatttctagatgctctatatggttatttttcaaatctgctaagacatttttatagtgtcttattacttgctgaaatgttcaaacctcttttatttcattaagcatataaattttgccatctcattttctgtgctaataaaaattctaatatcggaagctttaataatcagattctgctatctctttttcctgcaagccttatctcacagtaccttgttttcttgtgtgttttacaattgttgacagtgaatattctttagaactttatccttgataattattagaggaatgaattaaaatttcacttctccggaaagtactgtgtttgcaccttttaataactcaagagaggtaacaacccaagttcattttcaattaaaattttcatttgaggtttttcagaccacaaacccatgtgagagctcacatatggttacaaattcttgaagaaaatgaggctccttccttccccatccaccttcctagtaccaaagtcaggacagacaggttttctgtgttagttcacttctcattcacctttgtattaaaggtctagctctttgaggttcaagttttatgttgggacctcttcccacttggtagggcctgggttttacctactgggtttctaagcatattttgtggttaacatcagaggccaggagactcatcagtgtataattaattcttgtataactaattatttaaaggcagtggacctattcactagcaccctgctttcggagtcactgaattcatgtttgccctcagctaaagccatcctgaacctctttagatgggagaaccctgatgctggtacctgtagcatgggggctggggctggagaagccaagtagtacactagggacctcacggtcactgtgagggatgggggtctctgcttggcttctgaacacccaaaagtaagctcttctgccttcactccatgtccactggagcctgggatcctctcataagaagctatatttactctaatgaaaaaaaatctcacctgggctgaaaaagcgtatgctatacatgagccttggttaacctaaactttcatccagagtttcaaggattaaattcctaagttctttttaaagcaaagagaagttagttccagtcctaggccatgataatgctcttggctgagaaaacctccttcgtttttttaaaatatggattctgagggtgcaagtgcagtttcgttatatggaagtattgcacagtgatgaagccatggcttttagtgtacccatcatccatatagtgtacattgtacccaacaggtaattcaccatccctcaacccccctcctctgttttaaggaactggcatttatgcaactaattgataaaattatcatctgtctcttaaccagattaatagtataattaaggaaatctgggatgatgatagcaggtttactgttgatgaaaccattgaacacttgatttaacccattaacagtgtttctgaaagtatgttccttgaaacactagaccatgaaaagtcctttatgttgaaatatgcttaagaaatattatatgcttgaaacttctcttggaaactcacgaagtatattagacattaaaggctctaagaaatcctgcaataaagaagcctatttaattttatttgactcggtgttttcaaattatgtgtgaccacagaaatagaaggaacttggaggagtaataattcattttttgggtagaattcactactgtcacagatatttgtatgctgtcaatgaacatttaaatgtggattatagagaaagtaagatttattcaacaaatatttgctgaaagtccactatgtgcttaccactttgagtatacatcggtgaataaaaaagatatagttctgtctcatggagcttgtaggagcattggactgtcgtggaggcattaagaaagaagtagcaagtgcctagaatccagctgcccctcaaattgttggatcacagccgtggaacaggccccagagctgggaagttgactgggcagttggctgttgtatccagcctgggagatgcaaaatttattgacataactgtacccctcaagaggaccataaagaagaccaagcagaaacacacttggttctggaacagaaaaaagtttatctaggaaaggaagtttaggaaagactgttagataagaaactgggtggtttttaaggcttgcagaatctcttattgatctgagaattcctcccaaaacaatccctctaaaagtgcctgattcataatccagtgaatgttaacaggaatgacgatgatgattatgatggtgatgatgatggcaatgatgatgatggtgatgatgatggtgatgacaatgatggtgatgatgatggtgatgatgatggcaatgatgatgatggtgataatgatgatggtgatgacaatgatggtgatgatgatggtgatgatgatggcaatgatgatgatgatggtgatgacaatgatggtgatgatgatggtgatgacaatgatggtaacagtgatgatgacaatgacaatactggtgatgatgatggtgatgacaatgatggtaacagtgatgatgataatgacagtactgatgatgatgatgatggtgatgatgatgacaataatggtgatgacaaggttgatgataatggtggtgatggtgatattggtgatggcaatgatgatagagtttaatctgcaactccttcccttcactcaatgctatggccaattggccaccaagaactgtgagtctacttcataagtaactaactcttaagctcatcctttaatttctttggaacagggcttaacctttctcaacagccccctcatctcatttaccttctttcagtgtgtgttcttccaatctgtctccacactgtgccaatgtaagcttcctaaagtttaagtctgggtacaggcgcactcactcactccgtgcacttttacacttttatgccttttttgtgttcttctctacttgtgttttctccttcttgtcttttagcaagacatgtactcatccttcagggtccagctcaatggtgagagcctctctggggctttggctgatctcaccctggaatgcactgcaatgttcctttgcctaggttcctgcaatgctttctccatttatctgtataaccctcaccacttctaagattacgttattatctgagtctgtggtgagggaacataccacatctgacctacggttcattgccagccccctcccagagtggaacactgaaggcacatgggcaactgttgcaaacgtgcagggtaaatgcacccccatggagtgacagctatgcagaccagagcccccttctcccaggttctgtgttgcccacacctttcttgacagtcctgggccagggcttccccaggtttggaatccagatgagtctgaaagcaaatgtcattctctttccttcaccacacagtagcatttgttcttgccaaggtagctgtgtgtgtgtgtgtgtgcatgtgtgtgtgtgcttgagtgactgtgagtggttgtgagagtgtggatgagagtgtgtatgtgtggcgtgtgactgtgtatatgagtgcatgtgtttgagtgtgtatatgcgtgtgtgtgtatgtgtaggtgtatgaatgtgagtgtgtgtatgttcaagtatgtgtgtgaatgtgagtatgtgatgtttgagtgtacgtgttagtgcatgtgtgagactgtgtgtttgagtgtgtgtgtgtatatgaatgtgtacgagtgtgtgagtgtgtgtatgtatgagtacacgtatgaatgtgagtgtgcatgtgtgtctgagtgtgtgtatgtgtttgagtgtgtgagcgtgtgttgtgtgcgtatgtgtgtgtgagtgtgagagagaatgtgtgtgtgtgtgtgttcatgccgatgttcacgatgggctggagggaggaccagtcccctactgcgtagatcgaggatgctgcctttacccagtcttcatgaagttataaaaattacagccatttgtcacaggtctctcaacacagcactgggccctgggaggaccaggccacatctcttggcgtctgaaataaatgaactcatttattcacacattgaggccacacatgtttgttgcaagtctgtggccaggcacagggctgggagctggggaataaagagctgacccaaacagcagaaccagtttgcgttttcatggaattcatgatccgctgctctgacagtgggcatgggtcagacaatgaccaagtaaacagatcagtaagatcatttggagaaacgagaagggatccaaaggaaagaaagcaggaggccacgaggaggggagtgtggaggagtgaggggctgctttaaattcagaaatccttgaagactgtctaaggaggtggcgtttgtgttcgggcttccataacaggtagggggaagatggaaggctgctccagaccagtcagggagaaggggagtgagggtggttgtggttggaccacaggaaatgcaggaaatgaaagggagggtggtaggaaaggcaagggctagaccgcacagggcctttggggccagcgaaggaagtggattctatcctgagtgcaactggaggccactagaagggcttacgcaggactgacaggctccgattgatgcttcccaagttcagccgtgctgcagggcaggaactgtaggaggagatagcgtggcccagaaaggcagtcaggagctgtccaggccagctgacgctgacgatgagtggggcccagagcttagactccctgagactcagccctcctctcccgcaggaccccagcagccagccttggagggctcccaaagaatgacatcaccctcagctcccagctgcttgatatgcagggaattcctcccaaggctatgcagaggcctcaggcttcagcagcaagctgcggcccgtgcctgggggagagaggaggggaaaatcgtaaccccagcagcacctcctcccgtgacctagactctgggccagacaccacaggcattttctggataatcctcacaactgccccatgagggacacctctgtcgaatcataaaatcctgaacagggaaggatgcctggagatcatgtgacctgtacccctgtgtcgaaacctgtgtattcctggttcttgtttatttattcatcatatccttaaataacacccttactacttttcaatcacttgaccaatattaattttcatagccacttcagaaggtcagaactatcattattcccatttcatggatgaggaaaactgaggcccagaaaggcaaagtaacttctccaaggtagcactggccatcatttacatctaggcagactgacccagaatccatgttcttctaggctgtacatgataccacctgctctcggttgttcatgagctggcacagtggaaagagctctcctcagcgggctggagcatctcttgtacgcccagaggtgtgggtgagctgttctgtggcacaattgtcatcctggggtctgcgacggtaagactcacctcagaggaagggctggcctttcattcctagctgcaattccttacaagtaagaaggagagggcctcaaacaggaaacctggggtgaagaggtgaacctcagatgcctatcttgtttaaccttctgtctccaggcttagcacagtgcctggtacagaggaagtcctcagtaacattgttgagtgaacggatggatagatgtgtgtggacccgggttcatccttcacatgagaaagtccgtgagatgtttacatccaactcaatatctagcacatacaggtggacaaggcagaaaggcaatgtcatggctcttgccctcacactctagggcctagactggtgtgacaatgtccatgcttacatgtcctgtctaaggaaagcagctcccgttggtcatgcctgtggaaatgtggccctgtatggccagctcttctgatttttcataagaacctggatggacagatgccatgcaaagtttttttttttaattttttaaaaatcgtgtgtatcccaaagaaaatattatctaagggtgaaatccagcccagggggcactagtttgagatgccaggtctgggatcagtagcaggtggcccagaatggggactgggttggtgaagactaagaagaatgagaagctccctggagcctccgagaggaaggtacattttgcatgccagcttatccggattcgagacttgctcgatgtttattttctggttgtcactccaggattttagttaagtcttgtctaacattgcagccaggctcagccattctgtaggaggattaaaggatgggactgtgtataaaattgggccaggatggcaagcgagggagcagctcttgaggccagaagagtgggggaagatggcttgatgacagacggaatctcaggcacctgaagagtcttagaagccagatttggggctgagccgcccttccccaagtggagattcaccagccatggccagactcgaggatgtgagatttatttttcttaagatagcaaatgtctttgcaggcatgcttcccagttgggaaattctttttatgctccatgtaatccgtctgccagagcctcctttgactctgtttatcggttctcttcctgtatgtgtcatgctctccttccctctctcctcttctccccttctcgtcaccacccctttgctctgcaccacccagagcctgttaggaagaaaggggggatacactcatcctggctccatttagggtgggcttttaatccagacatgtcgctgacaccagcatttgcaccaggtatttaattagaccaggaagtcccaggggatttgagaagctggctggcgaggaatgggctctatctccatatcttattttgacaagcactgtaattatccctcattgctggcaggcggagcagaatcacgttcgttcccagccccatcttctcagaacaagagtactcaggctcctggttgctccaccactaaacaactgcctgtctcagttccccagcgagaccgagactgagctcagccattactcaggagatcgcaggcgggcgctcagcctactttttgacagcatcgtggaggtgatttcagagcgcttgctgcatgcacatgggaaatagcttccaaggaggatctttgggggcagaaggaatgaggtgggcaccatgccctccaaaaagacagaagttacccctccaggagccagcatgaatggagcacctaccatgtgcccatttggtattgaatttaatcttctcaatagcactgccaggtcagtgttatcattccatattaccaatagggaaactgaggctgtaagtgaggaagctgcagagtcagttgcagtggcctcagaattccgaccaagagctagctggccccacggtttcttcccttcctactttacagcattgtggctcagggagagcacacatgccctcatgctctgccccaaacaatttgtgggtgctggaaagttctggccatgtcaggagcaagtgctttctcccttgctgtgctgcccaaaacttctttaaggaggttaccctcatctgtcaaacagggatgtccctgtctgtcccacagagtcttcatgaaatgaactgagatggcatattttaaagccctgggaaaaccgaggcagcctcgggaatggtgacgtatctggttattgagactgtcttataatttggggcgtgaaaacctagggctacagggacacaaggtaatgagaggaaattgccaaggaaagcgaatgcaaaggaaacaccacccaagcccagcctggcttccaggtaccctctgaaccagcctcctgccccactgtgggccagaatagaccagcctgctaggaaaacctttggcccactgcaacaatgacaatcacaacaactcaaccgtttagtgaacacaaaatatgtacgaggcacgggattatgcacaggaaccacgtccgtacatttcattctcaagatcctatgaagtaggtgttattatccctatttgatggatgagcaagctgtggttcattaaaccacatcccccatgtcaaacagcaaacaaggggtgaggccagttggtcttgacagtttgtcaaaatcgctgtgctagaaaaccaccctccttactggttgtgttccaggggttcccaaactcaagttcttcttggaggagctgcaagaaatgatttgagggtgatagcaaggaagaatgcatctgagatgccaggctcaggagattcctggagtcctgcactgtgtgccctttggcccagaaggcccttgtaagcacctttaggtgttgtctgcatttcccttccctttctggtcagggaccccagctctctctgcatggattctcctctccaggaggtggggggtgggagccgatgtcaacagggaagaggggcagaggaacaaggacagggatggggagaggaagaaagaaggaggtgggatgtggcagctgggcccggaagcaggctagagccagctgcacagctctgacaatctaaagtgtctcttccgatggtctccattcagccccatctgcagatagctcattttgtgaatgaggcctgggtgtttgttccagaaccttagctgtgattaggaaagacaggagcacttgggaggccccaccttcaatgcaccagagtatttctagaccctcattctgcagtcagctctagctgccacatcagggaattcttgctggtctgtagcctggattccaattgtggatgtggcctgttaaaactttcctgggtaggacagtgtgggcgttctgccttaggagtcagacaggcctgagtttatatcccaccatttccatatgctggctgtgtgaccttgaacaggtcccttagcctccctcagcagtggagtggaagattaagtgcacagactctgaagctaagccttctcccatgctccagtcccagctctgccacttactaactgtgtggccttggcaaagtgacccaacacccctgggcctctcttctcagctgcaatacagggctaatacaggcatgcatcttatggagttgtcaaaaggatgaaacaaattcatgcatttaaaggacttggcacatggtgagtgctcagacatgttagccagtatccaggcatggtggctattttctggaataaatatggataaactgagacaactttctctcctgaagatgggtccattgcgaagtcatctcaaagaggtgtggcctggagaagtggttccagtacctcatgccttcttccccttccctccttctctcctgcctccccctgcattcttcatgtgcctcctgctgtaagcatttgctgagcctcctgctgtgtcccaagctctgtgcttggggtcaaccacccagaaatgaatcgtgtgggtcccatcctctccaagacaaacagttagaggatggtcagatagtgccagtggagagcagggaaggcctcgtggacaacatcctatttgagccacatgaccatcagggaagagcatttctaggcagaggaagcagtttgtacaaaggccctgaggagagaacaagcttgagaaataggaagagtgcccgagtgtctggagtggagggacagggagaagatgggtaggaatgaggttgagaagtagctagaggtcaaatcatagagagctttgaagccacagtgagaaatgtgggcttactttgagttttctagcataaggttgttctgaagattaaatgacaggagacaggtagagtgcttggaacagcatctggcgcattgctgggccttaaataattgttacttttattatggtggcacttatttccatattcagccctgaggctggctgtggtctactaggaaattattggcattctggtttaggagagaggacttgacgggatttgggtgacaagtctcagttctgcccttccctggcctagccaagctcccttccttccctgagtttctataaaatggcagcatcacattcccctccccaggtaatgtgacaatgaactttaatgtaaagtgccacccacgatcaaggaatctcatcatttaaactgcttttgccatctaaggtcagaaggcttaaactgagcccgtaattacatcaagtgcctgtaatcctagctacatagaaggccgaggtgagtggatggcttgagcccaaaagttcaagaccagcctgagcaacatagtgagacccagtctccaaaagtaaataatttaagagaataaaaaattaattttttaaagaaggtttaaactggttgtgacctaaggaaacaatttcttccagccgcatcattgaacaggtgggacaccaagctcccttgtagataaagatcgaggtggaatgggagtggacactgactccatctaagatcatggaagcgctctcacagtgaccctactgggctctctggaagctgcatcccagcagctgtgcagcccctgggaccagccaggagtgacctgggtgctgccgttcaacccacctgtacatttcccaaaaagaggcagccaagtgctgattcagggaatttaaactttaatggtcccccggtctattattatgttttaatgaactggaaaagcacaaacagaaatccttaagagcatcagccgtgacacagaaatctaatacaataaaacaaagtgcttataaaccccagagttgtttaaaacccagaaattgccaattgacatatgggactatatcttcttagcccctagtaaactgagtggcttcaaacaagtccctatcacctcccagggcctcagtttcttcacctgtgaaataagaggatcaaaaaaagataatgttctctctgttctcttccaaccgaggcaggcatctcaagtatttcttagtcagttctactctaggctacacagtatctgtatctggcagctgtatgaactactgttgaaaatcctcttcccaatcccagtttcaacatcactcctcaaggcagcatccaccttcactctagactgaattaattcctctgtcttaccacctaaactcctctagaaaacttgatagaggtaaagataaatgcattttttcaaaaattctacttttctagtcccaaggcattgtgtatatcattcttatgtaagttatcacaataaacccataattagttacttccatttatgtcaaatcgcctacaaagcagaaacatgtattattcatttttggcttcctccccagtatctagcatacgaactgtttgcaaacatgcccagttcttcaaactttgtaacttcatgccttttctatctactacttgggatgggcccaccctccctttgtcctctaagcacactcctattcatccttcaaagtccagcacaaaaatcccctcctctgttaaacttcaactgctccaggctgagtcttatgtttgggtccttcatacgtacccctcttctattgtttggggtattgtgtgctgtgggatctgtttactctcagttctcccctctaggctgggttccttgaaaaacaccctctggacatttcacctctacatcctctgcattcttggccaggctctgagagggcattggtaaatgttaactgcctggcaatggtgatgctgttaacctgatgtgtcaggggtctgaataaagctgcctcaaggtaggcagatgcccacaaccaagcaagaactcaaagctgcaggctcctcagcctgaaccttagacagcgtcttggtcaccatttcaacaccttgaccacatttctcactctcccaaatttcctcctgcttattcctcatccacatacataaggctgtgtctcccaggggaaattcaactacttggtaattatcctgcttcttaagtttggggctaggggattcatagatgatgttcagtattatgctgtgcaatgtagatgcttcctaaaccttctcaggagctaccactgagtggcacctggggacctctcaggaagagccagttttctgggcagtgtggggcaggacagagctcattaaaccagcctaccacctgtcttccagctcctcctctcagcctctgggcttccagcagaaagcacacgagagcattcttgttggttttcttatgacttgagccagcgagacgtacatgcccagcacctgttacctgggctggctcttggctgagagcatacatgcattgggtcaggtttcagatctgctggaggaacacagccagaatgtcttgacaggcagccctggcaaagccccagaaaatataagatctgagtcttatgatggactctgtgaccttgagcctctcacctcgtgaccttgggcatctcatgttctctccacaggtctcggttctggactccttcatgggagctgtcatgcccctgtcacacagcagtgttgtgcccccggggatcagggaccaggatggtcctttcttggtggtgaagggggcattttgcatattccagagattcaagtttccagacctatctagaaagaaacatttgagtttacaggttggcgcttctcagcctctgtctctcttcctctctgttcatctccctctgtcccctctatgtatgtttgtgtctctttctgtctcctctgcctttctttgtcatgtctttctgcttctgtcctatactgtctctcacctccaccctggttccccccgccccagatgctcttctctctgtggggttttttcttcccctccatttccttctcctctcccactccttcctccccagattctccctcactacaggcttctctctaatctctctctaactgcctattcttctcacaagaaggagtcccctctggggcccagaggccaggcaaggcattgtggacaaggagggcatccgtgccatccaacgggcaggagcccagcctcctggctggtgcgtggctgtgctgtgggtttgtttccacttaccaaagggcatctgtaattaatgtgggcagtgataaaggagctggagatgtgtttatgctccttcgagggctgagatgaaacacccataacatttaatgtggcgcactgacatttaaatgtcaattagaaagtccccgctctgcttggctggcccctgcatcctcagatgagaccgccctcctccctgccttgccagccctgctgggaccaccagctcacaaaagacagtggccacacagcaaccgtgactgaagagtgtgcagggtccaaagaggctaaagtggctttaagagcactccggagggggaggactcttggaacagagaaaggaggaggatggtgccaggccaccaccaaaggcacgtggaagggggctgggcaaatggtgaaggagcatgtgggagacaagtttagaggtagcgttggcttcctcctctcttccctcagtacctacagggcagaatctagagcttgtttgtgccttggcccttaggcgctatgtttctgcctctgtggttgatcaccctccattagaccaagggcttcttgagaccaggttcccatctcttcatcacacaggacgcctatgcacacacggtgcctggcacacagtaggtacacaaggtagtctattcagttcaatacagtatatattcgttgagttcccactgcgtggtgggcattatcctaggaactgaggctacaacaatgattgggactgagacctgcccccacagagtgtacagatgctcttcaaattaccatggggctacctcctgagaaacccattgtaaatcaaaaatacagaaatcaaaaacgcatttagtacccccagttaatccatcataaagtcaataaattgtaaattgaaccattctaagtccagatgctccttaacatacaatgaggttatgtctcaataaacccatcataaagtcaaaaaatctgaagtcagaccgtcgtaagtcagggatcatctgcgttacatttttaaagacagacagaaaaatagatatgtggcaaatgtttagatggaagcaaagaaaagaggcagccggcccaccctggatgacaagaaagcttcttggaggaagtcaaatagagctgagacccaaagaataaatgtgcatttgcaagacagagaggcagagggaatactggacagagggcccagcacaagtgtggagccaggagggagcctaggagtgcacaggggttggtggcaatgggcacagcagcttccttgtgaaatctgagctcagagaccacatgactgcatggggttctgcaaccagcacgtgagctctgtgagggcaagggcctcatctgtcttgtccactgctgtgttcccagagttggggaaagtgcttgatgtgtagcaggcactcgacaaacatttattggatgagtaaatgaatgctgtcttcactggcctctcctcccttgtccagttcccaaagctcagtgggtccccgcaaatgcatttattttgcaaaagcctttcccaaagcctggcatccaatgggtgcctcatttcctcatcccctgcacgccgtctctcagtccctgagctgctgtgcccacgacatgctccattttctcataaaagcccttccaacaaggggcacatttgcatttcaagtttcctggaattggagtacagagaaatctgacttccagagcccagggctctaagctgcagctggagaactgaaacacagcaagcaggacacctgcccagaataaggttcaggccctggaatatcacatgggacccatgctcctgtagctgtctgcagtctcgagccccaaggcagtagaacaggtgttcatcttctcctgcactctggaaatggagtccagggcctgagctactgagtttgtagactgcaactttggtagcaagaggcatttctcctcctcacctccacccacacacagatctagttcccctcgtacgctgccctttcagtcttggacactgcagaagacctgctaggagagcctaagaaacccaaagccttcccacctgccatccaccaactatcatttactcacccccactcctccagagtgcagatgactatttcacttactgatttggcaggcgctgctgctcctcaccttggttggagtagagtttaccctgcccagccctgcaggcccagtggtaaagggaaggaggctagtgattattccgactttggatcaatcagttgctcagtttattggaattacatcccagtggctgctattgatggaactgctggactcgggcccacaatcctcatgccagttttataacactgacatcacctgctcacacacagggcttcctctcccatcctgtccccatacctcactctgtagcctgagatttctaaggtgggggatctgcactgggtgtttggcataaatgatgtaagagatttcctttgtattgctctcagctacatcttacctttgtgtaagaatgcaaagtcataagcacagtttacaattgcaatgggaggtatgtgctagttttaaggtgttttgtttttttttttgtttgtttgtttgtttgagacagtttcactcttgttgcccaggctggagtgcaatggcacaatcttggctcactacaacctctgcctcccaggttcaaacgattctcctgcctcagcctcccaagtagcttggattacaggcatgtgcccccacacctggctaattttgtatttttagtagagacagggtttctccatgttggtcaggctggtttccaactcctgaccttgtgatcagcccgcctgagcctcccaaagtgctgggattacaagcgtgagccactgcatcaggcgttttaagtttctaccatttggggcatattcaggaagattcctatcccaacacaccccttccttctgcttttataaacacacagagtccccaaccaccctacgtcctctttcctccataaccacgtcacagtgcactgtaaacacattacgaaccagctatgcaataacaatctgctgaatctcagagatgcagaaagaaatcactgggccttctattgatacattcttatgttatcatttttaatttctataattatgtttttaaggtacattgtgtatcagcacagcagcagatgctaataatatattaaaaactgtactcgtgttctgggagtgttcacaaattatagcttcacactattctcatcttctcccgcctctgctcagatgtccttgaaacatctctaaggatcctggaaggcaaactgactacaacacttatttgcacagcacagcatctttcctatgacacgtcttttggtttttccaatcatcaaaagcaagaggtagcaggagaccgagctgttaggcactgaccgtggcattgcctccagggtgaattgcgggggcacaggaaaaacagctcagattcctagcttttccccaccttcctgatctactgaaccacactttctccagggatgtggcccgtgatctatattttaagaaaacacctcaaataacttcccagccaggtgtgtgcaccacagtgctgggacgtggtattgttcttgccatgggaggtgggagattcttgtccatccttcacccagaagcctgcatgtggtttgtcaatttttttttattttatgaaactttttttctgtttacactcttgcagaacaaacagacaaattatatagctgatgtcacatccctttgaaaaatctatcaggtttcatccattcattcaacaattgtttttaccagttacactttttttttcatttgccatatacagaaactgaggctcagtgagactgagagatttgtttctgacttagcttgtaagaaagagattcaggaactcaacctaggttacctggccccaagtcctgtgcccttttaattttacttccgtacattttaatgaaatggctgcgagaccagagctctgtgtgtgaacaagttgtgcctttcaaccttcctttatctccccttctctttccccaccaccaagagcaggctgatgagaaaattaacattcaggacacgttctgctcccttctgattcccacagagagaacacagcctctgcctgccaattagtgacgttcagatctctattagagatggggacagctagttccagttatgcaaatgcccttgtctgagagtagccatgggccagcagcatgccagtctcacctctccccatggagtcaccatggatgtgacttgcacctcccgtgttgctttaaccaataatcaaatcagtatctatttatataagcactggccaaggtactgcaggaagctcagggacagattttatttcagcctaaaggaacttacactgagtagagagtgtggccagggaaagggcagatctttcaaagacactctgttcttctctaaacactcacagtttctatttattacccaaaaaaatacataaggaaaaatacctaacatttgttaagtacctactatgtgccaggcactgttagacactttatacacattatctcattcaagtccattaattttatataagaagcaatatgctatttggttcaaggcatgtgttttaagtaggaaaaactaggatttttaaaactaggattttaatcctgccactttctccatgtgggacttcttgacctcagttattcatctgcgaaatggaaggaaacaatgtctgtttgccaggaatattttcagaagcaattagataaggtatttaaatccaagcacctcatcttcatatgacacagcatagtgttaagatgcctaatatgtagggaaatgacaaaaatggacaaatgcaggatattattagcaacaatgcaaaaatatctgtatatggatgaagagtggaagaggacaattatgggggaaacttgttgtcttttaatttctgaactatctgtattattattattattttagatggagtctcactctgtctcctaggctggagtgcaatggttcaatctcagctcactgcaacctctgcctcccgggttcaagcgattctcccgcctcagcctcccgggttcaagcgattctcccgcctcagcctcccgagtagctgggattacaggcacctgccatcatgcatgactaatttttggttttttgtctgtttggttgtttgtttgtgtgtttgttttgtagagacagggtttcattgtgttggctaggctggtcttgagctcctgatctcaggtgatccacccgcctcagcctcccaaagtgctgggattacaggcgttagccaccgcgcccggccaactatccgtattattatgtattttcatttaagcttttaaaggaaaatggaaacactgcattaaactgagcctcagagaaattcagtgacttgtccaaggtcatacaaggactggagggaccaaggcaggatctatccattttcaatgcccatgctttcccccacacaccatgccaccacatgtccctcaggaaacaggtctgcaatgattcaggagacctcgtagtctacattgatagatgtaaacagcattggtttctgtcttagagagtgggccagtgaggaaggcatggatcaaagcaaaaagaaaagccaaggagggggaggatggagattaaacaggtccctggttgtcaggggcaaaactgttaatgacggtggagcaccatgaaattaatgacccacccaaagcacctgagaaattgaactggttattaaaatgcaaatcataaaccaggaaaaggaggaaaacaagcacgaggaattaggaagaaggaagatatggcatggagtaccacgaacagaaagtctgtggccagcacctggatattcagagaaagagtgtgatttaggcttcagaagggcaggggtctgtagcttagggactgggcagagctgttacctagaaaagctagaaacagaaatgcataaatcccagttgtccctgacagtgggatacagtcagggcctgaagtgcaggggaaggccatcttaggtcagaggcagtggttcttggcatacagtggttttccccctaagaatgttaggcaatatttggtgacatgtttaatgagcacaaccaggttaagtatctactcactgctaatctctggtgagcagggagaccaggggtgctgctaagcatcctacaaggcctggggacctccccaccaactacagttatccagtccaaaatgccatagtgtcgctggggagaaaccctgatctaaggatgagtgagaaggtggatacaggaggtgaggaggtcagaagtcagaccaaacatcagatgggaagctaggaggaaaagaggtcagaaaaggagttatgaaccaaaggacaaaaggaagttaagtagtcagtcaggagatgaggatcatagaggagatcaggcaaagagaagtccagaggtggaaaaaagcttcagagctcagacgggctgggctctaacaatcatcacagaagcagcaaagatcaagaagcaatggggaaggacagttgaggctagcgccagggggaagggccattggtgaggagcctttctgatcagaagttggatggagaacaccatggtggatgtggatggaggtcaaagtgatgatgttctggaaagcagtttaaacaaaacaaggggcctgcgtgctttactaccagaggccatctgttaatggatgatgggaaatgccactcttggcccccacagtcaggagcaggtcaccttcaactgggcacagcaacacgtcccactgcaggcaggcacaaaagcagaggctcattaaagagctgccctgggcccaggctacatccttggcaaaggatgagatttgcacccaaggtcaggatggctcgggtgtgtggagcacgggctacggagccaggtcaatggagttctaaatccctgatcagcaaccttctacagatgtggcctttgataggtcactgcctctctctgaagctcagtttcctcacctataaaaatgggatcgataacagaggttacatctgtgtggatcacctaaactgtagaggattttgcaaatgtgttgttgtggttgccattcttattgctggaacataattccctcattagtatttctgagtgctctggtgcatatctgctgcagcagaatccttcatgcatccagcaaacatttcctgggcatgtagtatgtcccagacactgtgctgaacactaagattacatggaggaatagagattaatttctgttctttgtttactaagctcctaggggctgaaaggcatcttaaagtccataaacttcctcctgatgcttaagtaccctccacaacatcccacttatgtgtcctgggcttgcacacttctggtgctgatgagctcaccgcctcctgagacaggtgattccttctacagaccactcagactatgagaaagttcatgccgggtgcagtggctcacacctgtaatcccagcactttgggaggccgaggcgggtggatcacctgaggtcagagtttgagactagcctggcgaacatggtgaaacccgtttctactaaaaaaaaaaaaaaaaaaaaaaaaattagccaagcatggtggcgggcacctgtaatcccagctacttgggaggctgaggcaggagaatcacttggacctgagaggtggaggttgcagtgagccaagatcacaccactgcactcccgcctggttgacagaatgcgactccatctcaaaaaagaaaagacaaaagaaagttaatatatacctgtattgagctgaaattctggttctggccctttctctgcggctacccaggcttgtgttttcatctcccacattacctcctattagggactttaatggatgacatattgtcacccagcctcctctgctggatcgggatagctttccatccagacaaagaattttcatgactgagtgaccatccccaggatgggctttggtgtctctcttccctcagaaagtgggaagctccaagtgctgccccctgaaacccttttccagtaaccatggcctccaggggtcctggggtgatctcagaaaggtagacagacctctttagcagtaacctggaatattttgctaccttcctgaaatctagagaacagagcaactttgcaagcttcttcaaaggagcccgttctgacccaggtcgatggagctcccaaaatctgcacccccaccccccgctgctgtgtgcaacaggagaggggctttcccggaccagcttttccagaaacatgaattctttttgacacttggcaaacatttggggaccctctcagacctcactctgggcaggcccgaactgtcttttccatgccagagggcagtccaggttcctatcagagttatttgaataatcttcccaacacctctgagctgcagtttcttcatgtgtcaaatacagataacaatagtacttcactcataggattggtggacaaagtcagtgaggtaccaggtggaaaaagaggtagaacaagctgggctttgcggcatgccaccgtagtcctagctactcgggaggctgaggtaggaggattgcttgagcctggaagttcaaggctgcagggagctatgatcacaccaatgccctccagcctgggagacagaacgaagccctgtctctaattttttttttttaaagaggttgaaaggtgtctggcacttagtaagccttcaccctagttagctttgctaggattatgatttccatccagacaaagaagttgccctcagtgacgttctagcagagtcatcaaaattgggttaaaaggaagcaatttagcatggagcgagcctaaaaatgcaccaaagtaatgaaaagagcaaagcatctagacatttgatatctggctgtttttccctaggaccattgtcatggatggggataggagagccatctaaggtccctgcccatctgcaacactctcctgtttctgctccgatgctctacgatgtcgtacgtggcagagccagcccagcgtggacttcagctctcccagtaactggctgagtgatattagaaaagtcactgagcctctattttctataaaattaagaaaaatcacactcccttataaaatccttagggaaattaaagatccttgggaaaatagatctcttacaggcatatcttggatacctgatcaatgatagctgctatagtcttcttctgatcatgcttttcataataatcatcttaatcattactggcattcaaagccatgaagcacctgggagaaggagaagctgatctgtccatgcctgtctcctttggaaaatgcacgctgttacacttccccacatgttcaaattcatactctctcccccacccccttttttgagtgcccccaataggcacttgagaaggctgaagctgggattgtaaactgccagatctcctgccttgctctcaccccttgttccaaatcttatcaaatattaaaagctgtgaaatagaggcaggttttaaatcattttaatcacagcattcctcagcctgctcaaaagggctcaaaggaatcgattcagaagtggtaattatgactgtggccccgtgccaggcggcgggtcagcattggagcaccagcgacagacggccggcactgactggggagggctcctcccaggtggggacaccgaacaggagatgcctcctgggaggaaataaagctaagtcatcccaggctgggtatcaggttttaaaattcataaccaagtcaactgaaaatcagcttacctttattaagtcccccactaagtgccagatgcttttagcctcatttaaccctcagataactcctggaggtatgtgtcattatcctgatttataagtgaggaaactgaggctaaaaaatgataagtagtgtcccaaagccaatcaaaaagtagctcaactagatctatccagcttggaagcctgcaatttgttctctgtgttttggtcacgctcagattctgaggactgctgcaaaaatgttgaaggaggtgctacccacaggtcccctgctgtccttctccagcctccaccatctgcccggtcctcactcactttcctccctcttcccccacattgtcttttggactctggttgactcttgctgtcctctggctactgggattcatccatgcacattagaacccagttaggtcactaaccctttgaccatcacagcccagctgtcatatccctccctagactcatctcttccctggccctttcacctccatgctgtatactccagcaagacttagcttcctccagttcctccagcacctttctctcctgccttcttgcctgtgcgcaggcttttccccaactggagcaacttgctctgtctccacctccaggtctcagttgaaacatcacttcttcctggaaagactgctgactcctaggtatttttcccctaatttataccaccgtggccagggcttttctgctatgacggcacccagcacttggttggggttacttgtttgaattgttgggattccttttactggccagactggaggaggacagagagcacgtccatctgactcaccacagtccagggctaagcagggttgccggtacatggcaggcactcagtagacaatggctgagtgagttatgtcaataatgggaccgtgcttaaatgtggacatttctgggggctcagggaataggtcattctgtgggccagacaaagcatgcaagtgagcagagctggcccttcgcctacaaaataccgaagaatattcttcaatatcacaagaaagtatcttttccatcatttttcttgaaaaatgcatccctcctgatctatctttcatttcctcacatttaatagagatgtgaatacagagaactatatctctactataagacaaatagcaccctacgcacagtaatgacagcccaagtagtctacttgtaggaacaatgaaaggaagtgatgggggctggggtgaatggaggtgcaccgagcctgtctaaagaggctgctgcttctcaacctcagcctggtattgcccaaggaaatgtgaaccagtgcagccagatttcctgacttcaagaggagctggaaatcgactgtatgcgtaatgtcccaatttttaagagctgcctcaattgaacacgcacaggcacaaacaaaaacaaaataaacaagccaaatgcaacatctgctgagaggttttggttcttggattgcaacctctgcacacattttcccactaaataaagaaaagctccttgcagatggaccccggtgggacctccaatacccggaatgcaccgaatggctgggatttgtgtggccccaaaaccctcccttcttgcgctcacagtgctttcttgaagcttcagcaaaccccagcgccaaaggaaaaatatttataacctgactaggcagcgcttaaaagatcaaggcatacgtggtgtgcagaaatcactcgcacattgttcctgtttcctctctgccataggatcaaatgcttccagtttcaatgattaatcgcctctcagttttcaccacaagttgtacaatgttattgactgaaacagaaatattcatttcaggactctgctgctggaacaaacacaagctctggggcggggctgatgatgactgatggcacaggttgctgcacatgtttctgtgctatcggattcaaaccacccctgagactgctctctttacagatgggactcagggaagctcaaacaactatccaacaacaatcatttagtgtgactttattaatggccactatccatggaatgtttactctattccggatacggtgccaggaacattacctataccatctcatttaagcctcataacacccactgttatatttgggaaggagccttggcagtaacattttatacttgaaataactgaggcagagaagcccaaggctgctaagcagcagagcagaggggccagtccccagcccagagctcccacctcggctctggcattgctctcctatgcaagaccctgacacagacacacacagtcttttccaagctggctgggcaaggaacaatttcttttgcagaaactcgagttactacaaggcttctgtggacagtctagggtaatattggtactttaattatgcacctggtgtgttatctatccttgggagttgggaaaggtgatgctctggcggtctggggaaatctgccctctgaaattcgagcactcttgaatctcttgcctggggcccaattgagcatggttgctctccaggaatgtcccagggcagtgcctctctaactcaaatcctgggagatattctccagcgtctatgaattctccaggtaacctctttacaaaatttaaaatttttcatcaaataataatcatgtaaacatcaatttactattttaggttgtctgttttaatcaccttataaccatctatgttgggggtccacaaactacagcctgtgaactaaatcagcttccaacctgttattctaaggtctactactgaagaatggcttcatggtcttaacccattgagaaaaaaaaaatcaaaagaaaaataatatttcatgacacttgaaaagtatatgaagtttaaatttcagtgtccataaataaagttgtattgagacagcagttctcattcatctgtagctgcctttgcaaaaaagacagtggagttgagtcattggaacagagaccttatggcccatagagccataaatatttactatatgggccaagacagaaagttggacaattcctgacctatgcaatgtgatgttagtggcttatgtttgtgcttccagctgagttgggtactctgtctgttgtggttttgttcaagttcttggattgcaacctctgcataaattttcctgctaaatagagaaaaactccttgcagagggacccaagtgggacccccgatacccagaatgcaccaaatagctgggttttttacttttattgccatagggctaatgagaaaaataaaaatagaggaggactcaggcacttagaacatttgcagctacagaaagcagtaagtcctcacattattgtctacaggttctttgatattgcaactttattaagtgaaaagacatataaagaaaccaatttgaccagaagctaattgaaagaaatgagttaagttccttgggcatatttctgggcacaaaaacatcaccaaacttctaaataaagacccaaaacacttgtaacactaagcattaaaataaatatgagctatacatgcatttaagaaagattaagcaaaacaagtcagataattatttacccaagtttggtgaattagcgagtgccagcagtcatagtggtggtctgttggatcaaggaataaatgtttgaaagcaaaagttgtcaggagcacctcctcctaccacacagttcaaaaacaattacagatatggcaggctcgccaagcacttccataccacatggtttattgccttgcatttgtacgattatcttctgctttacaaatttttattttacaattacttttattcattgactgattcattttccaatccacttattccagttcagggtcacaggtggttggagcccatcccagcagctcagggtgccaggaaggaacccaccctggccaggacgccatcccatggcagggcacactcacacacacctacatactcacactgggaccacaccagttcacttcacatgcacagctctgggacgtgggaggaaactggagtccctggagaacacccgtgcagacatgggggaaacgtgccgattccacacagacagtggctctgccagggtttgttgtttgtttgtttgtttttcatcaatgttatatgaagcaacagtattcgaagacctgctgtacagctttccagcagttccaggaaaaaagagccctgggagacttaagccatcacagtacaaggcagtagaggcagggtgaaatagaatggaaaaaaaaaatgtgaacccacactgcagtcatactggaagcagcaatcccatttcaaccaaacaacctcacattaaactaatgttgttaatttgaagtttattggttttgcagtcgtatttgtgtttaatttggaaatttgtttcagttttatagctgaataagagctaaaaagcataaggattttatacctaagttttatgtctgtacatattaagtaacattatggtaaagtcaacacttactgaaaatgtcccctttaatagggcatatgttacttaagtttaagcaggaaaaatgggtttaagaaataccaattgtattatatctttaaatatgtgtgagctgttcaaagttgccacctggcagaaaattcaatctcagttacatagggaagttcctacccctttctaggaaagggtcttgttaaataagaattctaagcttaagttggagacaggttcttgggttggggcagtgatcattttttaatcttgcttgtatgcctacactgcttttgtgtgtgctgatctgtccatcctttaggctgtgctctgcagaatggctcaaaatcacccctcacttagtcctcccacttgcttcctttgtaccccctcagcccactttgcttcttcctctttcctggacaaagggagcacagttgttctcaacgggcctttagaagcaaaattctggcttgactttccaatgtgggagtgggagaggactgctaaaaataattggtctttcttcttagcaattcaccttattacaactgttaggtggaaaacttttttttcgttttactgaaaagtttaacccaggcactgaagagttagattgtatggacctcttttaatcatctgctgagttctccaatgtatcagttagctattgctgtgtaacaaatcaccccaaacgcaatgctctacaacaataaaaatcatttattctgctcactgcctgcagtttattcaggcattggatgagacagcttcttcctgctccatgtggagtcagctgggtacttgaactgggacatggatgatctactttcaagatggcttattctcagggctgccaaatggataccggctatcagttgaaagctataagcaggggcactctgcataagcatggctcatctctacaaaagctcctccccagtctccttgtttgggcctcacagtgtatggtaacctcagggcagtcagaatgtgacaactaaagacttcaggagtaagtattccaggaagcaagatataagctatgtggccttctaagacctagcctcagaggtcacatagtgtaacctctatcacaccctattggtagatattgtaacagaagcccacccagtttcacagatggggacatagactccatttcttaataggtaactggccagagttgtaaaagagcatgtgggatggaagatattgttgcaagcatctttagcaaatacaactggacatacccaatgcaagcacaggattgatcctccactctgcccccataccccatgatttattagccactcggacaagtgacttcaactctccaagcctctgtctcctccactaaagtggggacaaatgagtattacaaatgagaccattaaataagataatacattttaaaaattaacctggtacctgtcacaaagtacatgcctaacaaatgtttgcttctgtctcacttcctcaatttcatctcagtcaacctggactgactcaaaatggcattcttcttggctgccccctttgaagtatttctgctgagaaaatagtttctgtgtatttgtaaatttacaggttgaacatagatcattattcaagcattgctggtcgattcgtcttttcaaaggcgggagctgctggctgtgggaagggacccagcaggggtctcttgcaaccctgctctatgggtgggggaaatctggacctccctctggtggggttgattgaagtgaagggtcaccatatgtctttcccaagagggtgactgacttcctgctttggtcccagtttccctgagattttcctgaaagcccttccggctagcccagttgggagtgttagtacatcagatcccatgctttggtgaaaaatgtaaacacagacctgatttttcattttaaatgaagccaagcatattgctcccagcagatgccgagtgactcaatctgtcctctcggttctgaagggaactgaagaacaacatggtaaaataaagcaaacagcacatttattggttgataaaatgctgttttagtctaccctggcattatatggtgattgctatgtggcgaacatctgttattaaatccagacttctgttgcctggatacattgagtcaaaagctggagcggatgagaaatccatttatgcgtctgttgcgtgtgaatgtcagagctcatatgatgcctttgtcttcattctaactgaatcttttaatatggaccgtctcacttgttaattctgactcaggggcaataatgttttcatttgattaaaaaaggttaaagaaacaaagaaacagtgttttctcaggtgctctaagtaattctgttaatgaattttcggagacagcgtgtgaatttgaaaagagtaggactttttaaagagttcatactatgaacccaataattcagatcctagggccttatcctaaggacataatagaaatgagcacatttataagaacaaagatgttcaatgaagtgttacttacaacagcaaaaaaacttgaaagtcacctaaatgtttgtaagtcaagagcttcattgatattgactgcaaagtccatgttattccatgtgacgaattttttaatcaatcacctcttgatggattttaaattttttacaattttttgctatcctaaaaaaaatgtgtcaatgaacaactttgaactaccctgactaccactttaggatagattgctagacgtggaattactaggacaaagcctatgttataatattcactcagtcaacaaacatgtcttgagtgcccactatgtggtaggcaggctttgctctaaacctcagaggccccgtggcagatgaaaggctctcaccttcacggagacaacagagtgagaaggggggaaagaaaactagaggaatctagtagacagtagcagatgctgaggagactgagaacagtggaaaggctacacacagggatctctgagtgccatggttcagagatcattgaatgaggtgagattcaaagagtctgagaaagtgcctgatagaagaggatggttggctctggagggacagaagtggagggtgggagtgggggaactggccttgcctgagtgtatccaaagagcaaatctttctcactgggctgactgacctcgagaacaggcctatggcccttgtgtttcttcactgccatcagaaagactgtgcacatgaggagatggaagggactctcaaaagagagaggggatcatcagggatgagatccgtggagaatcaccgcagagctggcagcgtttatctaagaatgtggcattgggaaaagtggtgcaggctacattccaggcgataaggaccaagcaatgaaataacaaataagtcatcttaaagttaaaggagatggacaatagacaaacaaatatgtttcaaaacatgataaatgctatggaagaaataaagagggttggagagagggttctacttagatagcctgatcagggagaatctctctgaaaagaggatgttttggctaacatatgaatataacatatgaatattgggaaagagacagtcatgaagagagattgggagcgtaagattccaggcagaaggaatagcaagagggagggccctgaggtgggaacaatcttgatatgcttgagggacagaaagaaagccatgactggagcatagggagttatctggaaaatggcaggagtaagtgtatcagtcagcaattgtcactgtaatgctgtgtaacaaaccatccaaacctcaatggcatagtagaggtagctgagtcaggactagaacccaggcatgattctcttcaaatttttctctttccatccatattcactaccttcctatgtacaatccactttctcttaaagtcacagcagcctcagaatgtattacatacataagaactagtcctacatctagatgtaatggctttcaaacctttatgagcataggaaacacctgttgagctggtttagaatatagcatttagggccttgcctccagatagtctgatttcacagaaacctgcattttaaaaaaatcaccccaaatagttatgatgaaggtgatctatgtacgacacttagagaatcagtgatggaaaattcaccaagaacagccacaggcaggccagaagaatggccctgcccctctacttttaggattaagcagaagctggccctagatctcaccagttaccagtgatcttgggcatttttagcatcatgtgcattgcttcactgtgataccatcttgctggcacagccatggaaagccatgagttaatgcatctccccatgtaacaaacctcccctaggactctggtccacacctatctctgctagattctctggcattgcaagaaattcttcagactgccccaagagattcgttccaatctaggggctccttatccccagctcagagctggatttggctcttgcttggaggcgggaagccctgctgggccagggcttagaggggctcacaagaaatcaaagcaagcattctccgcctctctcctacagccctgcatgcatcttctctgatcccttgcctgagtggggggtggcattccaaaagctcattactggcttacatactttgccttaaatcagctcttaaatgccctgggatgaacagccctaaataggaaagaaaaaaaaaaaacaagtttcttgcaagttcacagatatgcttggtgctttctgtcaggctagggtgtagccttctctgttctaaatttgattttctgagtctttaaggaaaaatggctactggtcccctggacgctgattgcttcagcatctgaatctgctccatcacttctacctccacccactggtccacgtccagtgggtagaggtaaaggggatggagatatcatttatcttcaaaggataaaactgctctgagagatctttgctttcttagaaacactgctggaaagttgtttctttagactacattaacagaagtaccatctctaggaagacaaggtggtaataactaacatcaaatgagcagttcctatgtaccctgtacatgtcttagccaacttcatccttgtaacaaacctggaaggcaggcactgttatcactcttattcccaggtgaaccagttgaggttccaagaagtcttttgtgcaaggtcatgcagagttgaggcccccaagtcggtagacttcaggagccagaccctcaaccccctcactgcctcccgcctcatgctgcactgagcagaccatacccggatggtcatgttcaggttggctatcaatgcagaccacgctgggcatattcaggggacggatactcagaactatataacataaggaatagaggaaggactggaggatgtattaacatgaagaaaaggtagactcatggcaggagatgagcagggtaaagaggtgcaagacataaaaagccaatttcatatacatgaagatttatcaagagccagaaggccctctatgggtccaagagttacaaggcctaatgaggtgaattaatgccagcatataaggaaaagcttttgaatactcagaagtgtccaaaaaggggtcaggctgccttggaaagtagtaagctctccatcagaggcttggcaacttcttattagggatggtatgagtatctcaagtacagatacagatgacccaaataaccactgaggcacttctgaccccaagtataagagattctattgtaacgcacaggagtccatctcaagcagcacactgagccatctccttgataaacctaaaggtaggtattattcctcccagatgctgtcttcttagcctgggatgcaaaagccataggatcacttcacgtccaacccccatcaggtgatctgtcatgaatcacaagttattggagccagatggaactacagagctaaaagatacatgaagacaccgaggcctgcagacagggactaactttccaaggtcacagagctaacaagtgtcagagtcaggctagacccaggactcacaagttgagctcacaattagttccacttcctacaccacctggatcatgagtgtcaagaatgaaggacctttggcagtcttctcatccagcagtgacaaacaggatgcacttcatgtgccagcttttaattcattggtcatggtttcctgaagtgctgttgtccagaaatattctgaggccatatctggatccagtggacatgagtgaatcatttatgatgtctgctttggacacaggtggggaagtgacaacctgtgtaccaagggtttggcagccttgagctaatccatcttaatgactttctgcacatgctgcctggaagtgatattaatattgcaaaagagattataatgtgtgataacgttgtagtacctcacttattaaaataattcaaggatccatctttgatggttaaacccactgtctatgtctgtttgtgttcctacaaaggagaacccaaggctgagtaatttgtaaagaagaggtttatttggctcacagttctacagactgtcaagaagcatggatccagtgtctgcatctggtgtggacctcaggctgcttccattcatggcagaaagtgaagaggagctggatgtgcagagatcacatggcaagaaaggaagcaagggagagggggagatgccaggctcttttaaacaaccagctcttgggggaactctcttaggactaatagagtgagaactcacttcttacctggacaatggcaccaaaccatttatggagaatccacccctgtgacccaaacacctcccatgaggccccacccccaacactgaggatcaaatttcaacagatgagatgaggaggatcaaatatccaaactatagcacccacctaacgaatgcaaaagatgtgcagtgaccttaagccccaacaatatagagcagatgacagttgatatgtagatagtttgaatgacagtttaaggtagcaggttggcaggtggctccaccatatacttgttgagtagtcctgagcaggtgtttctctgagatcctttggctggtctgtaaaatgagagataatgactctctcacaaggttgccatgagaaatagagaaaataccaagtactcagcatagcctaacatttagcagttgctcaataaatgataggaagtattggctttataatattgcatctacccccttctctctatgttagaacctttccaggcatttaaaaggtgagcagcaaaggccacccataaatgtgctgctagagagcacataggtcaccaatctcagactattggtctgaggcagatttttggagtctcttattcccgaagagatccagggacctgctttgcaggtgactgagaagaccaaggccaggagggaaggccaaaaagctccaagcagatcacttatctgtataacacttttcaccttccagtccttcttcatggagtttcccaaagtacacacccacagtcctacaaattggggaagagccagaggcaataaatgtgtgggagcagtcagctgagaactggatgttgaaggattgtacattttcttgaattacatgggagcaaactgcctcctgagcctgctgtacccaaatttatcaaagcacaaagcatttttaaagaccatttaataaactgattaaatgtatttgacaacggagctagaaagccagtcaattcatgtcttcatcactcctgagaagttgcctacacgataaaaatggaagttctctgaatctgtgggtgggagggctttcactctcctaatggaggagggaaaaccagggcatgctgggaggccgtcccagcccatcttcctgacatcgctgcttttcctgtactgtgctaagtgcagagaaggtccagcgccctgcctgtttttcacttgcattcttgtctccagactttctttctctccccacccttctcatgaccactagcatctaagtttatcgcttcctctctgttacctctgtatcctccaagtacatgatatacctctacagctcatctgccaatgctgcaaagtttacttatttataaccttcccagtgccttgtgtatattagatgcaggagtaagatgttgtgatcgagatcgtggtggtgatgatgatgatggggagggagaggaagaggagggggagaagattaggcaagaatgtaaaagccctcatgggtcttggaaatcacagcatctaagttctctccttcctctcccctccttcccctggtttagagatgctttagctagcctaagggcagaatagcctgcctcttcatttgttcttcaaaatccattgtttggggcacaaaatgatcttcagagtttaggctcttgaggctcaataaacttaaaatcttttctcagctttcctgttagatcacccacccccgaggcaatgaatgctgctgagctgatggaaaaagggcggtgagaaactccagaaatattttccggcagtgtttcttctttatctctgtcccccagtagctcagtgaggtaaagataatcatcagtttttaattttttatgttattattgtggctgcataacagttgtacatatttatggggttcatgtgatactttgataccagcatgtaatgtgtaatgatcacatcaggtcgttattttaacactgaggatatggatgctcagaatggacattggcctcactgaggtaatgcaggggtaaatggaggcactggatggggctggaacccccatctgtctgactcaactacctgaagatggaatatgggttgtgctaactaaattaatgagtagaggctgcctgaggcgctgccttgagaacagttctgaggctgcatctgaacttggtgagaaaagaagtgctgtgatctattagtaatgtctgccatgggcactggacctgggagcagccacgggagccatgccatgatccccagactccgtgcttcttagaaattctgattgttgtttgttcaatagataaatgaatgcagaaactgcttccttaatgtaggcttagagaaggggattggagtaggaagcaagagaggcagctcctgggcctgttcatggtgtgtcgggaggccaggctggacagtaagagataagaacggcaggggagattgagaccagaacttggaaaagcttacaatgccaaactaggaagcctgagggtcgtgaaaggtttgggctcagaggaataagtaagaaaagctgcatttaacaccaggaatctggcagggacacgtagagtcaaggagacagaaagaccagcttggagagtggttgagtctgcacgaggcgtggaggggtgcccagcccccggcagaggcaggtcacagtgacaaggacagaaagcctggagggacaactccggggacttagtggctggcagaggggactcttttccccagtgactcatatgctcctttttttctagctgaatttcagttttattttcagctccaatcagtggcaatagaggaatccgtgtgctttatttctcctgctccacattcctccccacagtctcccagaggctaacattctcccatcctccaaagagaagaaatccacagcccagagcagagcaggcctggtggcttcatgacagtcatcagtgtggccccatctactagtgctctccaagtccagcaatgtgttaaccctttacaggcattatcccatgtaacccctaacagccctaggaagtagacactactagtacctataattcacaggtaagaaaactgaggttcagaaaggcaaagtaactggttgagggtcacacagctaagaagtcgcaaagccagagtcgaaaatattcaaaaccaaaaagaaaaaaaagaaaaaaaaatctgagttgaaagcttgctctcttaacgatatagctctggcccaattaagctataaaatgtcacaggtagcagtgtccttagagaacacctaagctgagaactccctcatttttcagagggggggatctgagggtcagtgaggagatctgttttgtccagggtcatcagtgagttaggggatgagccgggacttgaaccctacagtggaagaaatgtgagccacagaacttaccatgttgcttgttgacttcctctggcacattccactgtattttccccgaagcctctccccagcctctcagccccactcctcgtggctccactccctattactcagaggtgttcagctccacccactagtctcccagcatggcagtttctgcccattacaggcctacaatacctgcgagcctgtcagccccctgcctcccacctctcaccccccgccccggaaatggttctgttgttaccggaccaatcagggcacccagcagcgtctagaacttggggctgataatggcatcgtgaatagaggaaattagagctgaatgcattcacagtgaatattcctcccagggcagacggggccattcgctgagtggcacatgacagatgttcacatggaacccagtcgcagggccaccttcactcctttcaccagcacggctgtctcccagccctggccgtgctttagagcactctgcatccccaaccctggccctccaagccctgcaggagccagtggttctgcatgtctcctctagtacctctcaagcacatggccttggccctgaagagcgtagtggttgatcgcacagcctttggggttagatgtatctgcttccaagtcccaaccttctgcctcactgctgggcaggccgggcaacatgcctgaatctcagtgcccccatctgtaaaatggggataattaatacccaccccacagtggtcatgtgaattcaatgtgattatgagtgtaaagagtttgtccccatgcctggtatacagcaggtgttcaataaacgatggctattatgatcatcgattgctctctgtcacctgtgtatcctccaaatgcatgactggcctctgcaattcatctgcctcaaagtttacttctttgtaaccttcccagtaccttgcatatattaggtgcaggattaaggtgttgtgattgagatgatggtgacgatgatgatgaagatgctgatggggatgcagaggagggggagaagattaggcaagaatgtaaaagccctcatgggtcttagaaatcacaagagggcaatttgttgcagcagaaattgaattacctttggagttatacagatgtgctgaaatttactgtcagcaacaggaaactcacacaccctgccgggtccatgccacattgttctgtgtggctggggaaagttacctcatctctctgagtctgggtctcagtccctcatcttctccagggctgttgttaggagtgaatgaagccatgctcacaaagtgcttagcacagtacttggcctagtgggtgttcgattcacagtggatattgctgttgctactcttgtcagtatatttctgatctccccaacttacagatcaccactccccttgagagcagagttgtacacttcattgtgtgtgcttctggagggcagggatggaacatccattcatttagtcaacaactgtggattgagcagtgtctctatgcctgccactgtgctcagctctgaccacacagcagtgaacagaatagatgagctctctctgtcctcatggagctcacagcccagtggggaagacagatatataggcaacaagtttttaattgcaagtaaaggtgccagccccaaaaaacaccaagtcacaggatacagaacaatgtgggatggaccgggcagggtgtatgagtttcctgttgctgctgtaacaaattatcacaaattcagtggcttaaaactaataaaaatgggccgggtgcagtggctcatgcctgtaatcccagcactttgagaggccaaggtaggcagatcacctgaggtcaggagttcaagactagcctggccaacatggtgaaaccctgtctctacaaaaatagaaaaattagccgggtgtgactgcaggcacctatagtcctagctactccaagaggctgaggtgggagaatggcttcaaaccatgaggtggaggttgcagtgagccgagattgtgccattgcactccagcctgggcaacagagcgagactctgtctcaaaaaaaaaaaaaaaaaaaaaaaaagctaatataaatgtattatcttgcagttctggaggtcagaagtccaaaatgagtcttatgggactcaaatcaaggtgttgtagtgctgtgttccttccgggggctccaggggaaagtgtttccttgcctgttacagcttctggaggccactcacattccttgtctcacggccccttcctccatgtcctaagcacatccctccaatctctgcttctgtcatcacatggccttcctctgaccctgagcctctgcctccttctgagaaagacccttgtgattacatcaggttcacctggataattcaggataatctcttcatctcaaaatccttaagttgatcacatctgcaaaatctctcttaccatgtaaggtaacatattcacagcttctggggattaggacatgcatccctagggaaccatgattcaacctagcatgggggaacccactacaggcaggtgttgtccttgccatcgccagctcagtgcttggcacagtagaggccatggatattcattcagagagagcatgcactgaggcaagcctgacctcaagatcaagacaggaaattggctttcatgggttaaggacctgttactttgctcatcaatgtatccttaatcatcagaggtcagatctgctggagagtgcaatctttcagtttccaaaagtaagactggatgccttagaacttaaagtcagggaggtacccaagaaagcaatcatagactgagtccccatgcagtgcactttctcggatggacaatttctctgttctgacagtcactgttgactccatttctcagatgagggaccgaggcacagagaggtgcagtcagtcacctgaggccacacagtcaggaagtggaaatccatggaaactcatcatcagctgcctcgcatcagggccagtgctctttatctccaccccacacattataaagccactcagctttacactcaagggaacttcctatttccctactggattatatgtataatttgtagtattgcaagatttgaacagaagcgagcagcagcttgtagttgtgtgtgtcactcactcctgcctgtggggatgccacgtgattgtttaaagggttggaatcaggagaaaggcaggctcagagcaggaccaagagagagcccacccctcgcctccccaaatccttcagcttcctgaagtgtggctgctgggtagcagctcccccagggaagaaaatataagatattcccaagggaccctggaagctttatcccaaggcttcacatgtgtaggctgtttcctgtgattcggtctggctgtcaatgatctaagattgagagccaaggtcagtgaggggggaaaagggacatgtagtgcaggggttcagcatccaggcctaggacttagactgaggctctttaccctcctctgtttcttgctgatggccttaggcaagtcgcttcccctctctgaccctcagtttttccctctgatgaaatgggtgtaataattgtgcctacctcttcagggttgctgtgggataaaatgagctcatacttacttcttttttttttttttttttttgagacagagtctcgctctgtagcccaggctggagtgcagtggcgcgatctcggctcactgcaagctccacctcctgggttcacaccattctcctgcctcagcctcccaagtagctgggactacaggtgctgccaccatacctggctaactttttttgtatttttagtagagacggggtttcaccatgttagccagtatggtctcgatctcctgacctcttgatccacccgcctcggcctcccaaagtgctgggattacaggcgtgaggcaccgcacccagccagcgagctcatactttcatgttagcattagcatagttcctgacaataagaaccaaatacgtggtatctgctattttctgttttaattaggtattcagagtctatgttaaattaattaacatatatacttatggaacacctactcagtgccaggtattgttgtagatgccaggagtacagcagggaataaaacaacatccctgtcctcgacacaaacacacaagtaaatagagaaggtcagagataaatgctgtgcaggaaaacaaagcaaagtgagggatggagagtgcggaaggttggggcacttttgtttcagatgagtgtcagggaagcccccttggaggaggcactgtaagggcacagactcgaatgaaaggagtatgtgaaggtgcttaaattgtttctgtttggtttggtgtggtgtgatgtggtgtggtgtggtgtggtgtggtgtggtgtggtgtggtgtggtgtggtgtggtgtgatgtgatgtggtgtgcggtgcggtgcggtgcggtgtggtgtggtatgggttgaggctggccttaggagcctgttggccttccaggccagtcctgaagcccagcccagagcaccagactctgcagtcagtcagtggagggcccacatctcagccaatgcatggctttgggtggtgacttcatctcccctagtgttcctttccccctctgcaaaatgggaatggggatggctcagaactcccagcgggagttaggaggaataatgtataggaagtatgagcagagtgcctggcctggagcatagcgcatggccgatcataggtaagtgctggtgttgattttattggacacaagtttggaaactcagagcctgcagggatggccttgaaggtaaagaagaggtagttgggagttttacacttcccaggacctaccctcagagagacaggggtcattccagagtatctggatacccagtttgggccaaagatacttccagccagggcactcgtcaaccaccttgatatttgcccaacacagctcctctgaggagagcttgaggtctgggggccccatgctgctgattaaactgatggctgggaggcaggtaaagcaagagtggagaagtgagtctggaggtggaaatgagatctccaaggaggggatggctgactgaggctgacacgtttctatccaaccggtagaggatttgcagttggactctgctttatggcttggtgatggtcagtgttggggcaggcactaggtcagagggtgatgggaggggtgagggaggttccagtctcacgctaggctgcctgcaccttcagcctcagctacctcaccacctaactggggaggattaactataactctgaccattcctgggactgtctccatttcaaacaatcagatcccctgccagactgtattagtcagagcagtgcaaatgctgtaacaaacagccccaagtgtctgtggctgaaaccatgacagtttacttctcgttgccatggcagccagtgcagctcagagtggatgggcatgtctgcatctgcatgcatgcaggctccttccatcctgaagctccccatcctcgcccttacactgctggctgggaaagggagcctggaggaagcctcaggtttgtatggggcaggcctggaagtgaggtgcaccacctccactcctatcccctgggccagaacttgggcatctgaccacacagacttcccttggaaggagaagagaacaaggacactgtgcacctttgtcaagccaaccaccatgcccatggagcatctactatgtgcagagatgtcagctcctccagacaatgttctctgtcattttccatctgttcaagctgagtcagaggtgtgtacatgtgcaaatgcgaacaatccaggctcacttcctgcttccctgagtcctaggctaacctctagcacagcacagatcacaagagtgatgactgcctgaccgtgtgtccttcctcccagtagagtttgagccacatggaggcaggggccacagcctgtattctcaggacttggacagcggtggaagctctacttagcttgctgaagaggaaaggggaaagaaaggagagtgaattggcacttgtcgagatctcccagttcgttttttaaaaattgtggtaaaatatatgtaacagaaaatttaccatcttaaccattttggagtgcgcagttcagtaccaccaagtaccttcacgttgttggacaaacttcaccaccatctgtctctagaatgttcttcatcttgcaaaaccaaaactctgtacccattaaacgactccccattccctcttcccccagctcctagcaactaccattctattttctatctctacaaatttgactactctaggtacctcgtataattggaatcaacagtatttgtaccctggcttatttcatttagcataatgtcctcagactttattcatgttgttgcatgtgtcagaatttccttcctttgtaaagctgaataatttttcattataagtatataccacactttgtttatccattcacttgtcgatggaaatttgggttgcatccacctttttttgctattgtgcataatgctgctatacacatggctgtgcaaatatctaatattagtccctgctttcagttcttttggatatgtatccagaagcagaattcttggatcatatggtaatcctatttttaattcttttaggaactgccatattgttttccacagcagctgcagcattttacattcctaccagcagtgcacaagagttccaatttctccatatcctcaccaacacttgttattttctgttgctgctgtttgtttttttattaatagtcatcctaatgggtgtgaagttgtttctcattgtggtttgctttgcaggttttgatttgtagattttcctgatgattagtgatgggtgcatcttttcatgttcttactgaccttttatatatctttcttggagaaatgtctgttaactctactcatacttttgtaaatagtattcccaatccttctaactccccaatgaggtggatattagtatgttcgtgttacagtaaagccaactaaaccttagaaagactaggttaattatccaaggtcacacagctagaaaatgacacagcttgtattgaaacatcagtttttctctttccaaacctaacgcacatttcatgaaacctacattattgcaccataacatcatgttgatttacttatctgctctcctgcctgtcccatctactacataaattgagtgtggtttgaaatcagagactacttctcatctttggcacagtggcagccatggatcagaatctcttacatgctggataagtggatgcaagctcaaggccacacctaaagtccccaggtgacttgatcacttgagttagctgctggaaacctgggcttcctcttctgcaaaatggggagagaaaataaattctcagtggattgtttagaagatttgagcaaagacctctgcaaagtgctaagcatgtggctagcatgtggcaggtgctgcctaaatagtagaaattaacactgccatgcttataagctccggacaaacacaagaagcccgaaacataatctgtgccttctgcttgcattcctcctagttggggatgtaaaatagcccagctacaatcaaagaagaaaatcaaagtcagcacagactatggatatgcttctatatgtgtagattatttccagactcattcggaagaatctggacatactggttgcctcagaggtcaagaaaattggctcatttacttctgtaacttaatttcgactctctatgcttttacatagttggaatttgccatgcacatatactacatttaaaagagcgtgtacgcgagaataatgtggtcaggtggcctgatccacaggtgggtgggagagacaacagagacagtcttctgaccccatctggcttctacctgccaaccccatgtattctggagactctccacacctcctggcatgaagcagaatccctctcagggggtcacctcacctccttccagaaatgtttaacagaaagaacctaccattggctttctccatccccagcacctaatagagatatcacggagaggggagcatttgtaatttactttggaggggtgtgtggaggccgagtaacaccgccttccatctcagtgacaacaaactcattcttcactataattaaaatgtcactttgataaataattccatcagcccccttccacctatgaatagcttcttgctataattgttcacattctgctgaattagaagtattcaagggagaatttaagaggtatttaggcaacaaagataaatcgggtgtgttttccaccctcccacaatccctcattaagcgagacatcatccccggctgggcagggcggggctggggggcctcatccctgtgttctcagtcactctctccctgagtggagggagccggaggggttgccacagcagcgtggacctcaggaaggggctggagtttggggatacatgtttgggggccttcccttcccagctattactgtagaaaaagaagaggatgcctgaggtggtgggaagaacgtaggctctagcttcaggtgagcttggaaaagtcagtgaacatttatggacctctgttgtataacagaatacaagatataattcttcattcaatcttgtgtcaagagcttgagtcaagatataattcttggaagagacatctgacattgagggtcccccctcccatgttatgggactcaagtcttccaaaggatgactttccctaggagacacagctagagattggcaaccccaggacctttgaatattcaacaatacccagtagggtatgaagcaccgtaggagttccgtgactattcccatcttccctcatttttgttggtacctcttccttcctgataaatcacatctgctgggaataatccaataataggatgcacagagccagccacagtgtgttggacacctcaggaagtgtcccatcttgggtatgtctgtcctcaccttgggtagaaagagatggtatttgactctttccccaccagaagaggggtatggccatgtggttacaagagcagcacttcatagtatgaaagccagggttccaagacaactactcccagtgtggggctggcatgttagtgactctaactacagtttctttttttttattattgtttgagacagagtctcgctctgccacccaggctggagtgcagtggcacagtctcggctcactgcaacatccgcctcccaggttcaagcaattctcctgcctcagcctcctgagtagctgggattacagctgcccaccaccacacccaactagtttttgtatttttagtagagatgggttttcaccatgttggccaggctgctcttgatctcctgacctcaggtgatccaccccactctgcctcccaaagtgctgggattacaggcatgagccactgcacccagcctaactacagtttctttatctgtaaattggaaataacaatagtcccactgatgagttatggaaagtagggccttccacggtgtctgcatgtggcaaacattacccatagctcctgttgggtttctcgtgaggagtgtaacagtttggccatgcagttttaaatgccacatgagcggctaggtgggagggagtaccgggccaatccaactcagtcaacacaggtcccccacaccatttcctctgtggcaggtataagagtcaaggcccacttcaaggccaccaaagtccaagcatctccccagtcctagcttccccagagagtcctgaatgacaggtattcattggttgtgatggggcttgtctggggttggggactgggggtgaggagtggggtggggtttaaaaatggagggcagcggtaccagtgaaggggaagcagtgataaaacccatttgagtttctgctctgaagcagagtccattaggatgacggctccttggaccagggagctgcgtctgaggggctgtgcccagttccatcagtggtgggattgggagtggtccatgaaaataactcacatgcatgtgtggctggctgaagaagcagagaagcctgcatgggcagccaatccccatgctgagcgctttgcttggaatggctctgataaagaagcccatgatgctggaaggaagggctccctgcaggaccctctgggatgattccctgcccatctccaggaccaccctccagaatatggtctaggatggccttgagtgcgtaggtttcagaatgtgggaagaaggggcaaggagaaaaaaacaagcacctattgatcacctgtgttagctcattcaatctttctaacatctctgcaggttaaatattctatcccattttacagagggcaagctaaaactgagagatctaagatgattttgccaaggttacactgctagcaaatggttagatttgaacccaagactctaactccaaagagccaagctctttacagtggatcagtccatcatctctttacattttacaagtttgtgtcatggttttagacaatatgtttgacatgcaagacgctctgctaaccttaatgaaggtgtgcatgtgagatgcatgtgggagtcagtgtctcgggtggtgagcttcatccagactcatttcaaactagcttgcacagcagagcttccagcaatgcaaatgccaggttactcgaggctccctctaagatgcagggactcaaaaagttgtttctgaagctccagggcctttataacggggcttcgaaagcagcagaaagaaacagcacacaaagtgtttgtttattctcttgtattcaagaaagagccaataattcaaacaactaattctagaagaatagaattcccccagtccccaccttaatacaggcaggctcacctgtccattggtaagtcagcacatttctctgtgaacactgatgccctgtgcccatcacacccatagtatcaactgtcaggacagctgccagatgaaagtgctgtcatcatgggcagctgcctcttggaccaggagctaagggagaaactccttccttagagacccacgccagactgcagtgttgtttgagagacctgagtctctcagggatgtgttctggagatctgcgagcaggactgtatccatgaatcaggactctgtcttaagccacagtagggaagaggaatggcacaatagaggaaacaccaccccacgtagcatggagccatggagagagcatgagtttagaagccaggagcgccagctctgccagctactggccaaaccactgggggccagtgcctcggccatctgtgaacagacactgctggataatgatctcaaagctctcatcctgtctaacaccatccagtttgagacctgcttaatcagtggggttctgggaggccagagctggagctatgatcagggctaaaatgcatacagaaagcacagatgctagaagccaaatggaggttgtccagggggtccccaaccatgggactggaagcagatgtcaaaatcaaggatcagagcttctgggaagcagacacagcaagggaacatgagtagtgtgagctcacgctgagtgagcactggctgtgcaccagtattgaataggtattaactcccttcagctgcacaattatgctgtaggtgagttttaccttgggaaaccaaggcacagaatttaagtaacatattgaagctcatgcagctgctaacagggaaggccagggtctgaacccagctgatccggctccagcatccgagctctgaaccactggtctatcctgcctctgttaggacttggtccaatgtcatcatcctagaaggaacatttaggcccgcacggtgggtggctggttcaatccagtttaaaggccaggagcaggacagtgacttgcagctgcagcaatcctatgactcaaaccaaagcagctgtgacaaataaagggactgactctcattctcccgtgctagggaaggatgagctatcaggccttgttgcaggctgagtcagtcatcccacaaaccacctaagtgaaacctcttcactgagccttatttcctgagcgctctccctttatctgtgcttgcaaagaggcgtctccctccatgccagccaacccacccacccccgcacacacataccacctctggctggaactgacgaccatgggttttagaaatgagataaatctgggagatgaatgtattcatgagcccataaaggggtcatgaatcactggccccaattactgccttcaatcctgacaggatgaattccctcaagcagattctccttgtcagacaacacgggaggcagtgtcatggctgatctagagccacagataacatcattattccataccaggctggtttcggtttcccaagccacctccacttgatttacagctcacttctgatgctggagagagagataaatatatatatatatatatatatatatatatatatatatatatatatgaaagaaagaaagaaaagagagagagagaaagacacaaaggggaagctttcatgccaagtggaaacaagacaaaataaatgcaccgaatccgatttcaaaagctgtttgaaaactctgtccggaattgctggaaagggccccagcatccacaggaaatgtatccctgccaagccctgtgctactgaactctgtggcccccactcctgcctcccggtgacttgtttagaactacttcagatcggaacaaatcacagccaactgcagtcgctgtctctagcccttcaatcactcctaatcagaccgtgtattttagcaacagaatcttccctggctgaggagctcattcatctgccttccaccagctcgacaccctttgaatgggagatgaggggaagccacctgcttctctggcagccaagggaagctgggaggaggcaggaattgccagccctccctctctgatagatcaccagtgggagtccagaccagcaggaaccaggaaaggaggtggcaggtcagagagaaggcactgaaaagggtcatctgagtccatgtttggtgaatgcccaccttgagctggacacctggctgtggtccctggagttggatagcctgggttcaaattctttaactaccattttctggccaacccattctctgtgtgccccggacaaggtacctaccctgtgagtatagaagcaaacccccagaaaaaagcaagtggaaaaagcaaagaaccaggacatgggtggactcgagtcctagagaggctcaggaaacttttatccaaagacacagaggagctggttgcagaggagagcttaaactcacacagagaggggaggcctgggaggtgtcaacaagttatcttctcacttcagaagggccctctcgagaacagggatttcccctgctctgcaagggaccagtggacagaagtcagcagaggccatgtaggggcaggagcttcctgtcatcatagatgccaaagctgaagcaggatactgaatgcaaacaggccctgaggccatctgatgtgctcgttcccatagccccgctgtgtgtgtgtgcgcgtgtgtgtgtgtgtgtgtgtgtgtgtgtgtgtgtgtgtttggtggggtgggaggggaggcagaagaggaagagagggcagagagccaaagactgaggccccggcccataagtaaggcagtttgcagatctcaatatcctgtgcagacccacaggctgccgtggggttgagggctgctggtgtcttaaccagaggcagagactggaaggagcaccagatagaactgactcactcctccttcctctaccacatttcttctctgaaaatttgccattaatcacaggtgacgatggaatcagcaattaacatgagctaaaacaaactactaggcatacagtagcgctcaataagtgctagctattatgattacaatggagggaaaagttgtcaccgcagcacaccgtgcatccctttttggtctggggcctctcatccagacacaggtaagaagactcctcactccccgaggaatcgcgtgcaatgtcatgatggcatctgatttagttttcccacatctcaaatgagatcagggcaactagtcttactcaacccttcagacttacataccctgtgtatcaaggaatgagtctcccatcattggagacaatcaagtagagcctttctggtggaggagaaggaagtagacaagtggagctcagaggtgccctcccaccccgagattccatgatgctcaggactgtggaatgagcacgggagtgtgatggacctaggggtggggaagagcgagaagttcccgtgcaatggacctaggggtggggaagagcgagaagtcagaacactggcagaagaggaagaaaccagacaacctggaagccaagcagatgagtttcacctgcatatcctctcctcttcccccttcctccagcgttgacttatgggaggtatttcagtgaggacaaaagaggacttagtcaaacaagcacttattgaaagaaaatatattctacacagcacttccgtccttttaaagtgattcactccctttccactgcctattctgtttaggagaaaagtggagcttcttagcttggtgcccaaggtcctcatcaatcctaagatgacatttattgagagcacatgatgtgccaggcattgttacaggcaccagctcattcaagccatataaagacaaccctgtggtgtaggttctctcagggtcaccccttcagatgaagaaactgaagcccagaaaggtcaattaacttgctcagggccacacagctagttagtagtagagctgggacctgaactcaggtaactggtccttacgctactgttcttaatcccgtacttaagtcgaccagccctgccctgccttggctccagcctcaccttaagtttctcaccacctggagtttttggccaatgccacacggaatgaccagcatttctctgaacacatcatgctgtatttagcgtccaggctttagcacagctgttccctgtgcctggaattctcttccttttttgtttttttctcacccaaaaccagcttgtcctttaagatccagcttaatgttctcctactcttgggagccttttttggtgcccccaaccccatcaggccacgtagcacctggtagcaccaggtagcaccccatcctctgtgtgcccacgcctacctcctctctacctcacccaccctggacagaccctcacaccacacttctcacattacattgaaactgatgactgccttgtcatcttctccctggagcatgtcattcatggctgtctcctaagggcctagcttggtccctgcattcagtaggcaggtactatttgcaggggcaggacagcaaatggttagagcttaagctctgcatccaaaagggcctggattcagatctccactcagccatgtgttagctgtgcgaccctgggcaagctagcccgctgctcctcacactccacggtcgctgtgaggtgtaatgagatcgcacatataaattgattagtgcagggtctggaatgcagcaagcagatggccaatgaatgtttggcaacactgcacttcagaatcgggctctacctagacagacttcatatcaaattccagctctcccacttaccagctgtgtgaccttgaacaagtcacttagcctctctgagtttaattcctcctctataaaatgggcttcatatttttaaaatggcaaagattctaaagattacaaacacaacacctgcgtcgcttccctctgtgtacagagcagcgttgttgcagtttgcgcgctaaggctgtagactgggctgcagtgccttttaaatacaccagctcctggtttggagctaatgggacacatgccggggacggctgggagtcacagcggtgtagaggagaatatggcttcaagaaaatgacatttggaagtaattatgggagcaatggatcggaaccacagtcagctgccagctatccccagagacatcacaggagaaggaggcagaagctggaacatcatccgggagctggactagaacgtcccgggaaacttcagcctggcttctgctttgtcccgaaaacccagggctccagctccagggctctgtcttagaatgaggcagtttatctgttcagggcttctcttagtttttaatcccaataggacacatgttgtattaaaaagccatgcgagacggaagaaggaaattgaatgaaatttgagggcaggtaggagcagagacaataaataattcagcagtgaaggaagcagaaaaaagattgcactcatttcgcccttcaacaattatactaaacacctgctctgggccacagaagggccagatcccattcctgtgctcaggaagcccacaggccggcagggagaggctggttggaatgtgtgctttgcactgtaacggaggcatcgagcatggtaagggactggcggtggctgctgcctgcggacgtcgagcaggggcctttgaagaggcaggacctgtctggagtcttacctgggccttggccctggcaatggggaatggagcaggcagcaggggacagatgctgccagaaaccgagatggtgccggaggactgggctgagtctgggtcaaatgacaccgccccaggctctctgccctctggggtgaggcaggaggctgcctctgtgtgtgattcagagaccctagaatcccagtggccatcaccccacagcacatgccaacctttctgtgataactttctcttgtggaactgtgaaagtgtaagaccagctcctgtatagtgcatggccatcctttgctttggggacagtaagtcagtcaacacatacttataaatggggtcctgggccgtggcactgatctggtcctcccaccttgcctcacactgcccttcccactcaccacttccctcctctgcatcttagccgcaagggactttcagaccaagcagacctggaatcaaatcccaccgctgggcctcaatgccagtggagacaggaacagctgatccctggagccctcaggaggaagaggacgggatgcctggcttggctgctggtctggggcaggtgcccagttacagcagttggaaaaatcctcagtgttggaaggaaatttggaagtgagcatctacctgcctgccgtgcagtttgtgacttttaagatggttgacagaacattcccaaaggaccacagcggtgaccactgttctcgtttccctttggtggctcactcactcagtgctggacacagtggtcctgacaagacagtgctgtggcttccatgaacctaggacagggatagactcaaggactaagaacaaaccaggaagaagcatcaccacaggctccttgccagtcacctcatctcaccctcctggccctggcggatgggtctccatatttacaggggccagatgaaaaaaccagaggagccaggaaaaggagcttccccttcccaagggcgcaaggtgaggtgccagtcatgagatgcaagccctgagctttctgattccactgcatgtggtcccaaggttcggcgccgcatcacacagttagtgagcacactctcctcccctggccccgagtgagccagctggatggcagatcagaaagagaagtcccgggtgcccccaacatggctagctccttccaggaccaggggctaggccccagctaaggctggtgcacacagcagggcagggggcgaaggagtgggatcccacccagggatcccacccaccccaaacctgctttcggacatctttccaatgcataatgtgcagatgaggccctttgataaggaccaaatccctttccgttgcttggcaacctggctcacaagtcatagcagggaagtaatttacaggaattcaaagtgtcgctggaggttctgctgagctgaattgctgcaaagaggaacctcaatggtccaaatcacacctctggcggggaggaggggctgaaggaaaagcttccacttccgtcacttgagagtacagagccctgagctcagactcagcgatcgttttccattaacggatttactggttccatgttgagctcctgctgtgtggcaggccctgtgctgggagccagggacacagtgacaaacgagacagatgccaaccccggatgcacagagctcaaagagacagaggagtaaacagggctacacatgtgacaagataggctgtgcacaggggtctgagcaggacccttggggcaggaggaggcagtggagggatgggagggtagggacgcagtggtgaccagctagccagatagagaacagagggtgtcccagcacagggccacacaagcaaaggcagaggtggggagagaagagcctgccacactctcagatcaccatgtggttgggccagggccccagctgaggctgaggacacatggagcccagatccggcagggccttgaatgccaagtcagaaagcatctgaaatttagtctacagatgatgtgggttattgacagccaggacagggaatgacatttgtgtttcaggaaaaccactgtcttcactgttagggggtagattcagggagaaacaggaggtggaggggaagaaactgtgagtaaaggagtctctggggtacaggtgaagtttctgtgaaactggagaagaaaactgttgaggcaagagttgacaaaacttgaagtaggatggagaggaagggacaagttcccctggcatggtgacggcccggtggtgggaaccagggaagaggaggggctttgcaggtgtctgacttgcccaacaggtggcgccatttaccaagatgggaagggccggggagaagggagggttccattctagggaaatctcaggtcctcgctattaggattctttcggttgccagtgactgaaacccagctgaaatggacttgggaacatactggttcatgacatctggtggaggtgaggtcagggtgcactggagccctggcagcccactctgatgccagagcccatggggacagcggtgtatgttggacacagtagtccttcaagggcggggatcggaggaacagaagaaaggaacagcagatgccccactgaggctgagcagaacatttaggatccttggccccatctcattgtgccctttgctgtggctcatctcacacttgcagggagaagccaatggatctctgtgaatggcgaggctttgtatgcataaatgtgggccattttgtccccaagaatccctgggggtgaggaagccacagaaaattgaggtcctattccctgctcactcctggtatgtagtggaagctggagagcctttgtccaggcactgacagcaggaggtttcatgcagagctgctcagggcatttcccagatctgtcccacccctgggaactggctcagtggccttgccccaccagaagactgggaactgcacccaagacaggttcagcccccccaggagaggacctgctggtgtgcgtgtccacacacagcacagaagcaaggaagatctggcaaacaaccttcaacaaaaaagaggccatttgcactggccacctgtgctgcttctttcctgagcagacttggttctgagccagggggtctccctctttccctcctccagctcaggaaaggactcaggcacatgtccacccaacctgcaggagagtgtggcacagcagtgaaaggcctgggcttcgcaggccaacttgggtttgatttttggctctgtgtcacaggcctcatgagatgtgctcacctcttagctccctcatttcagaatggggatgagaatctgccatgcccctgcccaccagccacctgcccaccctcccttatcatgtgccccgacctcccatgggtgctgctcatctgagtccctctgtcctcactatgacggctggtctgggaacccctctggccctactctgcttcaagaccatttagcctctgctcctgcttccttattttcttgctatttcccagctgcaatttctttgcaagacagggaaaggattggatatactcagcccatcttaatttttttactgtgggaaaatacacataacataaaatgtactattttaaccattttaaaggatgcaattcagtggcattaattacattcacaacggcatgcagccatcaccactatctggttccagaactttctcatcacctcagatggaagccccgtattcactaagaagccactccccattcccacctcccccaactcctggcaaccaccaatctgctttctgtttctgtggatttgcctattctggatatttcatttaaaggcatcgtgcaatatgtggccttttgtgcctggcttctttctctcagcaccatgttttagggtctatctacgttgtagcatgggtcagtacttcaaccctgttcttttttttttttttttttttttgagatggagtatccctctgttgctcaggctgaagtgcagtggcacgacctcagctccctgtaacctctgccccctgggttcaagtcattctcctgcctcagcctcccatgtagctgggattacaggcacgtaccaccacacctggctaagttttgtatttttagtagcgacggggttttgccatgttggccaggctggttttgaactcctgacctcaggtgatctgcccacctcggcctctcaaagtggtgggattacaggcgtgagccaccacgcctggccacttcatccctttttatggctgagtaacattccattgtgtggatataccacacggttttgtttattcatcagttgatgaacctttggattgtctcacattttgaccattgtgaatcatgctgctataaatattcatgtacaagtttttatttgaacacttgtctctaattctttggggtatatacccaggagtggaatcgttggctcatatggtaactctgtgtttaacttattgagaaactgcccaacagttttccataacagctgcaccattgtacgatccctcaagcaaggtgcaagggtatcagtttccccacatcctcatcaatgttcttgtttttatggtccttccagtgggtgtgaggctctttttactttttaatcaccaggcagagatctctcaaccaactataaaatgattaaatgactgatagcctttgtgatcaatcagactggctggagaacaggaagatgagaggagcctggagtccctgacccagaaggtggccatctcaaatgttttttccatcttccagggctgtggactgggcagtttgggacccgggaggggcaggccgtgagacctgtctagtgcacatgtgcgacctcatccgatcctcatagtaacacttactaaaattcttaaccattaccccaccagtctatgtccacacggccacgctcacagccgtccctgcagtgtcccaggcccactctcacttgttctttgcagaacctcatgatgaatgcagcatccactgtttccttcttctgctgctctggttcccctccaccgaagcactactttgtccaagaaactgctccttcccaccaggcagcgccctaggctggggccaaactagccagtatcaaccacaggcttctgtcccctggcctgagatcagattcttagctgcacagctgcccctgagagttcctttccccaggatgtgttctcaagcgggcaatgcctcaagcctcctgttgaggctagaggaaggaccacctcctgttcaccagcatgcacagactagacaggacggctccgtctgtcgcgcttctgttggtctctcatgcccaagggtgtggctctgggatcagcctgccctggttcggatctacttaattgtcactgtcactttcagctcgttatttagcctccagtgcttccattttctcaggggtgtagtgggatgatgaaaacaattcccgtttcgtagagtagtgatgaagagtaaatgagctaatcccagtaaaaagctttaactcctgagccacagtaagtgctcagtttatctaagcatcattatcaaacataaacaatcatttacagagtgatgaccaccgtatgctccaaacccagggctgggggcctttcctacttctacagtgacccttagaggtgagcagtctagcccccactttagggataatgtgacgaggtgctgagaggtcatgatctcccagcagtgagtgacagagcctgaggtgaaccccaaatctgtctgactctaaagttcatgctcattccaatcatggcaaagaaaatgcagtgtcttctcacgaagggttcatccctgcctcctcagtggctgtttcaaggagggccctttggtttgcccagatagactattcacactgaaagtgacaatggagaaactggccaggacactccaaggtcacagagaggtttgtggaggtgagatgagggtctcagccggcggggagggattccggagggcagcgatccctaaggtggagccttccagccacaggatgtgtgacgagaaagttttccctcttctcccctcacagcccgcaacaaaatctacatggcttgccaatattcttggagaatgaatttggggggctgtatttgtttcccatgactgctacaacaaattaccacaaactgagtgggtttaaaacaatagacatttattctctcactgccctgaaggctagaaggtccagatcaaggagtgaggacagaagaaggtaggcactagaacttgacccagaagcctgtgacacacacacaccccacatccttctccagccccccattatctgtctcctaggaacaaggacaccactacattcattccagaaaagaccccttttgtctgccagccatcctcagagccgaaaagcaaacctttgctgctgagagctgctgatagaagagcaggaagcacagttaaaggggaacaggctcccaactctggggcagcagatcttttgggcttcatgtcatagtattgtaaagacaattgccaaagtcagacaagatcagttgtgtgatcttggcaattcactttgtttctctgagcctcagtttactcacccataaaatggggagaaccacgtctacctgactgactcgtgatgaagatgaaattaacacaaagacaaggctgggcgcagtggctcacgccagtaatcccagcactttgggaggccgaggcatgtggatcatctgaggtcaggagtttgagaccagcctggccaacatggtaaaaccccgtctctactaaaaatacaaaaattggccaggtgtggtgatgggcaccagtaatcccagcgactcgggaggctgaggtaggagaatcgcttgaacccgggaggcagaggttgcagtgagctgagatgcactccagcctgggcgacagggtgaaactgtctcaaaaaaaaaaaaaaattaatgcaaagacaaaattagtgtgggaaaaccctttgctcagagaaatgatggccacaaagtcatattactccccccttactctgtaaaatctcctttgctagaggaagagttaaaagtccaagtgggaagcacagtcccgggcggaggcagggaaggctatcctggctctgagtcgggctctgtctacctggattttgtgcctccacgttccctttcatcactctccaacagggagatgtctgtctcccctcagtgtgatagtaatataatggggcctcctggtgctcctcagaatcacgtgctctgggcaggaaaaaggtgcaattctcctgcagaatgtacacagcaaagactggaaacgagaaaactgtcttccccagggtggcttcctaacaaatataatgagaaggcgcttcctctcttcctttcagtcacatggggaggtcaacagagagcaatgactgtcctgaggctatttatttattttttgcctgataataattataataatcacttgcatttattgagttgtctgtgtcaggcaccgggctaggcacttcactgcatgagttatcgcaagcaatctttccaaagggattaggaagcaggagttattttacagatgaggaaactcatgcatagagaggttgagtgtgacgctcatgttagcctaacatgaggatccaagagcttatccatttactcagactttttgattattttttgtgcaatttcacagacttttggtgatgcataaaatttttttagagtactagtttgggcctggcatggcagctcactcctgtaatctcagcactttgggaggctaaagcagcagaatcacttgaggccaggagttcaagaccagcctgggcaacatagcgagacctcactaaaaataaaacaaaaaataaaaataatacaaaaaattagccaagcatggtggcacactcctgtagtcccaactacttgggagactgaggcaggaagatgtcttaagcccagaaattcgaggttgcagtgagctataatcacaccactgcactccagcctggatgacagaacaagatcctgtctctaaaaacaaacaaacaaataaacaaatactactttgctcattcatttaagtcagtaaattgtgacaaatggaaaaatgcaagaaaaaaaaggaagctggacataaagctagaatggaaaatgcatgagctcttgctggggtgggtcctaatttggcttttagcttcctagcagcccttgcaaagaagaaaacaagatctgttaggtaaatctctatagcagtggttcccaagacatggtctcctgaccagcagtatcagcactacctgggaacctgttagattgtccctctccaccctcgaatctgggagtcaggcccaggcatctggtttaacgagccccctaggtgatgatgatacatgctgaggagtacgaaccacttatgttagaataaatacacaccagcttctaacattgatatcgcagagaaatttctgcatgacacagtgagctattatattgaccaaatccccattataaacaccatcatgtacttaataggcctttttcttaacttcctacttagcatacactcatgaaaccttctcaaggcacagcttaatgaaattagttccagaggcaccaagctatgtcacccagacacacagcatgatgggctggtttcatgctcatgcacacttctgagtagtgaaagcctggagaatatcccagcattgctgttagaagccaggactctggagccaggctgacccaaatttgaatcttaggtgcacctttcattaactgagtgaccttggccaattcccttaattccctccctctgcctcagtttcttcatgtataagaggaaaatgactattttatgtattccatggagttgctgtaaaaattcaatgggctaacagaccgtatgcttagtatggtgcttagtatgctaatgagtccttataaatgttcccacgattatgaactgctagagtgtgtttcctgtaggtaaacctccaagccatcaaacctatgtccatgtctcctgccaccatctgtcctggatgattattgttcagatgcatattccaaacttactgagtacctagtatgtgcggggttctttcacttatatcatttgcctttaaacagctctgcactgtagttattattacccattttctgcatcaggaaactgagttccccccaaaatgaactgacttttcaaaagtcacacaggtattaagtgccaaagccaggatttgattccaggccttctggcttgacagtggcactcaaattcatcaagtgtttcttgaggatcttgcagatattttctcatattgcaattctagtctctgattttttagccccagctgggcaggaaggaagcaggtgcatcagtttttagaactagagcaggacagatgcttagaatgtatctggttcaagcccctagtttatagctgtgagagtccaggctacaagagggacttggcttgccctggacccaaagagctaagcagaacaaatactcacatttggtgctgctcatttctctcccctgggccccacagcatcttcgaaaggtgaggtcaattcccatgaaaagtaccacactacgaagtgcagccaaggtccagaggggtatggcagagagcttagggttaattgattagagcaggaaaaggtcagaagatgtggaatcatccacatagcccttgcaaggaggtatcacatacatccactcagggtcgaagacacagacagcatgtgtctctctagccttccctctctcctggagtccatagccttggctgcctgccaggaacccggcacacccacctcccaacacctcccaagcccactccaccttcctcaaagggtaacctcttcctgacctaatcgttttcagaggaaagagcaggaactttggagtcaggcctggtttcctaatcatcatattggtcaaagcaagtcacacagccaagcccacaggcagtggggctgggaaggacagagagagaagggagaatcgctactgaatgacagtctaccacacctattgtgcaaagtgctggaagggaggatttgttcattcattctgttaatatatattaactgaacacgagccaggcactggcctaggtgctgaatatgcagcagtgaatgaaatagacagaagtacttttcctcctggagttcatgttcaagtgaataatggccccacacctcgattaatccacaagcacttaactgtctaccctgtcaggtttccatatgtgccagacacatcatgtccacaagagattctctgcaaccagcgagctcatggcccacggggaaaccagacagacagacacccaatgacaacattgaaggcttgcacgcacgaggggccagaaaacaccccacatggagtgggtcccactctaggccactctcccatcccttcccttttccaaatttcctccctagccacatgccttggtttccagggccagccagctgtgcaaaatgcctagcaagctctcagcaggcccctgctgggcacagcacagagaaattaagtgcaattagcgtaactaagccatcaccagtaagaggcacttgctctcctggcggctccctttcggagactaatggggatgactagagaggaggatccagagcctatggctgaaacctcatcaacagcttgggagagtgacagccagccagtcttctgcccgcaggctgaagaggcagtgcttcccagggtgagccagaggtcaggaatcagaaggcctccccagagctcgctcccattttcctgagtctaggaagatggagtaaattggtttaatggagtggagtcccgttgtcatggtggcaggaggagaacagacggatcgccctgctccagcctgacaatgtgaggctgggcttttagcaaatgtggccggctgtaattcagagaactcaatttgacccatgctgtatcttctttcagataatggccgtgtgtcctgcccttcccccaagtggggcaggctagaaacctctagtggactcctcaccccctcccaagacccagtcaatctatagggcccgctggttccttcccccaggtctctcctctctccctggattgtggcaatagcctcctgaaggttcctctgcgccccagggctaagtcctggtcccatccgctcttcacatacacacacccagcatagcacatttttctagaactcacacctgaacgtgcctctcctctgttgaagacatccccagaagctgatccctttgttcccaatgcccttccaccctgtctccacctggcatatgcctgtgtttccctgaaattccagcttaaatctctctccatgtttggccttctctgcctcttgctggattcctcatctcgcctcccaccggttttgcatggatccctgccactacctgtgtgtgtccatcgctccatccattgagcctgtgaggggaaagcctatttaattcattgtcacatcccttccctggagacagagtaaaatagctaataattagacaaaacattaattgagtgcttattttatgtcaagtgtgatttgaggactttatatgcactaatttatttagcttcccaaaactccattaataggtactattaatgccccctacttgaaagattaagcaacagaggcatgaaaataataaagtgatatgtccaaaactacacagctaataagtgagagagccaagatttgaacctgaaggagatgggagggagagaaatagttggggagaccacagggaaaggaggaagaagagaagggaagaaaaggaggcggggagggccgggagctggaaatgtacctttgtattttaagtcattgagatttgggggttgttactgtcacagatcctagcctgttcttactaataaaataaataactaaatttataaagaagtgtcagaaaaaaaggtcatattagaccacgaaggatgacaaagagcttcttaaaaagggaactcaaggcccaaacatgggtattgttgtgtcatgtgaatccttcacaggggccacttggtgtctgtgtggctggctctttgtggccctggagagggaacaagcatgaatgcatcagtggcttccagcctgaacagaataagttcaacaagagatggccccagctccggtgtctactggggaggtgatgaagtgaagtgttcaattcctgcatagccaccaacaagtccctggaaacacaattgttgaggatgtgtccctcggggaggcatggttcatctggctgtgtcacaaagcagatgggaacagctggcgaggaaggactgcctgtcctgggaattgccctaatcatcttcctaaatattgccgcagccaggaggaaagcctgattccctgcagatggggccattgacaggatgctactggtccgggttgggagaaaaggaatgctgtaaacacagtcagcccattcggcaggcagtggaagctgtctgaggcttcagggccccctcctcactaggggctataattcatgcagtttcttatctgccagatggccaggaggacacatgcattccagtggtgccatcttctaagtgttggcagcttgccagtgatctcaacttcattttcatcattgccttttgagactttttgttcttaatcaccccaaccaaccatgaaattttaataccagaaatatattctctgtttacatactttatgcaaaatctgttttttaaacgtaaaaaggggattttttcacacgtgcattcccacaagaaccaattctctcccccgttgagaatgcctgttgtacactaaaccttcagataaccattttctgcaatcagccctatcagatttggagggagagaagcaactcaccaggaaacaaatgctctttgcattgttttgtctcttcccagaagcctcccatccaccttcagctggagttgagctttctaacatcactgcattcctgcacatccacattaccatctttatgtatttgattcctccttgagggcaaggcctgtttctctgttgtttacaccccctctcagtgcgtgctgtaaggtaggagcttcacagatggttaaagcaaaacagaacatgggccgggtgcagtgactcactcctgttgtctcagcactttgggaggccaaggcgggtgaatcacctgaggtcaggagttcaaggccaacctggccaaatggcgaaaccccatctttactaaaaatacaaaaaatagctgggcgtggtggtaggcgcctgtaatcccagctactcgggaggctgaggcaggagaatcacttgaacccgggaggtggagtttgcagtgcgccaagatcgcgccactgcactccagcctgggcgacagagtgggattccatctcaaaaatcaaaaaacaaaaaaaggaaaaaacagaacatgaaagccactttcccacagcctgggcacgtagctactgtggtgaatcacctttcctggcagagcacactcaggaaccgtcagctccaaaagcaccaaacagtttcattaagaccgtggctccttcgcagaagcacacggaacgcagactgacaagcctgtgataacattttaatggcctgagttcagttcccaataaaatacttaagtttctgcaatcatggagctggcattttcattaatactcctgattaattgtctgtcctaggaaaaggctcatcaccgtcacaatcccgatcttgctagttccttgcagggagaatcccagcagcctgggcttttccaccaggttaaagctggcaaagggcaaggaagactccctggcacctggtaccctccacttgccatggtaacagaggattacaggctctaagcccagctgctgtccttgcattcagacctcaccactcatacactgggacctggaactacttaaattgcctcagtttctttatgtgtcaaatggcgtttgacacataaagcactaatactaatagtacttacataataaggttgttgtaaggattaattgagttggtacaagtaatgtcctggcacgcatctggcacatagtgagtgcttcctataataaacagtagctgggtttgttgttgttttactattatttttcctccagaaaggcgagagttgcatcagccttggaagaggcaggactgagatgtttgggaacaagaccactttcacagggggcagccttttgagaaatgtcatgtctacttgatagggctttaaatatggagtagtgggaatctgcacatttggattcaaatcctggcttttccaatggctgatgatggaacccttataggctcaaatcactcacttctctgagcctccccaaaaattgagaataacagtttttattccatagggtagttttgagaattggtaagatgatcataaatgtagaagggcctggtactcataactgttttcttcatttatttatttagtcaacaatgttttctgagcacctaccctgggccaggcacactgaggtgggccttgggattcatcagggatcaaagggaaaaggcatcccatctccgtggagcttcacatcatcgtagttaaggtggataatgactgtctcgacagataggacagtggccaggacacaggccttcagtctggagcatgcttctcattttgaaataatttcttgttcagagtcaggttggaaggaaggccttgcaggggctgggtaaggatggcggcatctctgcgttcacgtctgtgtgctcaccatgagagcccacctctctctggcccaagtttccttctgtaatgtgaaagaggtggggttccatgctctcctcttcagcatcctccttagatactcaatctggcactcatcagtttcggaccctccatgctgccccaaaggaagccacactgcaccttcatccagtttcttaaacctgcatgttctctcttgcctctagaccttcgcccaggctattccatctgcctggaacatgcttccatacacctgccttcacttggctaactcctacttctgccttgtgccactgcttggattgaatgtcctctggaattcagccttcctggatgtccctgagctgggctagggtcccctctgcccacctctgctctttgattttccctgttcatcaccccagttatgacactgagttgtaactgggatttctaatctgtcgcctccaccaagcagcacactctttctggccagggtccatgtcttatttgtcttggtatctctagggcccagaatctggtacctagtgaatgtgtaacaaatattttctctgagctaaaataggaacacagggtccctgcaatgaagaccccaggtctggaggggaagacaaggtagcattacaagataacaggccttccctgcaaagcgtcagcactcagactggggcattgtggacaagaagggtggagaggagagaaggcatgaaggcatcccagatagggacacagcagaaacaaagacaaaaaggccggataagcaagatctctttgagccggcaggttaagatgggtagtggaaagctggaccactgtcaggttttgacccctccagacaatgcaccgtgatcttctggcttccatatgtccctggctgctgctgcctgctgcccactgagggacctcaccctccagactctaagtgatcttaagccaccagccttacaaattacagcagacagagggggtccaggcccttctagagatagtgttcacagcactttcccaaagctggttctgctcaattccctaaaagatctcctgcaatggggcctccagggtcctaaaagcaccatctgctcttaaagagtctcactgctcattagcatatcaaaggctctgaaatgtcctgcaggaaaaaactctgggctaacttttgtagccctgttccccaaactaaattgaatgaaggattctttttttatgacccacctacagttctgcagagatcctccagggaatgcagatctaacccattctctgtgcagtgaatggcagagaaaattaaagtgattgcatctattgcacacttacttttccttcgaggtaggtgagagagtaaataagatgcaggagagaattacaaccggagatataaaacagttgtcttacagggaatagtctgtttgcccagggaggaggttttcagaatacaaagtaccatttcttctccacgacatccccaggggagaaaggaaagtgaaagaagccctccaaccgaccactggagatgggagcatttctgctggtttcatttacataagtgtccttggcaatttgtcccaatttgtctcattataaatgatgtaaacatccgggcgtaatcacagacaaaatgggatggtttaaatgctgcctgattaaaaaccctgggttggctgcaatgacttgcaggcatgctaacggcttccctgcaagggactttggtttcaaagttctgagagctcaggagggtccctaggtctagttgcaaagtcatgtcccccatgactctgcaactctccacatagagcctagcaagaatgcatcatcttctctatatctcttataaggagggaaggaagaaagggagggaaggagggagggggagagggagggagaaaggaaagaagaaaagaaaggaaagaaggaaggaaggaagggagggagggaggaaaggaggaaggaagggagggagggagggaggaaaggagggaggagggagggagggagggagggagggagctaactgacattttcccctttgccatctgattggcatgaagggcaatgtaactgaggagtctggggaccaaagtgaatcctagtaatgtcactcacttaatatgtgtgattttttagaccaatcacatcatttggccaagcctcagtttcctagtctgtcaaatgggaatgatgatttgacatctggtgtgtctctcactactgttgagacattatataatgagagcatagccctttataaagacagggtttctgtcctctttcttacttcattctttccttctcttctttccttctaatagaaggtatagagaagacagcacattcctactgagctctatatggagagctgcagtcatgggggacactgtctagatctggggaccctcccaagctctcagagctttggaaggaaggtccctgcagggaaactgtgtgtgtttcttcaacagtgtatcctcagtgcctagcacatggtaagtgttccataaacagctgttgaagagacggatggataactgaatgaatggatgcttccatgggcaatgacacactaatctgaaaagccctgtatcaatgaaagaatcacttaatagtttaacttttccctcatccttcagaacacagatggcatgccatcttcccttcaaatctcttcccagtgccccacacagaagaggcacacttggacactggtgtctgatggacccaagttcacagcctgtctctggtcatcaggtatcatgaccttgggcaagaagcttaactctctgagcctcagtttccccttctgtcccccagggaaaatgagtcctgcccctcctaagggaggtatgagatgtaagaccccgaaggacacaaaggtttgccaggagccttcaggtaggaggcaggtaaggaggtctgctagattggaatgagtttctggaaggccccaaggagctcaaaatcagacctggggtgaaggtgtcttgaccaaaatgagacccatcaaagaagcctggatgaaggtgcccacagcatccatcagtgccaaaaacagaaacactttagcccaggatacaaggaacattttaaagcaacagagataagagatagttagaactcaggcctcctggctcttgctgttcttggcccataattagttgttatgggaccttaataaacttcttgccttcttggtacctttgccaaacaatctgatgaggagaatattgagtcatggtgccagggaaaattagcatattctgcaaattcctggcactgttaacactggattctgtccacctttagaaatcctcagatcactatgtcagcatcccccaatcacagctctccaacttcaaggagggttgaggggtctgaagaaggagagagaggcaacagagccagaaacccttcagaagatgccaagagcaaggtttggacccatagtccaccacttactaacttcaagagtgttatgagctacaaacttctcagtctccgttgactcatctcaaaaatggaagtaaaattatttaccatgcaatatgttgtcaaaatgcattgggtttagttcatagcaggtgctcaaagaatatcagttccacttcccttgtccctagagagccttgtagtggatgttgatgtgtcttccaacacatgcaccaacctttccctgtcctgtagcagttgagatggaatcatcccactcccagctccaggaataggctctgatgggcttgaacccagcagcttaattccattggttctctaggccttcatcattagtacaggaaaggcacttgacctaaattagttcgataagatttaagctcagaaatctggtttgttggatggagaaagagatgctttctttctctctggaaggagtttattgcaaaagtaagggctggggctgctacagccattgtgctaccatgagggaactagccatgataacaaaacttgcctggggaggggctacgcatcacagaaaatgatgccaaagtcctgctcaaactgtgcctgatgcctgcctgatctatggacttcttagttccatgtaatggattctctctatttttaaagccgtatcaggttgaatttttggagaaataaaacaaaaagcatcttgactaatttaaaaaatcttctttgggtattcaaccctcctaaactcacccccaaatccactgggagcatgtcaagatttttgtgagccgatttaggagatgcaaattcatttgccttaattggatctccaggaaatgacttctgccccctcttaaatcatttaaagctcaaagaggcatgagggccctccccaaggatgcaggtatcctcttgactgacagcctgtatgctctgcttccaggatccttccatctcctccctttactgagggagtctgctatgtgttagaggtgtccatcactggtcacactgggaagctgtggcagggaagctggagaaaaagcaagataggccccagaaagaacaccaactccagactcagggagactcaggccagaatcctagctcaacttcttccaagctcccaaagtcacactcttttctctgagcctcgattttcccatctgcaaaatggggatactaagggtcacctagctgggctgccctggagattccaagacattaggcatagaaacagtctggcctagaccctgtaggccagtaggcatttgatcaatggcagctgtggttgagatttttatcatcattatggctgcccttcctgctttccagggctagtgtagatctaagattataggggctgcaacgttcctcagtggagcagatgcagcaaggtagtaagagagggcattctcacttgtccccacagagtgtggtgtgggggagatctgtgagcaccccagcagccatgagggtcagcacttgaatctctgcaggtcagtcatactcctctttattatttttatttttatttatgtattgatttattgctctgtcacccaggctggagtgcactggcaccatcatagctcactgcagccttaaactcctgggctcaagtgactcccacttcagcctcccaagtagctagagccacaggcacatgccaccacgcctagctaatttttcaattttttgtagagacagggtctcactgtgttgcccaggctggtttcaaattcctaggcttgagtgatcctcccgccttggactcccaaagtgctgggattacaactgtgagccactgcacctggccttattcccttctttttatcagttttcaaagccatcagtatgcagagcactaggcccagaaatgagaggagaagagagatggaacgacgaagaccaaaacctctgtcctcaagctgctcataagccagtatagagacgtgtggagtctgctgtcctgagttccagtcccagttccccttgcaagcagccgtgtgacttgcagcaagtcattgaatccctttgagcctcactttccttgtctagaaaacaacaaaactggaaataatactgcttcccttccagtttgtcaaggatgaaggtgctttgcacggtccctggagcaaaatgtgttctcaatcaagattccgtctgtggtgggtggagccgcgtccttcccaaattcatattcactcagaaccttcaaatgtgacctttttcagaaatagcatctttgcaagtttaattcagttatgggtctcaagatgaaatcatcttggatttggggtctatccgaaatccagtgactgatgtccttataaaaagaagggatacaggccggggccagtagctcacgcctgtaatcccagcactttgggaggctgaggcaggcagatcacttgaggttaggagttcaagaccagcctggccaacatggtgaaaccccgtctctactaaaaatacaaaaattagctgggtgtggtggtgagcacccataatcccagctactcgggaggctgaggcaagagaattgcttgaacccaggaggcagaggttgcagtgagccgagatcgcgccactgcactccagcctaggtgacaagcgtgagactctgtctcaaaaaaaaaaaaaaaaagagtggatacagagaggcagtgaagaaggctgtgtgcaaagacaggcagaggttagtgggatgcagcgcgaggctaaggagtgtctggggccaccagaagccagggaagcctaggaagggttttcctagagcctttggagggagcacagccctgctgacaccctgacttcagactcccagcctccagagctgggaagggataagtagctgttgctttaaaccagtggtccccaacccttttggcaccagaaaccggttttggttcagtggaagacaatttttccacggacagggtgtgtggggtgggagatggtttcaggatgaaactgttccgcctctgatcatcaggcattagcattagttagattctcataaggagtgagcaacctagatccttcgcatgcgcagttcgcaatagggttcatgctcctatgagaacctaatgcggcggctgatctgacaggagcggagctcaggcggtaatgcttgctcgccagctcacctgctgtgcagccggggtcctaacaggccacagacccatccgtggcccaggggattggcgacccctgtctttttttttttcttttttttgagatggagtttcgctcttgttgcccaggctggagtgcaatggcacgatctcgactcttcaacctccgcctcctgggttcaagccattctcctccctcagcctcccaagtagctgggattacaggcacccgccaccatacctggctaatttttgtatttttagtagagatggggtttctccatgttggtcaggctggtcttgaactcccgacctcaagtgatccgcccacctcagcctcccaaagtgctgggattacaggcgtgagccaccacgacctgcccggggacccctgtcttaaaccaccccagcctgtgatactttgttatggtgaccctaagaggcaaatacaccctcctttccccaacctctcccctcagacgaaaccgatgcgaaaagtgcttcatgaagtttcaggtaaagaagtctgggacgaaaagggatagtgaggatggcgggaggggctgaactccaaatgggcttatcaaggctctgcaaaatggcgtgacggcgctgcccccttctggtggcctgaagactaacgcacatgatgtcaagtgcggggcccaagtactcaggaaaaggttctcatttggacactgggaggtcttacattgggggccctgagcctccagcccttccaaatctattctcagcaggagctcagccacacctgtgtcccagaactgaggccaggcccagccttcactccacgcccagccagccccaaggaaccgactccctgaggctctatgctccctgcctccagtggccccgtgtctgggaaatagtggccctggcctgatgccctgacctgggcaatccatcccctggtcctctcagctcccgggcccaggttttctgggctactttaaccagggcaaactcattcctcgagtacaaaataaaagattcgaacagcataatcaaataggtcatacccataaatcaacacatttgagcacctattttgttgttctttcactaatccaaaccatatttattgagcatctactatgtgccattctccagtagccattctaggtgcaggggatacagcagagaccttgaaaaaaggaacagtctctgatcttgctgagcttagagtcaagtggaggtgaggaggaaggaaatgaattaacaactaagtgaagcagaaggtaaccaattgattgactgacgaaggggtacaaacaacaaacaccttcctttctccaaactctatctttaactgtattctctcgttttccttcctctccattttacaatcattttacaacatctctggctattctcctatatttctgatcacttcggttctcatcacaataataatttcagttttcaagcattggaaagtcccatccaattaaaatgtcaatctcacacgcagtttaaacgtttcgcctgcccgtgagctcagacctgtcttggtgcctcagttcttgtgtggaggggaggagaggagaggggaggggaggagaggaaaggagaccggggaggtggggggggagaggggaggggaggagaggggaggggagtgggggagaaggggagaaaagcgcagctggcttcctcactctcctttccttcctcaccatccttaccctggcccagggcaggaggaggattggcagagtagaggcagggtcttctgtcttagctgggcctgttggtgactttctgttggccaacatgggctgactggaatgttctccagcatggcacatggtcatccagatgcaggctcttccctggggcactatagcagagagggctctcttccagtctattgcagatggatgccctcgtgagctgagttttgatgaacatcccatgtccccagccaccccattcagagcctctttctactctggtcctctggtcccagcagcagccctctgggtactgaggggagggcatctcacccaagccccttaaacctgctcaccttcttcagagcccacgtggccgcaggaaagtcacaaacccttgtgctcccacagggcacacgtgtgcacacgtgtgcagctaccttctctctagttggtacctgaggctgcctcctggattttccagtctctgtgttcccagacaaccccaagccccaagaatacaagagctctgtcaccaagcatcgggcctgtggctgcactacacgtctgcagctcaggacccctggctgcggcgtaagctaccagcatccccttctcatgggcaccctcatctccggctccccatcgctgggctgtgacctgcgggggcgcccctctatggaagggaaggagaaaaattcacagtgctatctactcctctgaatgcactcccaccaatttccttggaaatttctagctttcactgacatatctgggatggggcggtggtcacaaaatcaatcccactttccctcggctagtcttacaagcacccaacagctctattcagaatacagggctgcccagctacttcccattcattatccccaggttgcaagctttagtcaaaacccagaggcagcagggtgtctggttccacctgctgttaggatgatttcaggagtgcaaagtgttagaaacgcggtaaaacatgatgcttagagattaagtgggatggggactgggcagatgatgctgctttggacccagcgagtgaggtgagactgcgacaagacagagccactgagcagtgacctgggggatgggcattgcaggcaaggcagaaccccaagtgggaacaacctcactgggcttagcaaaactaaagaggcccaaagtatactgagcgatgaggtgagtggcgtgggataaggttggagaggaggctggaaccagaccctgcagggccttgcaggtgatgggaaggagtttggaaggtgctggaaggtttgaagcagaggagggatatgatcatgcctgtagctgctatgtagaacaactgtatgcatgccaggcctgtgccacgcatgctctaatcattactggctttaacccttgcactaacgttgtcatgcaggtaggagcatctgcacccagcaaatggaaactgaagctcaggaatattcagtcacttgtccaaggctccccagctgttaggtgctaaggctggattcaatccaggacttgcagactccagtatcttggcttttctaacgagagtgtgctagctttctaatgggggtggggaaggcagtctgcccccctcccatggcaccgtgagcaggtgtcactgctccagccagtacgcctggacaccgactaggaaggagtatgtgctactaggagggatggtctgggctgactctttgaagttgacaaggagttgcataatcccagctaataattatgctggaccaggggcagagacattactccaagggtgaccaggtgtggagaagaggctgctgactccggggccccaggacctggcccccaggtctcattgcccgagtgctgccccagaaggagtagaagctggagctgtccgggccacagccgaggctgggtgaatgctgcagtgaggctgccgcacaagttgcgtgttgtgacatttgtcttctggaggggattgggatgggctacttcagcatttaaaaacccctactaggtctgagaaatcccctcagcttatgagcctgggtgggcagcaggccttctcaagaagcccagaaggccagatgctcacttcccaggctctcttgcggctgagctgagagcaggcacctgaggcctggcaagtgtgacagctggtgacacagacagacagggacagggagatgggactgtgcctgcagcggtagccctggccggtgttcagtggggccagcatccgtgtctttcctgggggccagtgggggccgtggctctgacgatgcatccctcccccacgttttttctcttcttgtcttggactttgcagggagcactctgcttttgggaacaggagctgggtctctggccattctccgcagcccctcaccattcactcagtggctctcaaaaaatagaacctggggcaaagctgttcttggccccaaacaacatgaggaaaaataaataaataatgtacctggtaactgagagagttccctctgcatcttgggctctttcaatgagatgtcctctgcctgcagcaagccccaagggcttccctcaccaggaccagcaccctggtttgcctgaccccacacctgccaatgccggggcaagaatgtcccaggctgccctggttcccagagctgatgcttcccacagtgcccagctgtgctggcatggagctaaggacagggccagtcccaagaaaacaacaaggctccagggccaccggccactgctcaggaccctggctgaccccacagatgcggagtgcctgagatggctcatgggtgacccccaggcatctggcaaaggtcacaatggctgtttggcttgaagacagcccttgcaagatctgttttgagccaacctgtggcatttagccctccctgggtgacaaataaaaaggctgaggcttgtaggagccaaggtgggagtccccatctacccccaccctctcagcccaccagggcccagactggggaactgctcctgcttcgagggacagggctgaagaggagaggggcttggggctccccttgatcccaaagctccagggaccccaaagaaacgtatcagcagcatgagaatatcgggtgacctctctctctagtaaatgtcaaaacttttaaccaaaatgccttcatcccccagcgccaggcctgagctaatctcataggtgtcaggactgggagcctggacccctcttccttctgctcctgctttgcagagaagtgagtggggaattcccgcctctgggaattcagagacgaagtgacagagacagcattggaagataagaatgcagccaaagaggtcttcagggtagcgtgtggcctgggcgctgagactattgggcctagcaacttctcaagcagtctattaaccacagccggtagccagcttttccccgcccttctcccaggcacacacagccacctccatcaccaaaggtcaggcgaaccacctcccatggctacccccagcctgacttgctttatagaaatcatggcatctcatcctcacaacagcccacactcacagtgaatcttggccattatgacaactggggacactgaggctcggagtggtggaaattctcagaatcacataacaataagtgttaaagtcagaatttcaacttcatctctctaactccaaagggcgtgtgtgtgtgtgtgcgtttctggccataatcatattgtgccctacaagccccagtgaggaatctgctaggaacactggtttggggaaaaaatgtaataaaatatgtgatccagaaggcggccttggtacctgtcataaaccgcagcatggggtactcactatgcctggggtctgggctctgaaggcatgattgaatgatctcactgcaggcctggttgtcctgcgaagacacccgtcaatacatgaatattgacacacaacgctgcagtgcacgcgcttctggcaggggagctgctgcactcgagggcagctcaaggttaatttgcagggttcatgtttggagtttctgagcaagtgttgcagctttggcccccagccccctgaggggagctctggccgtgcatgagggtcagacagaaaatctcctttcctccatccaggcctgcagtctgcagcactgaggtcagcgctggccacaagcccaccctgtgcctcgtcagccccactgagcctctccatctatcatgccacaggctgaccctgaaatgcaaaatcattctgtcctcccgccctccactcccacctcgcacatctatggatttgctgttcagaaaacatctgttccctccttcgcccctgacatacgcatcgatctcatgctagcccagctgcctaagctcaccactctgggagacagactctcagtcctcatcagacagagatgtagggggctgtaagggacggggtgcaggtagggcctgaggattccgacaaggtgagccatgggcaggggcattgttcatgcagggacctcctggccaaggtcctacgtcaaggttagaaggaaagagtaaatgatcggataggctaagacagcaactcagcaggccaagggactcctcccccaggacctgctccacccttagaggggtcccggacagccaagccctgatggagttggtcagcaaccaaccagccctggggccaaggcctgcagaagcagagaggaggggtctcaggcaggccagaggtgctagctgggatgcctgggtcccccaccccaccccagcacactgtcctttctccaggtgctcagttagattgagctgggtcccatcttgggcctttgctggtccctccctagaaagtctgccccctccccctgcagggtggcatcagcattcaggcctggccctgacgccctcctctctgggccaccttcacctccacaaccccggcaccagcacccatccccaccacatccccagcacgcagcatctagtaagggcaccaaatgcatgcccagacatatgagtgaaatgaattaaccctgaacctgaaaaagggcaaccaccacacaagattctctagaaacaatgtgaattgtgcagaaggaaattaaccctactccatccagcccatcctaaggcagggacttggacctgttcctcttgatggggctggggctgaggcgggcaaggcaggcaagtgctgaacagttggcaacattgcccatcccgtctccctgcaccaggctgggcctggggtgagggggtgggggccggggtagctgggctcctccagcaaagagcaggactgagtccctggtgactattaggtaaaaggtccctgacaattttgaggggccagatgccaactcgagggatacagagaagatctaggcacagtctttccccaccatgtcagacaaaaaggttagatacaggacctgatatgttataaaactcaatcaatatttacttagtgaataaatggacggatggatggatggatgcattaggcagccaagtgggcagcaccgatgacttaatgtactgagtgctccgactccagcaacatgcattcattgttcctactgtgtgccagtgaacaagagcaatgaactcaatgacttctgcccagggtgggccagggaaccagggaagactctccaaaaaggcagcatttgggctgggacgtacagatgagtagggggtcgagtgtgtcgttatgtcgctggagcccagaggcgtccatcaggacttgggggagggcagatgaaagggccttactgcctaacttggagccactgtatgtttcaaaacaaaggagagagaggatcctgggaaagagaaagggtactctaggcagaggatgtgaatgggcacagcacaggtgagaacatcaagaccaggggtcagggaatctactggtaaacaattgtaccccaagggagcaatcacagcctctccatccacagggaaatgcctggtggggaggaatgggaggaaagaaacagattgcatgactgtgtcttgaaggtctaattccagagtacagcatcacccctatcttccaggtccagaaactgaggctcagagggagactttctgatgagtgcagcgtgcagataagagcatctccaaagctacctccttccccagtcacaccagggcataagcaactgataacagctgtcagcacgggacagtggagggaacactaggttaggaataagggtacgaggcttgagtacagattgtcaatgactcagtgtgtgaacttggtcaggtgactccaaccagatgacttccttctctgagcttctgttccctcctctatgaatggggacaatcactcagcttcacaaaacaatggctgcgaaattgcctggtacaagagagagaacttccagtgtgtaggggctgttgtcctaactgcccagccccctagataggtagttatgtcatctgtgaaatgggtgttagaattcctacctcccaggacagctgtgggcagaaaaccaaagaatgtgtgtgagagcccaagcaccatgcctggcacatagtaggtgctcaggaaaggctgagggtgcagctgctgtccacacacatggtaccactgccccaggaaggggcttcaggaaccaagagcaattctgagcactggtgactggactctgccattctccatttcaaacgctttttgaaagcagctccagacccaagcaggagagcaggaggcaaaagaaacgcaggggctttcccgaatggaattttagaaacacacagaattgtctcctgcacagaagggaagctgtcttccacagcacagagccaccaggccccagactgctggcttatgtatttgtcattgctcatcatgaatggatgccaggaaagtctctttgtgatgggggcacaacccctcaaatctcctcccctccagatgccatccactggagctgagactcccaggtcccctagggcttctctcccaggggcctctgggctccccaaggccacgtgctgcccccactagagacctgggccagtcctgaccaggggaaagagtagcgccgacaacagccccagatggtatgtgcactggcacatactggcagctgccttcatgacagcaagccataggtccaaatcccgccccttcacagggacattcccaactggtcaggggtggacctccccttcccggctgtctttggtgtccaggacgatttgccacagacagggggagctaaaggggcccacgcttgaggccgctcagctctgagtcctcgccggccacagaggaccttcgtgcctgtcctctgtcctcctgcccagtccccaggccaggctcagctggagttggggagcagaaaaacacgcatctgaatcaaggctctcggagcctttgcttctgcctccaagaggcgagggaaaatgaatacccaggcgagcgagcaagagagaccctcagaaaaccccagatgcccctggaatcaagccctgtcccaccaacgccacgtggattgacaggctattagtcttcctgtaattaggattctcgcctcaaatcttgtatctttttcccccagaagattctcctccagccttcaccactgccccctggcgcttccttgcaaggcttttgaagaatcctttgcagagaagcagcctcctttggcaggggctgcagagcactctgcctccctaggccagggcgaaccaacagaggcgggagatgaggaggagcagcgcggctctgctgcgtggccctgggcaagcaccacaacctctctgggccgtttgcacattcttaccgccagggatgtgggcggtaaatgaaagagaccagcacaaaccagtgtcagctcccttcctcgattcctaaaatgtgatgcccaaagatgggccagcctcctgctgtgccttctctggggggacatttaataagtggaagagccctggctctgagtcaggctagaatcccagttctgcacttaaccagctgtgtgacctcaggcaagcaacctggcctctctgaacctgagtttcttcatctgtaagtgggaacgctaatgctgtgctgagggttccatgggacaaccatgtaaaagcacccagcacgcacccagcaggcagcaggtcctgcacagcgttccctcgcgtgggggtgggttggggcttgagcacgggttgaacctggaagaggccatttccctcccttctccccgaggaataattgtgaattcctgggtctcagaggaaacatccgctttggtggtcagaaaggacatcctcctttgagcagggggagagcagagggaagggggttgcgagggtcacgccttccccaggcattctcggggtctctccagcaaggatggaggcggccaggggcttgggcggtgtggggcgccacctggcgtccagaagaggtaagacaggcggagcgggaccctccgaagtgggaggaggacgctggtcaggggaggaggggaccgcgagagcgagagcggacattctaccaaacacatggacaacacagaagatgaggaaaatgagcagggcagctagtcataggagcaaattttaaaaattaagtgactgaggtagtcagggggcctcactgagaagtggcttggagtaagacctgaagttggggactggatatgcagatgtctgggaggagagcttttcaggaagaagaatcagccagtgcagaggcctatggcagacccaagcaggaggcaaaagaaacgcagaggctttccaggatggaaaatgaagaatcagccagtgcagaggaatgtgcctggatgtgttccaggaatgtttcagaatgagctaaaaggccagggacagagaactaagaggagaggagaggtcagagagatggcggtgggcggaaggagggggcggggcggaggagggggcgagggggcgggggggcggagggggggacggaggggggggcggggggcggggcggaggggggatggggcggggcggggtgtggctgtgcgtctggataagggttgtggcttttatgctgcacgagaaggagagccattggagagcttggggcagaaacaagagctgatgacattttaatccctctggctgctgtgctggggtagactgtcagggccaagggcagagtgtgaaaagcgcccaagaggcttctacaagaatctagtgggagatgctgcggctctggccaggttagtggcagtgccagtggtgagagggatgtggttctgcgggtgttgtgaaaatggagccagcgggatttgttgacagaccaaagttgaggtgagacagagactccggaatgactgcagggttattggtctgagcagggttattggtctgagcagataaccagatggagtcaccactaacttagatggagaaggctggtagagtgaggaaatatcgggaacttatgttcggacttgttaagtttgagatggctgggagatatctaagtggagagggcaaggaataaaatgcttcctaaactccagcatccattcagtcccctggagagcttgttaaaccggatggatgggtgccacgcccacccctgcacccctgagttgcaataggcccaaaatgattcaataggcccaacatggggcccaaggttctacatttccaacagcttcccaagtgatgccaatgctgccagactgagaaccacacttcgagtagcaccaaagtaggcaactggatgtttgaggctggcattcaaaagagagatcctggcaagagatagaattttggagtcattggcacggaaatccacaaaacgacatgagctctcccagggagtgtgtgtgtgtaaagagggaagaaaagagcattgagtcccgagccccaggctcttcaatggtaagaggttggcagattaggaaggaccagcaaagactgggatgggaaaccactgaagcaagaggaaggccaggcagatgtgtcctgaaagccaaaaagagaaaggtcatcattaatatgatacattttgcaatttgtttatatgtaagaggagattaatagctcatagcattcccaggcattgctgttaggaattgcagctccaggctggcaacccttaaatcacaaactagattgtcaagaggactgcctggaattccagctctgtaagtaatatgctgtgtggcctcagccaggtcacttcacctctctgggcttctcttgcttccatatataaatgtaataagaaaatcttttatttattatttatttatttatttttgagacagagactcgctttgtcacccaggctggagggcagtggtgcgatctccactcaccgcaatctccgccttccgggctaaggcaattcttgtgcctcaacctcctgactagctgaaattacaggcacccaccaccacacccagctaatttttgtatttttagtagagacggggtttcatcttgttggccaggcttgtctcaaacacctgacctcaagtgatctgcctgcctcggcctcccaaagtgttgagattacaggagtgagccatcacgcccggccaagaagaccttttaaagtagatgttctaagagtctctttcagttctgaatctctttgttatcttacatgttaccccctcagagatgccttccctcactcccctgtccaaggtagctctccacccaagtcagcagtcatcacagaaccatcacaacctgaagccctgtgcatgttgctgtttatttcctgtttacatcacaacctgaagccctgtgcatgtagctgtatactaaccctagagttagtatagcttagttaaactttcatttattgctaaaggtttatcactgctgtctctatcagcctccctgcactgtaagggacaagggggcaggtccagtttctgtcttgtttcaggttttgtctccagccaagataagtatctttgcaaggctctgtttttattctgaaaggaaattaggagctattggagggtatggagtggaaggggacagtcttctgccttggatgtataaaagggatgctgggccacgctgatgggctagaccatggcaggcagagaaaacaggcaggaggccaggcaggggctgccagtgcccagacacaggccgggaggtgcaggtggcagtggcaggcagtggccaggccctgggtatattttgaaggtcaagccaacaggacttgccagtgggctgggtatgggcatgagacaggcaagttctcccagatgtgactccgatgtgacattttggagactccctcaacacccacctggggaagacagaccagttgggaggaaatatctggagtctcattttattaattctgagagtttgttgtattagacagtgaagcggaaatgtcaggaagtcagctggaaataggagtctggagttggggggaaagcctagccagagacaggaattgtggcgtcattggcgtagagacagcgtttaaagctgtgacgctagatgggttcaccaggggaatgagagtcgaaagagaagagcagagcagagctgagccctgaggggggcagaaaggcacacagggacagtggaggcaggaggcagaaggcagagggtggcgggccaacagctctgaaggtcagtgctctatcacaggggggtggccgaggaggggcccgaggctggaaccaggaggcactatcccaggcctgccttctcatgccagcagcagtgatctatcctcaaggagaatattgattgagcacctactgcatgcagagacctcatcaatggctcaatcaatatgacacggccacgcttcctgatccgagccctctgagcaggtattttccatcctggacttatccctgtttctcaggagagggatggacccaagagacaaatagttcccccaagatcgcacagcaagccagtgtaaaacaagcatagaaaccagcttttagggggctcaaggtgggggtcagaaaatgaggtgagagcaagcatttactgagcacctcctgtaaatatctcctacatacgaagtgctctacccacattactgaccacccaataaaggcaggtcctgtaattcccaatttgcagatggataagcagaggcttaggggtgtgaaacaacctcctcaaggtcatggcttctaagtggtggagccaggcctgcaaaccaggctgtctgaatccaaaatccacctccaagtccacagtgggttggccccacccccaacccatccccatcaccaacaggacggtggtcagagtccactgaatgaaagcatgcgtgcattcaaaatagacagccaatcagcagccttccatcagaaatgtcatctttatgacaacagcatcgattccaggcgtaccctgcatatgtgaaccaagggggatggtggattgtcctttccaagcacttcccagccccttagagtcccacaggcccagaaccacggcccttgacaccctctacccacccctgctcccccttctcctcagaccccgagtgtctggccaggctttctcactgggaagtggccactccatccaaatgaccaccgcacccctcctcaccagcttccctgcttctgccctggcccccactctttgagtccattcttcaaccagcagacaaaggggtgctgtacacgcctctgcacagaacccctccaatgccttctgtctcaactcagagcaaagggcagcagctagcacactccaaacactcccacccacacctcagctcctccctctgtccctctgctctattccctcagatctgacggctccatcccataaacgtggcacacacacacctgcctcaaggcctttgctcaggctgttcccactgcctggagcactcttcctgcagacacccacgaggctcattttcctttagtgaggctttcctggccgcctcttccagataacaactctcctctccttccctgccctcctgctcctcctgttcgcgctacataacagactctgtggggccttggtttatgtatttccttctctcccctactgaaatacatgtgagcgatgctggggcaggccgactagaagaagcagactatctgcttcttctccacccttagaatggtgctgggcccagaagaggcatgcagtcgatatttgctgaataaatgaatgtcagataaagtggtgtggggactccaggggaaagatttgtcattctccaccctcccagttcagcttaaagcagagaagtgagaggtgcccaaaaaggggtgtgtctggggggtggggggtggggatgttccaagatctccaaggcctggattttaagcaaggtttgagatgccagcaagagggcctggcattgccagattgatagtctgcatttcagagaaggacaaccccacctctgaccttagcccaagcctcaacagcctgctcaaggagatccacccttagtaggaggaggcagccaggccaggttccagtccctgccaccgcttgccaggtgtgtcttgggcagcagttgcctttgctcggtggtcttcagctttgccccctgccaggcacgtgctggcctcctgcctgcatcgtagctcatggagtcctctcagtcacctctgtatgccctgcagcatccccagttctcagtgagaagagtgtgctctgaaagttaagtaacttacccaaggtcacacaaggtctgagtctcaaatgcatacaatttgaccccatagtctaaggtcttgaccgcaatggaataagaaattattttaccattctgagtggcagtctctgaagactacagcaataattgatgcctctcagggggataggtgtgtcacttacaggtgatagtgaggttgtcctcagcctccctgctcttcgttagacctccctcctcctctctacccgggccaagcgtccaaggcaaccctgtgtgttgcattgctcttgggggcagccagtcccccacataaagtggtgtcttccttcagctcctaacaagtcatgtggccattgcccacactacaacgacagaggaagcctcaggggaaccctcctcctctcccgaatctccgggcttcctgcatccctgggaggcaatgtccattaattccagctatgaccagcagagggcagcagcagcctggggaagacccagaggcccaggcctaggggagaggccggtgtctccaccctaggagccccaattcctccgcagcaggagcagacacacaaagaggagggcgagcaagggtcctccggggcggaacacctctgccgcacctgcagcagccttgctctatttcttcacaagcttccccatgacactgacccaaggctgtctggccactacagctgctgatgatgattagcaataataataataataaacgaaatgccttctgcttagatcatctttaatttcccctccagaatgacattcgactctgcttagagttacaggcagcccagcaattactgagcgcaaataccgtgttcacccgcctcacctcatccacgcccccacaacacccagccctgagactggctccacgatcacctccactttataaaataagatatcaaactctgaacagaacggacgtctcaaaaaatgggcatattacatttaaaccctcaatctgttgggtatttgagtgaaatggacatacctccagggagtcggtggcgagggccggctctgaggacttcctgggttgggatcctggctctgcaggactgcgtgaccttggtgagttacttcatccctccaaacgcgctgttctccttcatagaatggagatgaccacagggccagattcataaggttgttccttgtaatacaggtgaatatccatacccagcaactgctggaccacctgtggtttcaaggataatttccctcccacgtccccgtggcccttggaaccttcctctcctcctgtctccccctgcccccatcactttgtaattgaaaagtcatgattgctctcccaggtgtagcactgctcacaggtcagattgcctgctctgacgtagtgactcagttggatgcggttcagctgtgtatgatcaactccctccccctgacaaaaacattattttgcatcacagagaagttgatttctttcacacataaaagaaggcaaaaagtggtgcctaaagggctggtacagcagcttcaagaaatcaggaagaacctgggctccttctgccttcttgttctgccaatatcaccccatggctgccacttcatggcccaagtggaaccatggagcaccacccttcagacccataggtgacaacagcctgctctgtgagagtggcagtggcttccagagagacttaggaagtagaatcaacaggacttggtgacagatttgccacagagctggggaacagggaggtccaacggtgactcccaaggagctgatgtgagaaccagagctgctgtgaatattgttcccaactcctgagacagggacagtggtcccgtggctaggaagtggtaggcagtagagagtcacaatgcacattagtatatcaacattgtgagtagggcacgcagggaagaaacctgttcaacccagccccgtgctagaaagacatcagcagggcctgcaaaagccctgattaaatctcacaagtttgcacctggagccgccatcttgaattgcaggtgaatatcagcctttggtttgggctgtgtgccccagatgatggtggtcccaaattacataggccaatatccagagctgggttaaaatgaagcatttcgaggaaaaaaatgcaatgaaatttgtttaaccggtacttcaggcttttgagcacagaacagcgtccatccctccaaacacacactgaggatatacacttagccaggagggaacataaggaggggtggacaagccatgtttactaaaatctctcagtgtgtgccaggcatgttcatgtatattcaggaagaagtgtcagtatttaagatcctcggcccttgcccgagtccccaacacgccttcttgtctggagaactgtaaatcttggaaacatcttgcaaggggggacacctcacagaaggcaggcttggcatgggataaacagaatcgactcctctgcttccttctgatgcacagtgaatgggcaggtggaagcatcgttgcttaaagaggaaccaaaactccaccccagagctgctaattccttttggcttgcagttatgcagagggctaaaaaatccaacgaatcacaaatcccctggttgctaagtagaaagaatatgttttggctgctgctgttcccttccccaaggaaaagattcaagcagaggcggtccccacctctcaacacagaaagcaacatctctgattgcctctagacacaccttcatgctcgtggcactttgggaccctctgcccgctggcttatgggcatggcttccccatcactctgggtccttgggaagagcctctttcccagaccccacctctgtgcctcatcacatttctcccaggctattgacttgttcaaggttaaggtatgaagagagtcatgcagcagccctacctggctctgctctgctgggggaagccttttcagagcctgcctcttcctcagcatgaggggctgctcgggcccagtcccagaggccatgctggtcccaggggaaggtggccgtcatccccatctgtgttttctcttgcaggtaagtcatgctccagcagtcgggagggttgtgtgatgacacacttggcagtttgggagcaaaagccgccacagtaagacacaattgattcattgcctctcaaccctctgctggggtggactttcatgcgtggacttctgtccccaaagaggcttctctgggtctggaaagggccctagccttggttgggggaggcaaaggggtggcggcttccaggtaccatctggccaggaaccggctccattgtctgtgcatgtagcttgcactgggctgcctgctccaagggaggcatctccccacgatctacgacattggcttcaaagagctgctcctggcagcttcgaatggctgagacctactggcatgggatggaggagtgcagggagcttcccgggacctcgctagtcctgcctggatgctcagaaggccctcgtcctcggtggcatgcagcctcggccatttccaaactcacggcatctcacccagccatgtcacccacccccggctctgtcgcccttcccatcacctttctcccacccatcacctcacatcaaggtttcagccagcgggaaccaggtttagactccaattacctgtgcgtgtgggaggttggattgtgacatctttggagggccgggcttctgaagcgacatttgatttctggtactgaaatgtcaaagggtcctgaggcacccgctagggcagcacgcggagcatccacctgcgtgcgcatcctgggctctctctgggccacttggtgctggggacatgccgggagctggtggtcagccctcctcctgcctcctcagtgctgcatcttcaccttctgcagctgcctaccagaagcagggggacctggaaggcaaaggagagggagttggcatgtagtgagcaccgactgtgcacacagtgccagcaaggagcttcacactcatctccagcgtcacagctgcccagtggctgtggaagccgatggactgggccctctcccagtacacaatcattagagggtctcagttcactgagtaactgtgggagcagcacggtgcctccatcagcccccagttctgctttcgaaacatcgtcaccatcgccaaagcaaagcctcagacctgcaggccagcgctcccatgccccatagccgggagtaaaggacagatgcggggaatctggaaggagattcacttcaagcaccatcccactctatttgttaaacttgtgctcctgtgaaaactgcttgtgtctgcatcaaacccagctagggagggctgagggctaagggtaaacctgggagagttgaattccagtgctgtgattaaaaccaatattccacataatgcaatgtaacttgctcacatcgtcccatgtaatctttaaagccacagcccttttgcaattgggattattatctccattttacactggaggaaactgaggctctaagaggtgaaatgattcacccagttaggaagtgatgagtccagatgtggtagactgaataatggccctcacaatggaacctgtgagtgttcccttagatgacaaagggcctttgcagatgtgattaaattcaggatcctgagattgggagacattatcctagattatccaggtgggttctaaatgtcatcagaagtgtcttcataagaggaagacagagattttgctacagaagagggggaaacatgatgatgagtcagaggctggagtgacacctggaaggggccatgagccaaggcgtccaggtggctggaagccagaaaaaggccaggaaatgggttttctctgtgagcttccccaggaaaccagcctggccaacaccttgactttagcccagtgcaactgactccacatttctggctccagaactgtaagagaatacatttgtgttttgttaagctagcaaatttgcagtaatttatgacagcgctatgagaaaccaaaacaccaggattatgccccaaggatcctgatgccctccctcctctctgctctgcagtgtgctggagctcacagggctctgctgctgggagttagtatctagtccaacactttacccactcaccccccaagctaagggactcctgaaatcagggaccagatgcataataggtgcccaggaagtgagactcgccttccccagattaagaataaagaagacaaactatccacggctgctgtgagcctctcatcagacctcagcttctagggcagggtccctgcctgtctccagtatgtggcctctgtgtcttcttcgccctccatccccacagtgggacgagaagtcatcaggaaggcaggggatctgcaggcagccatcagggctctaattgcagctggctgggggaccatgggtcagggctgccaccccctggctctgtgccttcacctgtgtaacgaatggggcactcacagcccctctcaagtggtcctggggatgaagtgagaaggtgacatatacaagtgagttatacacgttcctgttctgtcactcaccagtgctcactgggtgggtcactgaactcccctcagcgtttccttctccatctgtaaaccaccagtgcaaacctttcccagatagtgctgacccgaagcaggaaccagtgcccctctgccctcagtaagtctgccagcagaggaagcccatagagggtcttgggaaatgaagccaacagagtcaagagggtcagatgatgagggacttcaagtgccaccttcatcccattctttctgcaaatattcaccacacacctacgtgacctcaggctctgtgtcaggtcctggggatgtaatggtgtccatgaagaaacaaggtccctgccctcatagagtggcctgacatatgcccgaggcagtcagcagccgagtgcgggagactcttgagcagagattgagtgtgttgatatctgtaggcatcagcctggctttgctgagtgagctatatcagagtggaggaggccagaggcaaagtccagactccactggatcctggattgaggggagaaggggctgggcggaggagcagcctgagcacctgcatctcactccaactgggtgctgatttgtccccatggccccagcacccaggcaggtcaccaagtaagctcaagacaaaaatgatgagtgactcaacagtgtctggggacaagggagggagagaagaactcaaaatgactgaggtttccagctaccagaaaaatggaaggaccttgaaacaaatgggccatcagcaggggacactggctggaagcccagagtccagtcagctctgtaaggcccccagaataggcatttgacttcaagtcacaggcatttcagcaaaagcctctttgctacagtgattatggtgaagcagatgcccacagctgagatgggcaactctcaggcctccagtggggacagagaatccctgggccccaacatagcttggcctgaagatctgagtcaggcatccaacctcttctgctcagctctttcaggaagatgtgtatactggcctctcttgccgcaagggtccaccaccttccttatgtgtgacctaaggcttctagtgctggctcagtggctaatttgagcataagcacccttgttggtaaaatgaaggataggtgtagatcagcatttcccaaagtgtgtgcttctcagaaaattaggtccctggttgtctgtagaggttacttaacaaagagactctgtagttatgttagaaataaatcttatgattaccaggattagtctctttaaagcttgtctaggtgggtcacaaatccgcctcagtcaggctttaaatggggaacagggtttaaattggatttaaacatttaaaaaccatgctaacaagaaccaaaagaaagtgagagtagctacattgatttcagacagagcagacttaaggaacattgttagggataaggatggatattacataataacaaaggtgtcaatactccaagaaaacataacaatccttaatgtgtgtgcacctaacaaccgagggtcaacatacagaagacaaaaaatgatataaatgcaaggaggaatacatcagtcaactgttacacttggaggccttaacacccctctaccagaaatggacagatccagcaggcagaaagtcagtcaaggcatagctgaactcaatgacactatcaattaactggatgtaattgacatctgtaggctactcatccaacaagagcagatatcgtatttttctcaaacccacatgggacgttcaccaagataggccacattctgagtcattaaacatacttaacaaaagcaaaataataaaaatcatacaatgtctgctctcaaagcacaatggaatcaaactaaaaatcaataacaaggagatagcaagaaaatcccaaaatacttggagattaaacaacactcctaaataacataggtcaaaaaagaaatcttgagaaattaaaaaaaaatactctgaatcaactacagatcacacaaacatcaaaacaataataaaggaatattatgaacacctctatgcccacaaatttgacaacttacatgaaatgaaccaattctttaaagtaaataatctgccaaaattcgcacaagaagaaatagataatcttaatagccctatgtctattacagaaattgaatcaataacatcctttcgaaacagaaagcaccaggctcagataggctgattggtgaattctaacaaatatttaaggaagaaaatgtatcaattctctacaatctcttctagaagataggaacaaaggaaatatttcctaactcattctatgaggccaatattaccctaataccaaaaccagacaaagacatcagaaaagaaaactacagactaatatctctcatgaacatagatgcaaaaattctcaacaaagtatttgcaaattgagtccaacaacgtataaaaagaattataagccatgaccaagtgagatttatcccagttatgcaaggctggtccaacatttgaaaatcagttaatgtaacccatcacatcaacaggctaaagaagaaaaatcatataatcatataaacagatgtggaaaaagcatttgacaaaatctaacccccagttgtgattaaaactctcaaaaaacaaggaatagaggggaattttctcaccttgataaagaacatctacaaaaatcctccagctaacatcatacttaatggtgagaaactagaagctttcctactaaggtacaaggcaaggatgtcccctctcactcctccttttcaacatcatattggaagtcctaggtaatgcaatgagacaacaaaaggaaataaaaggtatacacatagggaagggaaaaataaagctgtttttgtttccagatgacatgattatctgtatagaaaattgaaaagaatcaacaacaaaaacaaaaacctcatgtaactaataagctattatactgaggttgcaggataaggttaatatacaaaagtcgatcactttcctatataccagcaatgaacaagtagaatatgaaatttaaaacacactaccatttacattggtaaggtatatcccaaaatgaaatacttataatctaaataagtataaatcaaataacatatgtacaagatctatatgaagaaaactacaaaactctgatgaaagaaatcgaagaagagccaaataaatgaagagtattccatgtttgtggataggaaaccttggtattgtcaggttatcagttctttccaacttcatctatagattaaatgcaatcccagccaaaattattggttattagcaactattaacaaattattttatggatatcaacaaagtgattttaaagtttacagagagaggcaaagactcagaatagtcaatttaatactgaagaagaagaaaaaagttggaggattgacacaacctgattcaagactaactctaaagccatgataataaagacactgtggtatgggtgaaaaatagacaagtagatcaatggaacagaacagaaagcccagaaatagacccacatgaatagagttgactgatctttgacaaaggaacagaggcaatacagaggagcaaagacagttttttcaacaaacagtgctagaacaactggccatccacattaaaaaaaaaaaagagtccacacacaaaccttgcacccttcacaataattaactaaaaatgggtaatagatctaaatataagacacaaaactataaaactcctagaatataacatggaatcatatctagaagatcctgagtatggcagtgactttctagatataacaccaaaggcacaatctgtgaaagaaataattgagaagttggaattcattaaaatttaaacctctgccctgtaaaaggcaatgttaagagaatgagaaaataagccacagactgggaaaaaatatttgaaaaaatatatatctgataaaggactgttattcaaagcatacaaagaactcttaaaaatcaataattagaaaattaaaaatctgattcaaaaataagcagaagacccgaacagacatttcaccaaggaagatatacagatggcaagtaagcatgtgaaaaaatgctccacatatgtcattagggaattgctaattaaaacaatgatgagatgccactacagaactcatagaatggccaatatccaaaacacttaacaacacaaaatgtaggtgagaatgtggagaaacaggaactctcatcagtgcttcgtgggactgtgcaaaacagtacagctgctttggaagacagtttggcagtttcttacaaaactaaacagacccttaccataagattcatcagtcatgccctttggtattcacccaagtgaaccaaaaacttgtgttcacacaaaaaactgcatgtggatgtttacagcagctttattcataattgacaaaacttgtaggccaccaagatgtccttcagtgagcgaatggttaaataaatgatggtgcatcctggcagtagaatattactcaagactaaaaagaaatgagctatcaagccagtagaaggcatggaggaaccgtaagtgcacattactaagtgaaaaaagccaatcatgcttccaaccatgtaacattatggaaaaaagcaaaactatggggacagtaaaaagatggctggtttccagggttgtggggaggaagggatgattaggtggagcacaaaggatttttagggcattgaaacagttctgtatgctactacaatggtagacatatgtcgtaattcatttgtcaaaacacagagaatgtaccaggagtgaaccctaatgtaaactatggactctgggtgatagtgatgtgtcattgtagattcctcagttattacaaatgcatcatcctggtgtgggatgttgatggtgggggaagctgtgcatgtgcgggagtagggagtatatgggaactcttctacttcccacttaattttgcagtgagcctaaaactactctaaaaaataaagtttattaatcaacaaagaacacagtgagctgcaacttcataaccagtagattgacaagaattaagaaatttaataaagaattgattagaatatggagcaacaggaactcttacacattactgatggaaaagaaaattggtatacctactttgtaaatagtttggaaatgcctagaaaagttgaatatgaccccaaaatgacctaataatgccactattaagtattgaccctaaaaaattattgttgaacgcattttttaagagataaatgcaaaaacatttgttgcagtatcatttcaacagcaaaaactggaatcaatttaaacagctctcagtggttgaatgaataaactcattttatgcaaaatgaaaataaaaatagatatgggaacaagatttactatcaagtggttttctcaactttcctctcttcttaagaatattttattttgcctgccatcaaaacttttgttccagggcatccatggtccattgtttagtttctgcactgaacaaaggctcttgatgaaggagtgagtgggagctgaaatccagccatgctctgctccccaagccatgcatttgggtgcaggctctgtctctacccagagagaggaggcatcttttacttcagatattgatgtcatctattccccaaatccagtgcttacaagtctggatctgccctgtgggaagtatttttcaaattcatctactcagcctgagcatcattttctaactcacacaaaggcattttttagattagtaggagcactgacctgttcaccacccagcctatccatcctggtacaatcctgttgtaaccaagcaggtacccaggcctttttaatgcagcagagaaataggaagtgaggcaggagggaggcaaggtgatgtcttgtcttttctttgtcatgaaaaggtcaggaaagggacagatagagtgaaagaagattggaaaataagccagagaggctcggttgttcttcataacaaaaagaagttgggggtaagtaagagaaagagccaggaaagagagccagaaaagtcccaaaggaggggtgccctggggagccctcttgtgctttatagcatgagtggctcctgtgcagttgggagaaggaagaacatcagaggggagagaaaagggaattttaagaaatattgctaagcgttatagattagataccctttaatgtaaatattcaaattcctttttataaaaaaagatatattgaaatataattgaaatacaaaaaaattgtacatattaaacatatctgattttattagtctggacatatagccagacctatgaaatcaccacaatcaagatatgaatataactatcaccccccaaagtttcttcatgtcctttttaatcccaccttccatccctcccaccctgccatcccccacctcaggtaacactgatctgcttcccgtcagtagagagtagtttgcattttctacagttttatctaaatcagccacgcagtatgcattcttgtctggcttcttttattctgcattattctgggactcattcacgttgtgtaactgaatacttcattcctttttattgctaagtagtattgtagtatttctttgtatggatataccacagtaggcttattcattcatctatttatagacaattccaacttttgactattacaaataaagctactatgccattcacatacaaatctttacgtggaaatgctttcattcctcttgggcaaatacctaggggtggaattgctggatcacatgatggatgaaaccttaactttttaagaaattgcgaatttaggattttccaaagtagatgtagcattttatacccaccagctctccattaataaattggatttcatcaaaaatttaaacttctgctccaaaagacactcttaacaaagggaaaaagcaagccacaatatgagaggaaatatttgcaaagcatctgataaaacatgtggatctaaaatatgcaaggagaataacaactctattttccactaaggaatgaatgactgtacaaggaccacattctaattaggagcttctgaacccaaaggaatttcagataaggggaaatttaggcccaaagccaggagaaggggtgagtagggcttgatctctgcctctgaagggcagagggcgtggactattcttggctcttaggggacagctagagaaatgtgggtctcatggcgacaactctggactccattggaagaaccttctaacagtcagggctcccagagataaactagacaagtcaccaagagaggcagtgggtacccctcacaggaggggtgcaaatcaaagccaaggcttggagtggaccatattaaatccatttcttatcctgtgattcttagagtcctatctgtatcaggggaaggcaggtgggttctagaactttctaaatgtgtccctgtgggtttttccttctccagctacacacaaacttgggcctaataagaagtctatggcattaacccagcaggaatgcttaatgcttatatctgacctcaaaccaagactgtctccacagtgaacaaccccgtcctgtcccctgggcgtctccttagcaaatgccatcagtcaatggtgcagccatcttggagcccttgccatctataatcttctaccgccacccccccagctgattgttttctttgtatgtctccttcctggacattacttattctttacttttaaatatttgcttccgtaaaaaaacaaatgaatgcctcggacagatttataaagaacattcctggagaggcgggtggattaattattcagcatcctctccctttgtaactatttattgtctcatatgcatttatatggtacctatcactgcagatctcgctccatgctggagacataatttccagtgactgactacttgtctaagatatatatcgtattgcaatactattttatttctgactgtaagggcacgtgccactgttgggtaattgtgttcatgtttttaaatgtgaaaaataatcaaatataacttgaaagagattgtacagtaattcaaggggatattaaaccaccaggaagttactcggcaaataaataggcgtttgtggctgtcacgctgagcaatgaggagctggctggctgtgggggagggggagacagagagaggaagacaaagaggagagtgcagtgtgagtgcctggttgccaggttagttgtgttgggggaaaggagcttctaatggccaagaatagaagacctgaagttggctagtgcgtggctagtgcctgtaatcccagcactgtgggaggccaaggtggatgattcgcttgagcccaggagttcaagactagcctgggcaacatggaaaaaccccgtctctactaaaaatacaaaaagttagccaagtgtgatgacacatgcttatagtttcagctactcgggaggctgaggtgggaggatagcttgagcccaggaggcagaggttgcagtgagcccagattgaaccactgcactccagcctgggcaacagattgagaccctattaaaaaaaaaaaaaaaaaaggaaggaaggaaggaaggagaaaagaaaaaagaaaagaaaagaaaagaaaagaaaaatgacctgaagtcactggatttccttcgaggtagccagaaacagaggaaagggggcattgcccacttagggtaaaaagtagagcaccgaattgtggaaggctgcaggttttcatgtgtgcttgcccaagtgatgttccatgtcaggctctagggtccctgcagggacagagagggactaacatttacttacatgcctatagtatgtcaggcatatacttgtgcctttatatatatcagctctgtttttgtcattaaaacatccctgtagaaagataggcactgctgtcccattttacagatggggaaacccaagctctgagtggttcagcaaaccctgggtgcatacccccaccttgcccctgcaaaaccaacaaaaaaacgaaggccctgccttcctggagctgacatttaggttgattctgaaagtcagtaggcccagattttcactcttcatttttcttgtttggaatgagagagcacacagctgggtcgggggaaggagcgagggtctaggcctgcatccactcaccccaaaggaaaggagtaggggaccagtctgctggacatgcagacagcgattggagaaaagtcagcccagctatgaaccccattcctttcagtatgagccaagagggatggcatctgtcagagttgctggatttgggattttgcatcttgccaagtgtccatgaggaattggggaaactctccccctggctggactgaggcttcagcaagcattgttgctgcccagtggtgatcagctcagtgtccttggaaaagagcagaaagtggtatcacgaacatatcttctcctttgcttccttctcctcactcttcatcatcatcatcatcatcatcatcaaatatggatctgtgaggctacctctggggttgaaacttggttttgggcaaaatttgtgatgttctctctgcccaatccagcctcaggctacaaatgaatgtaaaaatctctaatttagtgccaagtaacagaaaacagctctacttatcttaagccaaaaagagggacttctcagaggcatactaatggaggatggcaagagggcctcacgtggaaccagggcctggagcggcacagcattcaggaagctcagtctccttctctctctctctctcatctctgcttgtttccctttacctgtagacatgctatcatttttccaatatccatggcagaatgtggccaccagtaactccaggtgtataacagaagcctggcctcccaggagagggtgacttgatgcccttagctccagccttccactcccaccctgggccaagcaactggtggccaggaggagctcatattgcaggaatattgaaattttcactaaaatcatttgaatcgaggaggacatttcctagaaaaaagggtgctagtctgacaagcccacagtggtccccttcatctggcaattcatcttctgcaaaggtcacaccatccttttcgctttccaacctctgcaccagtgcccaagtctgtcactccctcctctcattctgaaacatcctctgcactccattcaccagtgccaagccttgcccttcttcagggttcaactttgtcccaccttctctgagaaggctgccctggtccctgcaaccgctatgagctgccttttctgagctcttctgctgtggaggatccatgccattgacctaggcacccgttttccacatattgagcattgctgagcacctattctgtgccaggcactgtgcttcagggccatgggggatgctccaagcggtaaaatgcaaccaaagccccgaaggagctcacattctagtcatgtccacaaagaggtaataaatccataaattgtatgtactattctagtcacaataaaattgtgtcgtactgtaatgctgggtatccattttaaaacggggggcatcggctgaatctgggtcattacagtaggaaatgcatatatataatcatttactcatgaatattaatgtatttaatgagggtaaaagatattacttaaagcaaagtattcgttccagctactgttggatttgttcattactgtttcccatgcagatattacctgtgatttacctgcatatcaagcatctggaagtagctcaaatccacctgtgggtaaattaggttagccatttgttggcaaaaattacagtgttaactaatttccagggtatgcttgcagtcagtagtttcatacttaggtacatgacttgcattcacatcatctggttaatggtgtgaacagagattttctttatggtttttggaatacagtaagataatgttaagctaacgtaagtctgttaacagtacctggttctgaactgtatttataaggtgtatcataaaaccattactttggagtttgccaatcttaaattcagaacaattcaaaaatgagccagaatctagtttgcatcattaccacttataaaaataaggatctgtaagttggctggataaaatatattacaaaataatgacttaagtggctctggagccagcacaaaagataaaaattgggtatactcaaaattaccttcaaaatatcttaagtcattcttaaaatacatgtaaatatgccaactcaaaatacatccaacaaaactaatatttttcccaatttgttggaagaaatttctctttctttagttgtgcattagatgaggaagtcagagtgcattaatattcggggccctgttgtataaaaatgacagattttcaatgtatgctaatatgcaggtcacactcggcccagtgagatgcttgcctagaggaggcacgtggaagccaaggccaaggaaggcataattcactctggagaacttctttagctggcaaagctcagtttctccccggatcccattttgctctggttgaattcgcatgcaccaaaccaagaccaaagagtttatgatgtggttcccgccaccgttggccaatagcaatttctaggcccaccttcaccaaggcaggtcctagatgtgttgctaggcatttggagtttactgagatctgcaaagctgacttcttccccagtttcaggtggttcaggctgttcttgcctctccttggtgtgtcagagtagaggagaaatgactttcagtgctgggaccataaccctgtttccactccacttctgacttgcactgtgggctgagaattgacattctgcttggggaaattttgttcccccaaccgtagcaaagtttaattaccatgttcccgctgtggggggaaatcctattcaagaaaccagcctctctcaaatcaatcagtcatcttgctcattgaccaatggttcggccacccggcaagaaattagaaaaatctatgcataggagaaagctttccaacagccctggaaaggccttgggccccaaagggctagtatgaggttgaggtgggggagagcaagagaggacaaaacaggctgggtactgaccttcctcgtactccatggctcagaactctgacctcttgccaacctgccttccgcaagcagcgagagtagcacggctctgaggggcatggccagggaggatgtgacctctaagtgctccaagtcactgggaaccctgttctaataataggcaaagcttcagttgatggagtgcctatatgggcccagccctgtgaacagcttcctctcagttttcccagaatgaagctcagtgcacacactaagtgtgcaagaaacacacaagaattaattgcaattttaagtccttgtgacaatcccaggcctgcatctgcagggagttttatgaaggctgtttatagaattgcgggaggggttaagagaaagacaagagagtgtgaaatgccccagaactagtagcaggaagctactaccatccctgagcctgaaggacagaacccagagagacagacctgtgctgtaggtcagggccccccagtgtgagcctcagctgccgctgccagtccccaactcaacaggagagagctggacaataaagaccctgtgagcacccacaacttcccattggctgcatcctgttagaatctagaggtcatgggagcctgggagaggccacccatgaagatcagcttccaggggcagagagcagagtggacatggaggggcaaatggggaccgtccagcacagtcaccatctcatagacattttcctccacctcctacctcgagtagccagtagggttccagccggactgtggagcatcatcccaacaactgcatggctgcttcccactgtccctttaacagcgcacatgggagggagccacaggtcagcaaggcccttggctcccgctgtggccctcacccatgcccatccccacccgtccccatgctcagcacatcagcttcactctggctgaccatgtgcacagacatgactcagtaagtctgtcttttcttttcttttttctttctttctttttttttttttttttgagactgagcctcactctgttgcccaggctggagtgcagtggcatgatctcagctcactgcaacctccacctcccgggttcaagcaattctcctgcctcagcctcctgagtagctggaactacaggcatgagccaccatgcctggctaatttttgtatttttagtagagatggggtttcaccatgttggccacgctggtcttgaactcctgacctcaggtgatctgagcacctcgatctcccaaagtcctgggattacaggtgtgagtcaccatgcccagccaactcagtaagtcttttgaatgtgagcggaggcccccactcagcatttccaagacctgggaaatgagggtgaggagggggccaagagctctgatttcaagtcccagccctgccacccattccttagggcaggcacccaccaccgccttggctcaggcctcagtttccatctggaaggtgctggctgccttgatgggcctctatgggccctccagctctgtggctccatgtcaaatgcccctgaccacccttgagattaaccctttcccaaggatagacagcttcccccatcattctagatccctcacacttccccagctcctacggaaataacctatcccatcccctaagatctgcaactgttgagggtaagtttttggttaaaaagagtgagacagactttggcgctagtgcaaaacaagctgctgctgtaagagtgcatgtgtgtacctgcagactggtgcaatcagatgaccttcccaccaggctgcacagcactggatgtcctcacagtcactcagccactcagcaaactttgactgcacagcaacccatgccagacctgctgctggactccaggcatgttgagaaatgaatataatacccaggctatggcctcaaaaccttcaaaacccagggcaggacacagacagggacacagatgtgatacctgctgggatacagtcctcatgaggctctctaagaggtatctaagcagggacctagagggaggaggtattacctgagttgaacctaatggaaaggcattgcaggcagagggatcagtataagcaaatactcagaccaaaaacaatggcatgggggactccaccaaagaagtaaaagagaatagggtgctacatggtgtctcagtcccttttctgttgcttagaacactgaaactaggcaatttataaagaaaaggaatttatttcttatggttatggaggcttggaagtcccaggttgagggagcacatctggtgagcccttcttgctgggggcaggtactccctgcatagtcccaaagcagcataaggcatcatatggtgagggggctgagtgcactagctcaggtttctcctaaaaacccaccagtcccactccccaaataatccattaattcattcacccacaaatttattaacctcttaaaggtcctacctcgcaatactgccacattggagattgagtttcaacatgagtttttgaggggaaaagtattcaaactatagctcacagagatcgcttttcctagagatggcagatgaattttggaggtagagggagaggggcagatcacacagatctcatagtgtgtacaaacctgcccttcctgccggtggtgggcagctgaggaagggtctgtctcatgaaccattaaggctgcagagtctagcacagcatccaggccacagcaaaagcatgagacatacttggtgagtgagcaagagaatggaagaagaaatcaatggagccaaatgactccaccagatttgcatttgagacggtcactgcaagactgcaccagtcccaaattcccaagacagcaatgttttccacgatgggtctgaacatgtaaccattctcaggttcctgttgggggtttgggagcctagaaactgagacagcctcacagctgacagatcacgagcagccatctaagtcgacgtttccaaagtcatggggcctatggtttgtgagcttatttaggttgtccccgggcccagcatcaaaagcattgagacacgtactgagggactcttttcctagcctctcagtcctgactgctcaaggaccaagtggtacttcttgcctgcgttcctttaatgcttgcctaatatgagctagtcttctctgatcacttttttttttaatccaaagtaggtgggcattgtcccaagagcctttggaaagcagctgcctctcactaggacttcacagcatcattttgctttgctctctttgtggttaaaattaccttccattcgtggtgggtgtatgtcaggatccccacaagaaacagagggacacccaaattagggacatacttcagagggactaatgacaaaggcatgggtgggagtagaggggaatacaagggagacttcaagaatcttggcctttattataaatgcaatgtatgtccactatggaaaatttggggaaaaaagcaaactagaaagaagaaaaaccacattgcctgaattcctactgcatggagagaagcatcataaacaccttttggaggagtctcttcttcctttctccctttctccttctttgtatagagaggtctttcctgaggacttcccagaatcttgcagatccaaaatcttaagaatttgcagaggcagtgaggagttaacatgcacagctcagggaatattctgctttttatctggaaccaggctcggaacaagactccttgcttttctgtcctgtgttttcatcttctctcagaaccctaactttgagataagatctttgactattattaggcgggtgcaaaagtaattgtagtttttggcattatttttaatagaactgcttctgtgtcctcagatctccatcgttcatctcctgataagtccctgaaaatttcctggccccttggagctccttccaggagtagaatgatcacaagagctgccatgtattgcttattctggcctatttccttaggcacattagcccatctaaccgtttccatggcccacagaggtgggaggagcatgaagaaaaatgcaaggaaataagctcatctcaaggtatctctggctcccaaagaacataggacattaccaacttgaagttagcttctcaggaaactaagacccagctgcttttcaaatcctcaaaatattagtatgaattatagatatagttatagccttcagaacttctggcacagcccaaaactgttggctgtaaaaccatgtttcctaaattcaatcatgtttctcattgatttccattttgaaattggaagtctttgccctcaagatataataaaaaccataccaaagaaaatggaaaacttttcccccttaatatttaaaggagaatgatttttataaaaaaaaaaaaaaacattcatttgtctacttaaagtaaatcacagtgcagtgccagtctgggtttggagcataacactttttttgatttatggtttctgccaggagacacccagctaatgatatttgttcctatgtccttctctgactagctgggtggcagctaaagagctagggtgaggggagaccagaactccaggcctgtcccatgttcctgtctcacccatatgtggatttcaaccctgggcttagtgtctgcctctagcgacatgggaagagagggatgggtcctctccttcttcttgtcaaatggcccccagagtcccaccaaggtggagctccaggctcctgaccagcggggctccccaaccctcctgctgtgcccagtctatccctccttccacgcccagcagagctcagcagacttgcccttggccactcttgtgccttcactgctgtgtgtcctggacaggagccagcgtgggcttgctgatcacagagaaagctcacgtggcaaaagaaccagtgagattaacaagtcgaggtttgggatatatcttagagatggagccaatggggcctgcagaggatttccctggggactggaagggtgaggaaggagaatgctctcagatgacacctaggtggctgatgtgatagaatgggcattttctggaagatctgttcaggggcatttggtgagacagaaatcaagggtttggcttgggacctgatatgtttgatcaccctgtcagccacccaggtggagaggttgaggagatggctgatggcatgggtctggagctcaaaggagaggctgggtgaggcttgagttacacatttgagggcatccatgatgtgaagcacatgggggggcccacacaggggtctgtgtgttcccctgtggtgtgtgtggggacacgtgagtatgtgtttctgcgtgtacattgacatgcatgactcagaatgtcacatccatcacaatttcctgtctgaccttggctgaggtatgtctgagttttaatggcctgtaaaatgagggggtgatattagatggcatctgagacccttgccaactccacaattctaggagttggggaatcccaaagatgctgccatccctggtttgtttgggtgaacaggaacagagaagtcttaagaccacaagcagtgaggttagatgcgagttctgcacctcccctggggccttcagcagctgcattcttggcccagcagaggacttgcctgatctccaggatagcaaaggagctgaggccaaaaagacacatgggctactgctcacccagccccatattatacccttttcatcgctgcaattcaacataaaatcatatcattcacacctacccactcatgcattcattcagcacatgctcatttttgaaccggcaaatatatattagatatcgatgctgtgctgaatgccacagattgcaacaggaatcagacgccaacctgtcccggaggagctcacacatctttccaaaaccaatttctacttcttgggtcccctctcaatgtgtacaacatagagctttccttgcaaggctcgagcacaacgcagcagtcactccttgtctccaggcctggctgtagacacaatggaggctcctccttgccatctgcactccagtcaggggaggacaccaatccactaccaaatgaccatagccagcatttactgaatgtagacacactgtaggtagcagatttcaggcacccaatccaggtattgcaggaaggtagcttctatttttctataactgaacttgacttctttcttgggtcctcattctgctgggcatggatattttagttttagtttatttggggtaagctcagccagtgcaaagagtttgcagtctaggtagggtgttctttcccttctcttcccactagagaatttataaggtgccctggcactgttgagggaggagctacccgggggaggaatgaccctccgtcactgaaggctgtgctggaatcacatttcctctgtctccagccctgagtccaccaaagcatccatttcttccaggtttaaccacaaggcctttccaagactgcccaggtctccgctcatccttctccaggagatgctaatctctcggagaatctcctctccaatctgaggactggggcctttcctgccttcctgccaccaaacaggcctggagtggaggagagccagaagccttgccacctccccaggctacatccaggaagaggcaccaagcccacttgtcctgaatctcaaagcctacttaagagcttaggttctgttgtcacaagatcatgggcacaagccctcgcctggttctagagagagtggggtcagaaacactctcagcatttgagtctctttctcctcctctgtctatcctcctttccctctggcccagagaatcttcctccactccctggagaaaaacctatcccacacaccctcacatattcttcaagatctattggttaaggcatccaacttattgcttaagcatttcaaggactggactttggaaagccaagaatctgagttgcaaagtcttccttaaaactcaaaaactgggctcataggtgctcttctctttttcttggcatttgcctaaaagccaccctgaggacacctaggagaggccacctcaccacttcttgaaccaggcatgggggatggggaagaagacactggggaaaagctctgagtggtacttcagatcatcctgcctcaggtgttggttctgatcctctcaacgactcccaagggaatatgtcagctccattttgcagactgaaacccgagtctcggaatgacttgtccatggtcacacagttgctaaacatctgagccagagtgaaactctggggtatttgactttaaagtcccagcctttaaatcatcccacacttgcttattccaacttggacttgccggagtcccatagacagaggctactctcccaccgtgctgaagctggtgcatgccatgtttcagtaagagaaaggagggtgcctgggcttcgtctccacccaggtgcctctcccccagcagctgcaccaggccagctgagggggattttagcccgaatccagggtttctcctacagaagacaaggagtttgggcactgccagaattagaagaacagaaagaaaatgttctggatttctcatcaaatgcccctagcctgagaaatataactaaattcacccttaggtcatcttacaatctgtcctgccccagtgttccccactcagggaactgctccacccacatcctggtccccaaaccagaggcctgggagtcacccttgacatttcctcccctacacccctaatcaatcaaatcctgtttatcctgccctctgagagtctgcaccgaaatctctctcctctccttcccacctaccatggcccagcagctttaccatcatgtctcacggatctctgcaccgctcccaactggcctgtgcgttcactcctgccccctcctccagccctgtgtacactcccttccaccatcctttctatactctcctcaatcctatctgcaccctccttcaaccctgtctgtactctcctccaatcctgtccacacactccaaacaaagtcatatttccaagacaaatttgaccatgccactttctcccacagctctccaccacctccaggatcccatcctcagtgttagccagacactcccaaggccttgtgatctgccctgcctatgtctccagcctcatcctgcaactccccctacactctgtgttctggccatcaaaccaatgggctcctcttcctgcacccccatccactcttgcacatcctgcactctatgtctgaacagctcggtttctcttcttttcttctggcacatgtctgctctacctgcaggtcatcttagatgtcacttctcctaggaaggctttcctaacctccaaaacaggctcagttcccctcttcaattctcactgagcctcctccctagcatttccctctctgcattataattcctccctgtgcaagtgctcatctccccactgcactataagatctaggagggtagagtctgggtcccattcgtttctgtaccctcagtatttagtagagatggggtttcaccatgttgcccaggctggtctcgaactccagagctcaggcaatccacccgcttcagcctttcaaagtgctaggattacaggcatgagccaccactcccggccctctgcattcttctatttaaaactatttattgagatctactattggctagatttcggggatgaaaaaggcagacaaggcgccctgccctcaaggggttttcagtttagtggggagcaaagcaaaaagacaaacaaacagttaaatataacatctagtagtgataaatactccaaagaaaactaaagcaggggccagagagcatgggggcattgatgttttagacaaggtggtaaagggaggtctctctacagaggtggtatttcagcagcagcccgagcactcagtaggtccatggtaaaatttagttgactcccgaactaactgagtgtctcactcagtgaaagcctctaatccattttgctagaagtctttccctgtagctcattttgttccaagtcacaagcatcaggcttggaagacctgtgtgggagagtaattaacctaatacacagcgcggggaatggaagcccgaacccccagaagccttttctgcaaaaggaccagggcttgggtaataaaatggggctttcattctcattaatggggcaattgatttaaagaacagacccagtggcttattgatcagtgttaatcattagaaaatgctgacttaatgaatctaactgccatgaggcccctgtgggatttgggaaggccagttagatacaataactttgtccccttccagtccagcagacagatttatttacagaaatctggattttttttttctggaaaaaaagtcaaagagtcactgggggttaagccatttctccagctgatctgagagatcatcccaagcctttgtaatacgcctgtctctcctgccatgctctgttcctatctagcttttcaaaacaaactcttcattttagaatagttttaaattatagttagagaaaaacttcaaagatagtaagagagttcccatatcctgcacacctggtgagccccattggtaacagcttaggttaacactgtcaccactaatggacaaatgttgcaatattattatttgctcaagtccatacttaactcagacttccttagtttttacctgaagtcctttttctagttcaggatcccacattccatttcgtaggcatgtctccttagactcttcttggctgtgacagtttcttaggcttccctctgttttgataaccttgacaatattaaggagatattgggcagatgactgtagaatgtccctcaactgggtcttatctgaagtttttctgatgattgcactggggtttggggaggaagagcacagaggtaaagtaccattcacatcacatcatttgaagagtgcatgttatcaacacgacctatcactgctgatggtgacctcgatcacctggctaagattgtgtttgtcaggtttctctgctgtgaagtcattttcctccctcccctcttacacactgggctctttggaaggaagtcactgtgtgcaactcacactgaaggagtgggaagttagagatcctccttgagcgtgggccatcttcatgaattattgggaattattctgcataagagatttgtttatattaatatgagctcatggatatttatgttgacactttgggttataatccaatagtattttacttcttttcttgctcaaattactccacctttgggtactggggctcttgcagttggctcctatgtccccgtcattgaggggtttgggttttgtgtgtgtttgcgtgtgtgtgtgtttgagcacttctttactgttggcaccaaaagatgcttaggcttgctttgagcatctcctgccctggccctggagccactccaaggaacctccaagaacgcctgattccttttattactggctcctattataattttcataatgggctgtcattttgttttgtctggttttgtttataattataagggtaagtcagctcattgcataaaatatagcaaagatataaaagaataagaatgaaaataagtatcccaaataatccaagcagcaaagaaatccagcgttaacattttggggtattttcatctggtctttttgctagttgctggctcttaagaagtctgtgctttcattcttgatctctgccagaccaagggatatcatgggccctggtttacctccctgtcccagcatctgtggttggagcagcttccatttggccatcctcaggtggtctgctcgctgggcccctgcccacttctccctccagcagaccgcaggccaagaggccaggagccagggtgtgtcctccagcagactctgaggaagtgaatacatcactgttctgtgacttccaacgtgatagttggcctcattttcctcttctttacgaagtaaatgcgataatatatacaaagtgctcagagaaaggcctggtaagaaacaggtattttaaaaagtaaaaactgtcggctgggcgtggtggctcacgcctataatcccaacactttgagaggccgaggtgggcggatcacgaggtcaggagtttgaaaccggcctgaccaatgttggagaaaccccttctctattaaaaatataaaataagctgggcggggtggcaggcacctgtaatcccagctacccgggaggctgaggcaggagaattgcttgaacctgggaggcagaagttgcagtgagccaagatcgtgccattgcactccagcctgagcaacaagagtgaaactccgtctcaaaaaaaaaaaaaagtaaaaactgtcattattataaccataattactattagcaatctgaagaaacacatatctaatgatagaagttcaggcatagtgtggcaggcaggcccctgggagggatgaatttgcacaagcaaactgccttctccatggagacctaatgaaattcatccggtccttcttgagagtttgactgagttgggaactgtgtctccaccagaccagcaaatggaagagaagtttcctggggctctagctgaagagtgtgtactgaggggcagtattgcattgtggttgagaacatgggctctagagccaggctgctcaggttcaatgcccagctccatcacttacctgctgggcagcagcctgagttatttaaacctcactaggcacaatgtaaggataacaatattgactatcccataaggttgctggggatgccaaataagttcacaaatggaagaactttacacagtacctagcacagagtaagcagccaattaatattactcgagttactgtttttattacttcatcattcgggactcttccggttgcaagtacaaggaaagccaacccagaatcacttaaacaaaagggaatttattggctcatgtaactgaacttcaacattttacagaatctcattggctccaatgggctcatacgtccatccccaaaccaatcacagtgactgagggattatccaaggatcacactggccactttcacaggttttatccctaaaggaaatcacaggtaatagatgtggggctgcagaaatgcaacatgcacttttccttgaaactgcatcccttttccctgaagatgaagcttgaaagaactctaagaggttaagcatggagctgatgggcaagccacaggcagaaagagtagctgtgcagccaggctcctggccagggagggcagataaggaggggaggcaaagtttggtaaacaggaagctaatctatgggcaagaatcattttcttcagcatcctgacctctcctaaaatgttctccactggtccctgctaggacaaaggaattaccaccagactagagtcaggagtcctgggctggttctgctgtatgacacaggacaggtggcttgcctggtctgggccacagcctcctcccctgttgatgagcatgttggttgttccagcaccatgtcagccctagaaatctctgaattcttgaccagatcagtaattgctctcttgcgtttacttttccttcaaataaagagattggcatacaggggaggagcccagtacagacggcatgcttggctcaggttccagaacccagaaaccagacaagagttgggaaaccatgatggtggaggagggtgtgccactccttactagtgcctaatctcttcgagacactaatgtttcagtattatccacagattctgatgccaggcagcccagatgactggggtcagttattagcatgcttcctggaggtggttcccaggtgcaggctacctgcagtctggctggatgggccctgcaccacacttgcttctgggaagctggttttggggttgccacaatctctgaaagaatcactaggccaccctctgagtgggtccttctgtaggaattatggataaaattgttccactagtcttaccttcttggggaacccttcctggattcccaggctgggctgggtgtccctgcagcctagccccacagccctcctgcttctctttctcatcacagtcttgttatctctaccaactgtaggcctgccccactgatggtgtgaataaagggactgggtctctctagcacctagcatagatctgatacatagtgggtgatctctattgaatgaacgatgaatgaatgaatgaatgaatacatttagataattcagattactctttctagctcagcagtgtaaagcaggaagacatgctgtcaatatgatttagggcaagttttcaaatctctctggacctcagttttacctcttgaaaaataaatataataatttgtccttacttcatgagactattttgaagattaaatgagataatgtatacactactactcactgtccttacttgaatattcctaggtccttggtgctacattaggctacatagaatgtatttaaagtaatagagtggtatttaataaatattcattttctttccccagaactaccttaaattaatttgttgaaaggacagatggatggatggttgatggaagtagcaggcttccagcagcaggggatggagtgagtgtgtggataccgctggatcagcagaaggttataccattttagagtaactatctcggacttcggagagttcctgggtatgaaggtttggctttaattaaagtctcagcacagtgttaaatgccattttattttaggtcataattaacactaatgagatgagtggattacaaagagcacacattttgagaaagtgaaaaacaacatctgagcttggtggtttccattttcgcttttccccctcccatgctctgttcaattaaaagttttgagaaaatattacaaccatactccttgtctttgtggtaatgaagcatattaatttgaatgtgatgaatacaatattccactgacttttttattcccttatctacaaaagtttaaaataatggaccaattaaaccaggagagaagaatgcagggtttgcctggggatccaattcagcaaccagagaactgaaagaacaaaattttttgacggagtctgggccagacttcatcccttacctatagctgacaaacagtaagtcaaattgggcagatgtggaccagcgcagaacacatactatattgaggatcgaaaggccaggttccagaccgtcctctaatattttcttagtgaatatttgttggatgaatgcatggatgggtggatgaatagatggatggatggacagatggacggagagagagatggatgaatggattgttggatgaagttgaaagatgaaggtagatgacctcccatggtctgattcttcctaaggtagcaaattaagcctaggatgggctgacctaacccttccaaggacttagaagtcagggcaagaacttacagggaagggttcagttctctgacctcactaccctagaggcataaactataaattatagagttggcctgagctcagtttccctgggagctctgctctaaagcagagccccttgaccctgcaccaatttggttaacccgagtaaggctgagcttcccccagcaggagctcctgctttggaagagaacatcctgggccaggcgcagtggctcacgcctgtaatcccagcactttgggaggctgaagcgggtggaccgcctgagctcaggagttcaagaccaccctgggcaacatggtgaaaccccatctctactaaaatacaaaaatttagccaggtgtggtgatgcagcacacctgcagtcccagctactcaggagactgaggcaggagaattgcttgagcctgggaggtggaggttgcagtgagctgagatcacaccactgcactccagcctgggcgacagagtgagactctgtctcaaaaaacaaaaaaaaaaataaaaaaaaaagaagaggacatctggagcaggcctgtgaacctgacacatggtccaggtgtctccctgaggacttctggaagtctccccacctctctgtggtcctttaggcattaacaccaccttgtcactgtgtcttctgaggcagtctggaagttcataccccacaatctctgtgtaccttgtcccccattctgttctctgcattgcagatggtttaaaacacacacacatacacgcgcaaaatgttgttccttttcttaaaacccattgtggccaggctagacaaatccttaacacggtctacaatattctgcatggcatggcccctgggtgcctcccaacctgatctgtcacacaccacctccacctttgcctgttccctgggccctagcactaacctttggttcattcctagacaccttttcagcacttaggcccccacagccctcagaacctttacacttgctgtctcttttgctttaaatgttcttgccccacctaccacctagttaatgccttttcctccttcagctcttagttgaagcatcacttcctcaaggagggcagccctgatgaaactcattatgcaaactccagcctgggttgggccttatctttatgctgtcatggccctgagtattcttcctttatggcaccaatcacggcttatatgatatacttatgctattatttgagttatgtctgtctcccccagtatgccactagtattagaatcattgatttttaatcattgtatccctagtgcttagcacagagcctggctcataatagatgcttaataaatatttgttgaataaatgaatgagtgaatgaataaatgcctcattcaagagctttggctctttctgtactactacattacttctattttttagctcttaattctcaaagcactttctttgtgctgggcttatgctgggagcttagacagtaaagcttagatggtaaactacagttgctctcaagcagttcacaatgtaacaaaaaagagacacaaatacacagtgacaatacagtgtgtcgagtgctacaatagatggaggggtgcagttttatggatgtggagaagaaatccttctattcctcactggaggcttcactaaggagatattccctaagctgcttctggaaggaaaaggtattggccaagaaaataagggtggaggcagaatttcaggtgaaaggaccagcatatgcaaaggctcagagggcagagcctggcactggaaacaaaatgcaagtcacttcgtggactgagacctggatgaggacatggggctatgagagatgaggctggggagggagacaggggccagatcacagaggcctttcaatgacagcaacatatggcagctgcagagacagcatggaagggactggcatggtgagacctgtgatatggagaactccctctcgaaggggttcagaaaagagatgtccatatttcaagtgaaggacttcctcccctggagaaactgaggctctgccccagggctgtccatcagactccttcccagaatccaaacgcttccaaaggatgttcagtgtggctgaccttgcttattcattgtggggagaattaatttcagggtggagaattttaaaaaaatataagattaagcagtgtaatcagctgctgctgagagttgcaaatgcaataaataataatagcattgagagctgtttttaataactcaccagtgtaatttagcctcggcttcttagagcatatttaaaatatgtcatagtgtgtctaatggcaaatgcctcattgccagcctctgaagacaaatgtcttcccaggagggaggggggcagaaaatagaggagaaattggaggatttgattgcaaacagggtgtaggaaggcaagcattgttcattctgacaccactaattcaaaatctgtgatctttgcctaggcaataggttttagttggtttgtcttcaagggtgaaacagatggatagcaataatatggtaaaggagatatttataatttgtaagagaagaggttgttttcagaatctatagaatcaccattttcatgcagtccatattctaattacagatcatcctggactatctattatagcaggtccccaggcaactgatatcttgacaacatttgttttacttagttgagttactaaatattcatgataccatgaaaatgtgttatttaaaagtgttcgatgaattctgagttttagtaattcatatgtgctgtccccgcccaaccccgattagtctaaactggtgagatggggctaggagtcctcccctcttgggtaacagacttgacacagttaaagtgagacaaactttggagtcagacagacctgagttcaaattctagttctaccacttactagctgtgaccttttgcagcttaaacactgaggctctattcccgatctgttaagtgagagtggtgatgatgacgaccatgacagctaatatttatggatcgcctattgtgttatctccaacacaacgatacagtgacgtaggtctaccatggttcctgtttcacagatgaggaaacttgaagcttagcgagctcaagtaactttcctgaggcacagggctagtgaataaccactctgggacctagtatctgttctagctggtttcaaagcctatgctgttaagtgggctctgatactatcttgtacagttgggggaagatttgagaagacatgtgtaaggtatagttcctggtatgtaattaggactttataaatatctcttatatggaaggactgaatgtatcttcctgggctgtgtcctcgcagggagatataacatctatgtcactctcaacgctttattaatgtccctgtcactctatacccttgtccaagttactccacaccctccaaagcctcaagtttttaatctgtaaaatggtggtgggcggaggtggggagtgagcgctcttacacatactactaggttgggggtaaattagtaaaacaactttgggaaacaatttggcaagacttagtaaaaggtgcatagatcctgtgacacagcagttttattcctgggataaatgctaaagcaggttgtctccatctctgcactactgacatcctgggacagatatttcattgtgatgggggctgttctgggcattgtaggggatttagcagcatacctggcaatttattcccaagaggaaagcaatgaggaaggaaggaaggaaggaaggaaggaaggaaggaaggaaggaaggaaggaagggagggagggagggagggagggagggaaggagggaaatatttaatagttaagttacatccacaggtttgattataaatgtgtgtattgaattggaatttctgttgaaattctgatcccttctagacaaagaaggtaaaaattgaaacatgtcaatggatatctaaatatcattactcactggctttatttgcaaatggctttccattgacaacagttacattttgttcaaagcaacaaatgattggcgctgacaatccacaggaacatggtgcagtcattaatgaatgtgctcattattcctccctgccgggaggcatcgactcccgttctccagcctgttttaagcagacagacctacatctgcacctgtcagcttggaaccctagtaggggagggggatgctgatgtgatggagaatgaagaatgggccctgcaggctgacattttgggagagtaggttctgaaatttatcccaaaggacatggaatcctggaagcagggttcaagatcctcccaaaattgatctcccaggatgcttggaatgattgttccgagggttttgtaaaatgccaggggaaaaccaggaagcttctctccagttgtcttgcctccttcctctccagtctccatggagctgactttgagaattaactcctgagggacagagaccctgggatggagagccagccctgctggattccacaaggtgctgcttaaagcacaacacctcttcccaatgacaggttctgaaagaaggccttgtagctagatgcacagagggttttgttttgtttttttttttttaacctttcagcatctgtctaaaattgctctgggctgggtacagtggctcccacctgtaatcccaacactttgagagctgaggcaggaggatcgcttgagcccaggcgttctagaccagcctgggcaatatagtgagatctctatgtctagaatgttttttaattagctgggcttgctgcctgcacctgtaattccagctacttgggaggctaaggtggggggatcactcgagcccagggggctgaggctgcagtgaaccatgattacaccactgaactccagcctgggcaacagagtgagaccctgtctcaaaaaatatatatatataaataaataaataaaaataaatggccaggtgcagtagttcatgcctgtaatcctggcactttgggaggccaaggcaggcggatcacgaggtcaggagatcaagaccaccctggccaacacggtgaaaccctgtctctcctaaaaaatacaaaaatattagccgggcatggtggcacgcacctgtagtcccagctactcaggaggctgaggcaggggaatcacttgaacccaggaggcggaggttgcagtgagccgagattgtgccactgcactccagcctggcaacagagcaagcccccatctctaaaataaaataaattgctctgtaagttgacaccactaaaaacatcattagtagttgtaataattaagataaaggagaaaactgtgcagagcccagcacagtgcctgctccatggaaaatcctaatgacatttagtttccctctctttgcccccattttcttatctataaaacagaaataatgctgtatcctaactcaaaagttgattatggagagtggcatagtattgtttcaacaaatatttattgagaaactgcaacacgcaaatagatgtaaaaggttgaacagaactttgcaaattaaaaatcctaaaggacattttagaccttatgaacttcctaataggtaagactttttaatctatctgcagtgtccaacaggtgcaagagcttgggcggactgtgaatatctaagaaaagagagagagcagaaaggagggaggaagatgaaagaaggaagggaggaagatgaaagaaggaagggaggaagaagggagggagggagcgagggaggcgggggagggagagaagggggaggtagggagggaaagaaggaaggaaaggaaaggaaaggaaaggaaaggaaaggaaaggaaaggaaaggattacaggtgggagggagggaggaagggagatatcattattattgtgcaattgttatcattatataactaatttaaacaaacccatcctgtgcccacaaaagggcaccaagataaaggctaagataaagaacacacgaatcattttcccattttcgtcagtgatgggaatggtaatgattttctctctgaaccataaccatcttgcagttaaataattgctttctgatagaatcaggagctctgagatggtgctctgaggagttctttcatttctttcgcaccttttaaagaaaagaaaacttcaagtgcaattattggcattattttaataccgactgcagcagaacattctggaaaatgaggcccctatcaaattagtttttccaaatgaggtttagacagtaccttaccaggagaaccactcagaaagcccccatggcagcagcaagccctgttgagtcaagggcacatggatgtcacactgcacatgtgttttcagataactaagtgaactgctccgatcttgtgggtcattgcaccacggggcctctccatttacttcaggttacacagcaacaagcaagctgagagcagcagaagtagctagctaaaattgcatttgattttgtgactgctagaggccaatactcaagtgaagtttaagcaaaaacaaatcatactcagctgaaaacatttgcctggaagaaagatctgtggctggagaattggagttcatgcacccagcaatttccagaggaagtctgattcccctacctgaagtaacactccttcctctccccagatccagatctccagactatacgtactcaatatatgacttgtccatggggcccagctgagcattattgcctctagcttatggttaataataacagtaataattatactaatattattctttctatgcataattactaattcatcttaatctcacaactctatgaagtacatactgtgaatgtctctgttttacaggtgagaaaacttaggcacagagaagttaagtaactcatcatagtcacagagctaagtaggaggcagagttaagagtcaatgtaggcttctgacccagagattgtgctctggacctctgtgccacactcccacttactgggtatcagggactgtgctgagcagtttatggcatcatctcattttgttattgtaacaaccctatgctatgggtatcagtattattcccaggtaaggaaactggctccttttggagcttgagtgacttatcgtggtcacacatctagtaagtggcagagataaaattgaaacccagagctaaaattgtttggcaaaaacttggcatttgtgattgtgaccatcttggtttccaagacgcctgggggactctgcagaccatggccagtattcatttgtcaagatgcaaggacctaaactggaatccagtcttttatgatgtctggatcataacaaaagtcaggtatctgctccatgaggccagctaatccccccacaaccccacatccccctgacacacatcatcctcacctagagaaaccttttcacaaataatcaaacctttgtttctttaaggcaaatggacctaaggggaaaaaaaaatgcctgtcagtattgataaggaattgaagaggaccaacaatgtgaagattcttggccaaaaaaataaaatagtaatttgggacaaatttagtaagagaaatatcagaatctatgcaggctcacatctccaatacaaacatattcaccttacactctatatggaaatagtaaagagcaatttgtgaaatagattccatgagtgccccaattagggcaaacatttctcatcaaatgaaggatggaacttcaataaagatttcaaagctggttacatgtagagagatttgtgaagaaaccttgtagctctgatggaactgggatgtgagaagaaggcaggttttctgataaacaattcctgtatctttcacaaatgccaaatcacagactcagcttgggacatatgaggacagcacagactttggaggcaggtagattttgggttgtcacgcagacacccactactatgagacctggatttccttctgacgttattggggataagaagtggcacctcaccatttctaggaaatagtaggtaagtctttctggttgccactgaggtgactcacctgagacacagttgctcctaaagttcaaggttaggagacaatccagaaggggagctgtctgtgaagtcagaattcttggaagaatgtaagtctttacacagtaacagcaaagcagacagtgggaaccactactctgccttcttgcatcattctttcctagaaataccagaaagcagtgagggattaagtctaattcctggcacctgaccttatatctaacagatgctcagtattacctgttgatgggacctcactgggaatgttttgtgtgcagtacaaaagggcaatagatgaaactttgggacgggagcccaggaaaatggctgagaggagagcttatgcctagcttatgcatgagcttgcaaaaagggagaatacacgggagggaagatcagcaacagcatgagttttataaggcagagagttgttgggaaggaagcagcagggagaggggaaggagtaagtagaaacctagaagagatacagctaagataagccaagagaacaaagtattgacttaccagaaacatggaagtcttcctgcttctaatttagttccgcatatctggatatgtgaatgcctaaaatcccattaagcccagtgggttaattattacacttgctagggccccagaggagaggaaacacagtaagtcagaaaaacctctgggcaggtgaatttctcaggttttcttctgggcagatgggatctggaatggtagcgtggcatcctggtaattcagagacagtggggagggtgaagaaacactgatgtgtagcatttctgtggtgtcaacaccctaccatggctgatttcaagctgacaaaggtttagcaactgccttgctgatttcctgaaaatttaacaattagttttcatgagatgcagtgggctgaccccaggacatcactgcctacacgccaatgagaatggagattgacacaaagaacagagtggagagacacagagcagggaagacaagattttcccgagtctcaatccaatatgtagactatgtctcccttttcacaaagaaggaaggggaggagagaccagcattcacattcagttattgttgttttaaatccattacgcacatacataggagaaaatttcagcaacagtcaccctctgaacccagttcctcagttctctccagaggcaactaaaatgctcaattattagtgtatccttttggaaatattttatgtatatgacagtgtgtgtgtgtgtgtgtgtgtgtgtgtgtgtgtgttcctttccaatattaaaataatattaacattggtaatagtggtactaaacaacttagggtgttttttttttcatttaatagtatatttttagtatctttccaggaaaagatacatggatgtgccacattatttttaatggctcacatggtactccttttatgtatgcactataatttatggaaccagttttctcaccgatgagcatgtaagttctttcagtcttttactgttataaacgaatgatgcaatgaatatccttgtacatatatatttgtgcgcatatgtaggtatccttacaagtggaatttctgaataaatggatatatacaatttatttatgaatttaccttcctacaagtgattcaagagagtgtctttgctccacagtgttgtcaatatagtgtattctcaaaatctgacaccaatatgtgtgaagtgcctgctctgttcccacactttacacaggttctcttatttgcgttaagtttatttaagaagaggaaactgggcctcatggagatctaggaacttgcccaaggacaggtctctgtgactctaagagtgcaatcttcccttttccccatgtcaagcacctttccccaccaggctcactgctgacaatccagtgtacgaagaagggaaattacccccacagagcccaaaagtttaggacatgccgacagcatcactcttttgcctcctcattctctctttcatttccagaacatttgctcactcagtgctgcccagtgatacttagccagcctgattacccatctaataatttctgatactaatataaaaccttcccaaagacaaatataactgagacgcactccagcttaccatagctttcctggtggtacagtttccagggacatttcactgtgtcaaagcagggaccacatatgttccagaccagcttgttgggtttttcactgggaagtgaagacaaattgttgtccctttgaaaaagcatctttcatctctccatctatctgcgatctaaagcaatggggctctttctgtatgtctttcaaatggtctacactgacacacgttttctctgagctgccgagagaatatgccatgagatgttgccagtgatggttacactcagctagcagaagattagggactggttaaacctttggagaaattgccttgggaaaagaggaaataaaagcaaatattactatgaaacatagagattaccaggtaggaggaggagagaggtggagggaggggtaggagtggaaggaagggagggaggcagaaagaggaaggcagactggtggaaaataaaccgtgcactttagaacagcaggaagggaggcttggaagcctggttttctggctttgaatgaccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccgagagatttgaaaaagccgggctgaaacagcgtggtattggtccccgcctccccagtcgcgccccagtgctgcgctgtccgtcgtgctgaaatgtggtgcgcctggggagtgcgggagccaggaagttagggtctcctgctccggccctatgagcatgtgagtcttgatggattattagctatgggtgaggccagcacaacacatcacaattctctctgaagctgtctggtaactacgtatattgttgatggaagccagtgacttttaaaagccattatgttgattaacttttttaaagaagtttaggagattatatggaggtaaaaacctttgtaaaatgctaatcacagtgtctgacaattagaacacatttaataaatgtcagtttctttgctcaacccttataagaacccttattccaaagccacctcctcagctctgacttcagctccattccttagtgagaatggggttataaatccaggttaacccgattgtttaggattagaaagtgatttggtttccaacgttgaaggagttcaagaaacaaagagttttatttttcctccttatgagatattgttccaaatagaacacagtttgtctagatgatttttgtcacttaaaattaggctccaggaaagattccaaatttcatgagcaattgggctcataaaacaagatcaaactccaatagtgtatatccaaagtatgtataatgtgtattcggtgtatattcttccaccactgcatggtgtagacagaatttctcttccaaggggcaccacatgacaaaaccgtacataataatgaaatgcatttgtagacaaaggactagctaaaataccaactgaaagtgggaagaccagaaactgaagtgtaagatgaggtaagccctggagtaagagtcaagaaatccactttctatccataatctgtctcggtttaatgttggtcaagtcattttttaaaaaattctaggtcttggtttccttatgatgactttagatctctgttccttggaattctagagtgatccaaaggtttctttgaattcagttttgtgggttgagacgggcagccagactgtgagtccctcagctctgcttcaaccagaacagctccactttactgttcagcatgttagccctgtatgtaaggatgttttttagctttagctaaaatttagtgactctatgaccctaaggccctgcttccctgagattttgaaagctgaagcacattcggaaaactttttcttccttaaaaatcacctgaaatctgacaatctggaagactagttctgtctgctccagcccttggtcccttagatgtgcttttctgaagatccaaactcaacctgccagtcaatataccaactgagcagagcccctgttctccaccagatttcaagagaacatgttccattcctgttcagagcttcagagcagcttccgctaagattgcacattaatgcaacagcgtcctattttctttgtttctttttttttttttttttttttttttgatgagacagggtttcaccatgttggccaggctggtctcaaactcctgacctcaggtcatccacctgccttggcctcccaaagtgctgggattacaggcgtgagccaccgcatctggccaagcttcctactttcttataaggctaaagttgcagtagaaatattcccctgctcttcctttccatatcataagtatccatcttccttcccctgctttaacttctcatgattgcagtttttgttttattacaataaaggatatcaatcattcatctaatgttatagcaatgaggggatttaaggtgaaaggtagagaacatatgttgagaactgtttctggaaactctaggtgaagaaaaagaagggaattaacatttattcaacacctacaatgtgccaggtacagtgctaagtgcctttatatacatgagttaatataaacctcaaaataatgctctaaggaaaacattttaaataatgctgaagttaaatatcatgattccttttatataaggaagaagacagatttagagaagttaaataaaatttccaaaaatgcagcaatagcaaggtggaggtatttgtctctaaaatttcaccctctgttctgtacaccaagtacctcagcaagtaatccagttccagatgggatctgcagtctgccattaagtctttaccacacataggctcttatgctagagcccttaccatatggtccaaaatgccatttttaatgtgtatttgatatggagactctgttcacaatttgagtactaaagagagaataccacctcctagtagatacaccaggaccaatgtaatgctgtcattctaaggagagcagtggaacatctccaaagaacccatctgtagtcttccttcggcccttgatcttattcctattttatttttaaggtttttttttttttcttcgagactaaatctcactctatcacccaagctggagtgcagtggcatgatatcagttcattgcaacctctgcctcccggactcaagcgattctcctcactcagcatcccaagtatctgggactacaggcatacaccactatgcccagctagtgtatgtgtgtgtgtgtgtgtgtgtgtgtgtgtgtgtgtgtgtgttagtagagacagggtttcaccatgttgcccagggtggtcttgaactccagagctcaggcgatccacctgccgaggcctcccaaagtgctgggattacaggcatgagccacagcgcctggccaatcttttagggataattttagaacagtatacagatattgagccaagagtcaaaagagctgggttgcaattctggttgtgccatttatcagttgtgtgaggtgggacaagtctctttttctccctagctttctctttcctcatttataaaataaagaaatgagaatgatagttgtattaatttctgaggactgccagaacaaattactacaaactgggtggcttaaaacaacaaacatttattctcacatagttcaggaggctagcagtttgaaatcaagttcttgacaaactcccctagagtctaaagtctctagagaaggattcctccttgcctcttccagcttttggtagctccagtgttctttggcttgtggcagcatcactccaatctcagcctctagtttgtggtaatgtattatgacagtcttaggaaaataatacatcagtatttggaaatgtttcttcatttgccacaatatgatatcaaataaaatacatccacttaaaagttcaggtatggatacacccattgatttggaatgctagtgaatgtaaaggcttaggtcaacttctctctgcagttccaaggaggatgagaaatagcagccttgacctcccaccagcgggagtttccctccttcatccctggtcactggccacacaaggacctggcatctcccagtaaatgtgttcctctgcaacctgagccacaaacctctctctcttttatctctttcctctttctaccttcatatttggttggctatttttagttcttctgcagatatagttacactttaaatgacacacagcctttaattacttacatgttgacttgaagcaatgtctgttgctcaccttcttggaaatatcagaagacaagaacacttttacttcctcctccttctcccatccttctctctgtctacttaatctgtttatcatattctcatttttacaccatcaaggtttataatgctcccagaacatacctccttcaaggtaaatgggaatggtaacctttggcctctccttgcccataaggacaacccagtctcctgctctgcgtgggttcccaatttggccctaagacttttctgtttgtatgatcagcaaaaggacatcaaatactttccatcctccaatgagcagaacacattctgtggtcagaagccttctcattacttctgatctcaaagggacatccagagttgcccaaacccaggccaaccacccttccatttagccacagcctgaagatcccaactatgatcaacaaataagactgactccagatcccactctgccaactgcctacctaatacccagactcttgcagctgagagagtctcttctaaaatccagcccaaaaggcacactagatgtgaggaccagaatatcttgtattttgtagtctattatagcaagcataataaacttatttgtttgagaccgagtctcactctgtcgcccaggctgaagtacagtggcacgatctcagctcactgaaacctctgcctcccgggtttaagcgattctactgcctcagcctcctgagtagctgggattacaggcatgtgccaccgtgcctggctaatttttgtatttttagttgagacatggcttccccatgttgaccaggctagcctcgaactcctgacctcaggtgatccacccacctcggcctcccaaagtgctgggattacaggtgtgagccactgcccagccgataaactttaaaattactttttctattccatatcatagattctgggaggaaacaaggcccaatttgagtaaaagcaactgcatttagctggcttgaacttcttcagagaaagaacaacataaaatattcagctcatctgattttttaatgacatttcctttttatttatattcaattacacaagtaatacatgaacagattctcccttttttaaaccatcccttattctacagatcaggtgaaagtacttgttgctggcctgtacttcccatccccacttttgtccccaggacaaagtactatcaggatactagcattcagagtgagcagattcctagtactgacataaggaggatcaccatctaatttttaaattttaaaaaatgaacacaaagtctattagaggaatgaaatgaacctgctttgtaggtacataatatttctctctccagagagaaaggaggagagcacacataagataggaagatgagagctacaataaatgagagaagagagaaactgtcagaaatagcagggcagaaagagggaaagaggtgagaatgagagagagggggagggaggaacagaggaagatgcgaacaaggagagtcactcagttctgaggcaagcacttgattctccgtggttcatttgggtatccaagtaagttatttcctataatcattggcctttaggagtctgcttagctaattaacagtttgcaaattgccaattgttttttgtcccgcattctccagagactttacactgcaaaggcagaccacagcagcccaccttacacttgagttgtggccaaagcaccatccccaccagacaaagccagccccacagctgaccccggcctgtgagtgtctgaaaactggctgtaaagaacattctgtctagttacttcctcagtaaactctggggctgggcactggaggttttctgaaaggaagtgtttggtgtctcacacagccatgtgcttagtatattccatgcagcactccactgagccagtgcccttgaaatgagcaagcactgcagccatcctcctttatttccctcaaggcaatatccaaggattaaaaagtcagagccgtctgcagattcctcctctctaccttgccctgcactttttgtgcccttcctcttccccctctccagccccaaacctctctcctgatccacggtactcctcctgggatgtccactggggctgatcctcccccattctccccctgagttccctgctgttaatctgtctccagcaaaattaacctagcctatgtcccatgccctctggactctggctgctcgtcaatcactcttaaaaatccggtttctccttaggcaatcattttgttttgattttatgtgtaaaaaaacctgagtaaattttttttttttttgagatggagtcttgctctgttgctcaggctagagtacagtggcatgatttctgctcactgcaacctccgcctcccgggttcaagcgattctcctgcctcagcctcttgagtagctgggactacaggtgcccaccaccatgcctggctaatttttgtatttttggtagagacagggtttcatcatactggccaggctggtctcaaactcctgaccttgtgatccacgcacttcggcctcccaaagtaatcactgctgggattacagaagtgagccaccgtgcctggccaaacctaagtaaatgttttaaaattatactactaacatagcatacaggctttagactgttggttgcttttaagtttgcttactttaaaagctagagagaagatggttgaggtgatcttgtctccttcagtattcactctgagccatgcctcctgaggaagtttgctttaggggaggcattgctatgttatacactctacgatgcaccagcccttgcctcagaaggcaaggtttgaaccccaacactgtcttttgcaaactgttaccttaggaaatagattttatctccttaactcactttttacatttgcaaaatgggtaaattgtgactacctcacatggatgtcatgagatgaaatgtaagaatgtgtgtccctggcatatagtaaccactttcgccaaagactgagttatccaactacagacagagaacagctggtggcctaatcaaagggagatacaaaataacaatgccaagactggaaaaggaagttcatcttaggatttccaagagaaaaagaaatatgactgtattataataggtatatttattaagctcttaccatgtgccaagcaaagttctttatatacatgatatacttcatatacattatttcatttagtcctcatggctaccaggtgagcaccattattttcccattttacagatgaggcacagagaagttaagccacttacctaggaagggcagtcctagttaagaagctgggattcaaatccaagaggctggattccagacctcaggctctattatgagaagtacctaaatagagattggtttaaccaaagcctgagtcccaactaagggcaagactgtgacacagaggtcactaatcagaatgaaagattgagccagagttgagttgttggaatgtattttggtacatttaggttgttttaagtatatcaatctccattccactcaatggttgagttcagtttcaagttttccaaatgctttatgggaaagtcatatttttctcccattgcagcagggatgccagcgcagccatgcttctcaaccaccaagtagaagcaaagccaaactgacccaagaagatgaacagagggaatccagggagttccaacttgggttcacagctgcaattctcaaaggatggactaagccatgtcacccctccagataacacagtcatattaatagtgaccttttggaggcctccctaaacagcaggtgaagtcccaaaatcattagattattcctggcctcaattgtggcccagagggagagccctaagatttttccatgggaacaaagatctaaattctgggactatctgggccatgtccaccctgcaccatttactacaaaatgggctgatcctatggaagcacactacctgtgttgtggtcatatagatcatcacctggcttctccagggctaaccagttagcatggaaatgggacacccaagaacaagaggatagaaagaagggaagggtggaaagaaggaaggaagaaagggtgggagggagggaagagtggtagttttggaaggaaggagggaatcagagctaaagataatacatgatatgagtcagtgttcaatgtccctgaagattaggggaatcaagctttgcttccaggagaattaacacaggagagccaacagagatgtggaaatttaggaagtcagaggagacattctttcattcattcattcgttcattcattcacttgctcatttttacatgaattgactctagaacagatgctggagatacaaagatgcatgagacttgcccccatcctcaacagtcattcacagtctaatcagaaagagagccttgcatttggaatacaatatggagtaataatacctctgtgttcagcctgcacaaaatactctgtatgcatggtcatatgtcccttgaaacaactttatgaggaagatactactatagtctccatttgacagataaggaaactgaggcttagggaggtcaaataacttgcccaagtaaaacaactagtaagtagctgaaccacaaaacagagattcatgcagaaagctgtacaacagaagaaaccaggactacatctgcctcaaaggaaccagagaaggcttccaaagaaggcagcattttaaatgggttttgaaggatgtatagcagctatagaggcagagaagaggaaaaaagtcatttcaaacagaaagaacaggttgtgcattcaaaggtgaattgagaggagagaaaagcatgttcaggaaaagacaagacatttgtggccctgggagctgagatatgccctcgggaaggctggagatgatgtcaaagacgaagattggacaataatgcccatcaggccaggagccccctttctggattcgctgcttccactcttgtgtagaatgatctttttaaaatgttcatcaaatcaggcccccctcttattaaacatttcaaaggttttctgttctacttaaaacctaaaacccttcttttgtatgcaaggcctgaacagcctgcctttatcctgtagacaaaggggagatgggaggaggagctaactcacaaagacagtggttatgtctgctctactcacacacatccctactgccccgcacggtgcccagcacatagtaggtcctcagtagggtgttgaatgaatgaacaaatcactgatgaatgacggccctaagcagggatttttctccaaagcttcctcacaccttggaatgcatttgggggcccaacacaaaggtttccaacttcaacagcaaaaactccacctcccacacaatgtagagttacttcttgctcatttccagtgggtttctgtctttctccacagcctgactccttctcaaaatctctctattcccttccaaatatacattctaaatatttacagaagcttgttattctcctcagagctggcctagagttctcctgatatttcaaagaatttccaagaatagggaaatctcctgatatttcagagaatatcccaagaatagataaagttccatctgacaaatagatgctcagtaaaatctggtgagtgaatggattaatgcaaaaactaattatcatgctgttcatggcaagggatatgataattttttcaagtccaactctggggcaccctcacttccacgtcacatgattaggaaaagggcccaggtggcattcagtagacatagactaagcctcaaccccagccctcaggcacatcagtgccctctctaggctctctctcaccaactttagaattgaattacatcagttgtttccagatggtgatctgcagaattcctttaaagaccacctgtgggatttgagggaggaaaactacactctcccaatctccctctttaacccaagcatctgattgctttcatctgttttacatacttagcttctgtgcacaacttcctttgattaaagagttccttgcctttatagtagtggatgatatctaaggatgatgtaaaatactgggtgttagctaaggttttaccaaacttaaagcctttatgcttcataattccactttattgatgtaggaagacaaatgatagacttactttcaaggtggatagaagggatgcgacctagccaaggctacagcatttctctatggcaccactgccatgacaaccatcagtttgaatgccttatgggtgcatcctatgggttatgcactggccccaagccataacccctaggactctagagccagcagcaaacacaaaacactgaattaataatgagtgagatctctgttcccatagctgccacaggctaaataagttgagggggtattgtaaaacccaagatgagatcactgagcctctggtatcaaaaaggtgtatttcacagaatgtttagttggacgagagcttgaagagcatggaaacgatctggtatcattctggtcaaagaccagaatttagaccccagttctgccatttgctgactaatgactttgggcaaaatacttaactttcctgagagttagtttcctcatctataaagtggggtaatataacccaccttgcaggatactggtaggattagttgaaataaattgtaggagaacatttggctcagtgctaagcctatataaatactccacaagggcacagagagggaatgacttgcctaggatctcctcctggaaatcacacaacaattccactagtatcatgtggcccacaggcagctggtgggcacaaccacactggttcagcattgccatggtccaagaggcttctggtgcccagggaaccagcagggtcccctgagcgttcctcctcagctcccaacacttccctccaggcaccagtatgcagggcaaggtcctggagggggcgccgaaacaccactcgagatcctcactctcaggaattcaatatagaaaacacattaagacctgtttacatggaactgctgtttataattattgttccctatgggatattccccactgcttcctccaatcctcttttaaactgctcaactaatagagttttcctggcttccccagggagacattcacagatgctaatagagacataattcaaaaattgcttgatatacatgccctcaattttccccaagaaccacctaagtaaagagccccagacatgcaacacattcattggccagatgcaatttaacatgcgtgggattaaatatacaggctactacagccaggttgtcatcaagcagcagcaggcatggcattttatcctaaggtaccaccacggccaaatgcaacaggaaagaagcaggctgctgggtgggacccctggaagatcccctcctctgtaatttccactgcaagcttttcccaggccttttcaggcaaagcggggagttttgaaaataaatcccccaggcttggagaagcaaagaatcaatgctaagcagctccggaaataatagcttccatctctctgatatataaagaggataaggaaggcagaaagaaggggcatgatattatgagattgcaacaatacattgcaacattacattaaagaattacagaaagcaagatctagcttcagatgccagttcatgcacttactccctgtgtgaccctgggaatcacttaagctgtctgagacttagcttgtctaatgacaaactggggatactaatatcacctcccaggattgttgggaaggtaaatggagattgacaaatgtgaacacacttagtatgtctttacatagtaggtattcaataaactcttctatatatcttctctttctgaaaatctgaatatggggagcatggatatgcttatatgttggttaaacaaatgcatgaatgttgagcaaatcagaaaatactaaaattagaagactaaaaggagtaaactaggaccgattaaaagaagtttgccttccccaaaactcataaacttaatgaaacttgctatctccagaggaaattaatataaatttaaaatagcataggtttgagatgactttagcggagtttctggagaatagatccatcactggttaataaactaaaaatatagagagaactgcccaaggttacacgagtagaaatttggtgtccccaccactcctttttattgcagagggaattgacattcagggaatggaaatgcccagcccagaattggggatgtggtctgggaacccaggtctcccatcccactccctcgccctctcaccccctcccgctggtcagtgttctttgtcctctgctggcatccctggggacgggccagcccccatccccccgacacacacacattgtcccttcaagatggagccaggctgacaccacgtagaatgacctggaagcccccactcagtctaccagtcctccctcctcacacaggaatagatgggagggaaatgaaataagctgccatctgctgtgcatcctctgtgtgccatgctctgggtacccatctaatcctcgtgaagaccctgagaagtgagtgttcttcacagactaggcaacaccagaaggcaggtgaagaacgtacagaagctacagagtgcacaggtgacaggtatgagagccaagccattcaaactccctgggtataggacccagctcttcccacgtctctgcctttaccgaatcaaacacctgagcacggaagaccctccatcaacatgaactgctttgaattgacatgaacaagcttcaatcaaactataaatgctgaaatttttcaattatagaaagtatttgaaagatcccataaattcccctgtcatatcacgtgagctgcatttactgcagcagacactttttatctcgggcttggaggaaggattagcaagaagaaagtggagggggtctgaggaagggctggcagcctagaggaggacagcagcaagaagcaggctggaggcagttctgtgctgccggccttcatgggtgtggcctttggacagcaccttagcaggaatgtggtggagagcagccccattcactccagaggagagcctcaaactcttcaggcagatctagcctaggtagaatcttggcctggcccctccgggatgacaggtgccattgcccaagaatggggaaaaggctgaagtgctccagccaaagaccccaatttatcttcaggacaattttcactggaaaccttgcctcaccactgcccactttttcagaagtaattagaatgctaatctataagaaagatgactattaaaaataaattaataatagataatacattttggcttacaattttgaataatatagccatcccatcttaaagtaaaaattcatatatttttaataagcctgagacatgttttccaatgaaccacagatggttcatttttattatcctataaagagacattatgggcaagtgttttttaaaatggtaaaacagaaccttagagcagctctcttttgaagatctctaagcactttctaagcatcaggacccccttctgtcatcacagagactgaaatgaggagatggtctctgtcaccccctcactcaccagtgagccccagaccttcatccctgatcagatggaagcagtgtggcatgattacagttcatatttcaactctgccactcaatgactaatagccaagcactaataatgcagaaaatgtaaatttaaaaaataatcttcctgagattggttatgaaatgcactcaacacagcaccatccacagagaggttctttttaattgctcttttctttcctctcgacacccagaatcacaaagcatgcctgaaagcgtcacacatatatgtctgtgaccataacatggcattgcacatgcaaaggaaataaataggtgttacccatgtgacaaaggtccatgagctctgtccgcaaaaagctgttgagtttaaagaacaaataattctgaaaaatcttccaggagatgaaatttgtagaactcaagggcagtaaactagctgctttccaaggacttgtcatagctttattgacttacaatagccaaagataagtcagtattaatcaaacccattctctagaaaaacctcatcatcactggggccagggcagagaagtgtgacacagctctctccagcttccccacttcacagcatggttccaccatccacccaattgctaaagcctggatagtcttccttgtcacctcccgatccccttctctaacacccatcccccggccacccaacatcagcaagtctggtggtttctctctgtcacagagattcaagatcttcccctcatctgtctgtttcaaagttaacatcatctctcatccagacagttgcaacactctcctagcaggtccttctgcatctattttttaattaaatttttaaagataaaaacattcctctaaatagaatctgctccagaacccagattaaaaaagaacgagaagggggaaagaagattagggcatcccagaagctccctatttgccccatttgattcattactccccaaaggtaactgctatcctgacttctagcaacactggttaatttccgttgattttgcactgtatattcatccgtgctgttggacactgtcatacttgattcattcacattgctgtgtaacatttcattgtgtgactattttaacatccattttactgttgaacacttgggtaaacttctgctttgaggctattataaacttgacacttctgcttcccattgctttaaagataagagcccaagtccttgtcagacaggtgaatggtccacacagttagcatcctaggctgggcgcggtagctcacgcctgtaatcccagcactttgggaggccaaggcgggtggatcatgaggtcaggagatcgagaccatcctggccaacatgatgaaaccccgtctctactaaaaatacaaaaattagccaggtgtggtggcatgcgcctgtaatcccagctacttggaaggctgaggcaggagaattgttcgaaccagggattcgaaggttgcagtgagccgagattgcaccactacactccagcctgggacagagcaagactctgtctcaaaaaaaaaaaaaaaagccaggctttttctcatctcataatctttgcgcatgctgttccctcttcctgaaactgctttcctaccacttctcacctttatgcttcacctcgtagtgttcatagactctccttccttcctaacttaaaagaggctccttctggtttttccttcatacacttccctcactcttttccttcactgcactaaagatgatttctaattgcatagtcattgatgccagtatttgtttattgtgtcattcctgctgaacagaggatgggcctgacttatttgggaccatgttgctgatgcctggacctaagcctggcacagagtaggagctcaacaaatttgttaaatgagtggctgaatggccatactctcaaaggacccacagtctaggagagacagaagaatctttgtctttttgtcttgcagtgggatggaagctgcagggaggggtcttgtcacattgatactgtctggggaagacagaaaaacttcagtttcagaggaggtagcccttgaaacgagatttgagagagggcagcacattgtacaactccatgggcaccatgcacattgtagtccagataaacagagccccttggagatatgtgaggcatgggatagactcagagaaacccaggaaataaccccttcaggcatctgacatgcaaagatgtggaagtgtcaaccaggaagtcatgttgggggaacagcaagtatttacagaaagtgactgtgtgtgtctgtgtaggagggtgactttgtataggagagataaaacctgtgagctaatcaaggagaagatcataaaagaccttcataaagagcatggcctttttcctgcaagcagtgaggagccattgaaggctttagcataaggacagtcagatgtacttccctagaatgcacatttccttctgctccagaacttctgcacaggaggctcctaaaagctctccccatcctccctgtacacgtagaatctgcctctgtctctctttctctctcctcctcctcctccatctcctcctcctcctcctctccctctctctcgctgtctcacacacacatacacacacactccttccttcctatctagtcagattccactccttgggatttcaggcccaccgtcactcctcagggaagcctgccctgaatgcctgcactacaccagggcccctttcccctgcccccatcccagagcaccaaatagctttcccttgcagcacttctcacagctgtcattttatgtttgtgtctgtgattcttaggttaagtccctcatgcaccaaatcataagatctgggaacaaggaccacacctgtcctgttcatcactgtaatcatcacactgcctgccaaagtgccttgcacatattagatacttagtagttatgtgttccatgaatgactctttaagagatcttctagctgttcttgcaaagaacccattggtaaggttgaacctacaggctgatactttgcactagtctcaggaagagatggtgagtacatgaaattgagtcccccagaggttaatgcccagtgccccagctaggaaacgtccaaggaggcaatttgaaccccatctgtctggctgcagagcctagccctctaatgcattcaggggtcctagctcctcgaggatgccactgtgccgtgaacttctttctgaccctcatggctcccagcacagcatccacactcagaagtgcaagatgaatgtttgcagataatgaacataaagctctcaggaaccctcatctcctgagaatctgctttggcccccacagcaggtctgggtgtggaccttccccaatggccttgggaaattatcaacatctccccattagctgttgcaatattaaattgtgtgactggaaatgaatgaataatcccatgggcaagtgagggagaccaagcagcagggatttaataacaagtcctgccctttctccaagcagaaggtcttcctaattaaatattaaaaatctatccatacaagcaagagcgaaaaattgcattttcagcagtgcagctttgagatgctgcctcagaagacccaagagctgtgggaatgccctctccaggacctagaagagggggccagaaaaccgccatgtggtaagcactgccgggtacccgggtatcacaggccttgccacattcaatcctcatggggacaatgagacaggggttagatcacagccactgtctaaatgagcaaactgaggcttagagagggttagtgacttacccaaggccaccaggtatcaagtggcaaagttgggatcttaacccagttctatgtggctataaagttcatggaatagaatgctgcagttaagaacatgggctttggcatcaagcagacctgtatttgagccccacctctgctgtttattaactgtggccctgggcagatgaccttacatccttaagtctctagttctttgtctttaaaagggtggcagaatgtacctcactggttttaggaaggtcacatgagatagtgcacatgaagccctaggcatgggaaaattcttctaaaatgtcagctgccattctgatcactgcaagacccccacccccaatactcccaattgtaccaccccaccccactcaccagtgtctcagaaatgcctcctccagaaggaaggcatcctgtctaacccactgcttctagccaagctgtctttcttcagaaggtagaaaaagattgttagtcattgtttaatctttattgagtatataccgccacaccaattgcactgccattcattatctcatttaaatctgacaagagccttgtaaagtagggattattcccaccatttcccagatgttgaaactgaaattgataaacacgacatgttgccatggctacatgaagatctccaagccggaggatctccaccctcacctgcctagcttcccagacctctctgcagaaaagggactgacccccaagacagccctggcctctgggctccaccccttccacatccatcccagggccgctgaggactgaagagttctccacgtttgccctttaaagtgacttaaaaataatctttatgaatttcttcatatacaaaatttgtacttactcattgcagcaaatttagaaaatacacataagcaaaaaagaacgtaacagccatccataaccctaactctcagagatcaccactattaaaatgtttattatctaagagagagatgatatagacaaagatgagacagattgacacagagaagatgggtacatgatagatattttctgttttataacccttgctttttcttgcacttctaggaatttttctgagaactaatctgaaatctgcacagggtccccacgtctcggatcctcatcccattgcctcccaccttcttgaactttgcttcaataattatcacacctcctttgcatgtttaatcttcccccttttaatgacaactaccaagacctgtttcctagtgcagggtcatgaggtaactaaaataagaattaaattgctctgtgaaaaaaaaaaaaaaaaaaaaaagttttacagtcccaggagattttctccagccttatcatattgttgataccatagggtcagttctgaagctgagcccaactcagccctaagctttctaaaggggaattgccaggtcccctggtattccagctgaaacctcaaacatcctaaattgtaggctctattaactaataaggagaaacacacttccttccccttcccatgacttgtagggagtctagggtctcaggcctatgtcacaggccctcgattgccatgagtcagcaaggagaggaaggacacgaagccagcaggcagagagctggccccacagagccatcctccgtgaagccccagcaaacgggagggaccaagtttgtttcagttttcctaaaaataacaagactgtattttctttgctgttggctgtccctaaaactgttaacatgggttcccagcctggcacaatgtggtccatgcctgcctcccacatacctgcctcccacccctctgggccttgttcccttcatcccagcctccagacacacctgcctcctgtcatctctagagcaggcttatcttgttctcctgtgggctccttgtagaggatgttccctctgcccagaacgctctccctcactcatcacctgttggtccccttctcctccttccaggctctgtgtcaaggccaccacagagaagccttgcggttatgtttagttcttcctgcctaagttcgcatggtaacccatacctttcctccatcataatttgctcaactgtaatcaaacattatttttaaaaaatcattccagcctgggaaacagtgagaaacccatctctacaaaataaaaaataaaaattagcttggcattgtggcatctgcccgtggtccctgctactcaggaggctgagatgaaaggatcacttgagcctgggaggttggggctgtggtaagccgtgattgccccattgcactccattctaggcaacagagtgagaccctgtctcaaaaaaaatattattcatttaatatctgttgccaccacaggactgatccctctgtgagggcagagattgttcatgcatggaattgtgatttataagcactggctctggagccaggttgcctgagcacggagccagctgtgccctgcgggacacctgtggcacacttcactcctgggacacctgggacacgcacacaatagaaatgttcacattttactaggcaatgccagtcacatagtcctacctaatttcaaaagggtaaaaggtacacccaacacgcatcaggaaggaggaggaccagaaattgttggtgacaagcacaaatgaccaccccaatataatattttgtttggaaggcattttattccacaaaaacaacattacaataaacacaacaacaaaacactggttgcagtagaaccaactttccagacctatctgcacagcacaaccattatcccactcaaaatgtcatgtttttacccaaaacattaaaattttaaaagcaattcaaacccatagcttaaaaaatgttccaaccagtaataaaaggaaaagtgtgcctcctcctcccaacttccctaccccacaatcgcaagatattatccttataggcgaaaagggtttcaggatttgagatgcaggctgggaggtctgagaagacttcctatagaagacatgacttcaaactctttcttgtatgtgagatttaattttcaaagactcctctgatccaacttaagctttatggtaaatcaccttgggacttaaatgatgagaagcactgctatctcacagtgagaaattcagaagggctgggagttccaagtcagagctctgatctggaaagttccatcaaagcgtcactccaggcttagcggttgccacccaccactcgtcagactaaacagcctcagagccctgtgacctgctaatgtattcacaaactaactcagctaattaatcccagctcattcatcctctcaaactatgcaagtcttccagctggccctccggcttgctgccctggctaatggagtgttacgtggactctctgtaggttgcaccttactcgcagccaagcaaaggcactcattaagaagctgagccccagggctcccccatgagtggggaggaaactcatgagtgccttctatatgccagcgctctatctgcaggggttcttttgatagcagcagactgagagatgatgttactgtcccctttttcctgttgttggcaactgagactcagaggatggaagtgacttgctcaggtccaccacctcttcagctgtggagctgcgacaggagcctttgtttgacttcaaagctcaccatcactcctctctcactgatgctcaagtgggctatcacctcgcctttcctgagccttccttcgctatcctaaaacagcgcctcccgaaatcaccactaaagaacttattcatgtaaccaaacaccagcggttcccctaaaaacctatggaaataaaaattaaaaataaaaacagtgcctcccatgacccatgtctctccagtcccataactctgctctatttccattcacagctccatccccacctttatgtcttttgttcactgctttatccccagtgcctagaagagtgcttggcacctagtagacactcagtaagtatttgtcgaatgagttaataaggttgtgaaaagaacgttagattactggaaggattcatctgagtttaattctgctatgctgggaatccagtgtgcggccttggatgaagccagttccctccctgggccccagtagccacatctgtacatttagagggcaggagaaaagccacacgctctgtgacttatacaacttgttgcccagagtggaggctgctttgatgctcagaaaaaagaaacaaacatggaaatgctaaatgggtggcagagagcttgagggaggaaggagatggggagggtactcttgaaactgtttggtgtcttccctcctgccccctcagtaccaattgtcaagtacagaaagtgaaggagacttgtattagtggaatttggtccctgacttgttatagagacacaattacaaagacacaagagtgggcccagcagagacccttagggtggtcccttgaggttccaaagcatctgcccatcaagcagatgatgtgattagtctctgtgaccccaaggatgcctcctgaaattgctgattcaatttctcctaataaaataggaacaataattagctaataagaaatcaacaattaaagctatgagagaattaagtgagatcatgtaagcaaagtacatgtcacagtgctctgcaaataggcagtgctcagaagtgtcaccttttctctttcttctctgagcctccgtcttctcttcggtaaaatgagaataatattatgcatacctcacaggggttaagcaatgtgaaagtactctgtaaagtataaggctgaaatgtactgggctcagaacctataggtctgttccattctcgacacacgtgatattagcagcacggtacatttaaggacacggcttgattctttaatcacagggcatcctgtcttctccacattgcttgggaccccaaaaaatgaagttctgtcatgtctctagaccaccaccaaacacataaaagtcacttaggaaaacatggtaggaggcagaggaaaggaattgttgaacagggattgcagattcaggtatataaacgagtgatgatgactctaacaacagctcttggtcttagtgttggaaatgtaatagggagtagtggggactgcggtttaattgttgccgtgtgggaatgtgggcctggcatggccataatttcagatttctaaaggaaagccaaaagttcatatttttatgtgaaataaatgttgataaagttcacacttaaatgaagtgaaacagaccagggctggtggtttatacctgtaattccagtgctttaagaggccgaggcaggaggatcacttgaggccaggagttcaaggctagtctgggcaacacagtgagaccccatctctaccaaaaaaaaattaatttaaaaaataaaagaagtgaaacaacagtaccctgtgggctgccagattgtgatttctgaactaaactgtcagattacaaagttacccgctaaattagccaaatactttccagatattccctgggccactgtctcgggactcttaatatattttccaattagttccttttagtgctacatacacacttttagcaaataatgagcacttactagtcactttctatgtgcaaagcagatattagacatcacagagggagtgagataccgaaaacaaaaataaaacaaaaataagcacaagacacaatctccgcctaccccacccttgaatatgaaaactgtgacacccaaaggtagattttgatacctgctgggtgattgctagagataataagtgctttgggaatttggacagagagagcttttttttgcagtggtctgagagagctgcccagaggagatggcacttacgccatgttttaagggtggataggattagtgccagatgatcacatgctctggtagacaggggtctgtgcaccagtagattctggggctattgcagaggactcatgacagggattagtctctgtgaccccaaggatgcctcctgaaattgctgattcaatttctcctaataaaataggaacaataattagctaataagaaatcaacaattaaagctatgagagaattaagtgagatcatgtaagcaaagtacatgtcacagtgctctgcaaataggcagtgctcagaagtgtcaccttttctctttcttctctgagcctccgtcttctcttcggtaaaatgagaataatattatgcatacctcacaggggttaagcaatgtgaaagtactctgtaaagtataaggctgaaatgtactgggctcagaattggggaatcgtctggaaaggtagaccagggccctagcgtggactcttcagcgccagcaggaaaatctaggctctgtcttgaaggttcctcagcaggaaggtggggggttgttgtggggtgaatctgatggaaagggattcctcctcctcctcctgctttctccagggtgaggaatctaggcactagccctggggcccctccaggtcccactcttcacctcttgttttttatttctcctgccatacaaccttctttttatttaaaatagatttaagcaggatagagccccctcccccaccatcaaggctgtttccttgtaggtggggggatgccttcatggtaatgatgtagaccctgagacaatatagagaggcagcagggcttggaaacaggcagtatttcctctttttatgatggtttcattttacatttttattggcctttcactgattgctcccgggctctctggcaggatgtgagatgcgctgacatttatagaaatcaatacattaataaatcacgaagttcataatgtctgatttgcttctaaatgagacagaactattatcgccataaagttgcacataaaatatgcccaattgtgatgtattgtgtagtctaatcaaaggcatttgagtgaataacctttccccaaaagaaggaaacaatcaaagctgaataacttcattaataattcaaggtgtgtctgccaaggcttcatttattaagtgcacagttaagaggcttcagagctgaatcctggagaggatagcaccttgccatcttctccctgcctctgggcaggcggatatacattctcagatgaactgactgcactccttgcatctggaagttcatgttccagtggagggtaatgcccagttgacttcttcagctaagagatggcccgtaacagtgctcatggactgtccggattcttaagggcagaggagccagagccaggaaatgtccttagtggccatcagttgttatgtctgttcactaatgttccaggccctatgcttctggtgtccaccacccacagaccccctgttctgttccacggactgagatgatcaacagtctttcatccagagggttgtgtttgctggtggccattacctttaacataaaacgatcatatttactttatcctattcatgtccaacctcaactgacaattgagttgtgtctctgacaataaatagcagaaaaaggaaatcttcctatactgaagagaaacacaattaattaactagatccatcaggaaaggtacaatcatgattgagacagtgtttaacagatgtgactattggattctgttgttgagaatgacccttaaaatcacagtcaaaatatacgacaagatggaaataacatttttgagcacctactatgcatgtagagcatcttacataccttatctcacttagatttacagctgcaaggtgggtatgattctagcttgaattagtctaataaccatatacctcctaggggcagtgagatgattagatcaattctaaaactattaccatgctctctgagctcaccaagacaggcagttaatacaaggatacattaataccgaatccagcaaaagctcacatggccagcttccattatgttcctatttgtgattattctgtatcaagcacagaaatgtatgttcacacgaacaacaaagaaggggtttattagtgtggattacagggcctaagcctaccctctgaaactggttttggagtctttagcacgcttgtttgggacagttaaacatgtgccagctattctaaaacagtagcagtaatgtgatagagctgggtcataccgtgcttcccaaagtatgatcacttcatttcaacaacttcacactaacagcctgaactgggctgtgaagggaatatttagaccaaggaaactggaaaactgtatcaatcaggcttttccaccctccccaagagccagttgtcagatatctaccagcctaccaacgctagctctctaatcagaaaccatcacttagcaagttcccaaattatctgcagagcaatgaactcctcttcttcagaaagcaggctgaaagatacactgttcacatcttagcctgacctggacccagtgagtttccatcagtgagaaaattctgtgctaacttgagataatactattcttgtggcaattttacttttcctttgagcgattccttcaacctctctctgccccttcatttttccgtcttaaaactaaaagtgccctttctccctggacactcctcatttgcaatgaattgtcatttcagctcctcagtcaagaggagtaatgaaatcccacccgtgttaatcctcttatatcccgcagaaatattgtagacccactcaccctaggcaacatgccctctctcttcaacacaggtcatcaattgttcatttactggctatctccatgtactggaacttcagggtggtgtccagctgggttcaaaggagaaacagtgggaagtttctccactgccacctgaattagatgagaaagagttgtctactgaaatacactagctggtggcaggattgggacgtcatttgactaattgcctcctagagctgcagagactgctggaactacctaagtaaatcatcaaaaaaaaaaaaaaaaaaaatcatcccagggcactttttccagacaaaaaggtccacttaaaacatcctctagagatctgtgcctgaagctgagctgctgcaatgaaactgacatttctgccttgcagcctggccatgggcttagctggactaaaatgctgctgcagtggtgagggcacgtgagagtccctaatgtacatggccttgctccttgtcctgacacatcttttagggctgctgctttctctagtgctggaatctagataattcctttcccagccgtttgtttcttcaatcttggaaaatatctggatgaatgtaacactgtcacacacaaacagaattatgacttacgtcacattctatgtcgtgattttgtggacttttaataattgcattacatttgtgaccattaatttccaccatcgccctgctcctgagaatctgtaagggacatttgacactcctctccccacccacctcaacatttgtgctgacctgaaggtcacattaaaaacatacccatttggagagaaagatctgtctactgaaatacactaaatattgaagaatttccaagtcatttgatcttgaaaactccatctaatggaagcagaaacactcaaaggtttttttttttggactccctttttcaggacactttcaggactgaggtatataaatgaatgagaaatgtataaattcaatttcacttaaaaggagcaggaggggtttcaagattaagagaacaaatgcttgaagcaaaacatgatttgagttttattgaaccgagaagactgaaaaaaatacgtggaacactcagaaaatctttatcaaggctcagctgagcactcctggggctcattgttaagtttataaaactcagagctgatgagttgtgtgcactgtgtgggtctgagtgggcttatgactcccctccaagcctggctgtaagaatctaagacttaaagctgaaggaccaaatgggactttccgtcccatcccctctctgctccatgcaagcaccaacgtggatttttgcccctaattatattagggaacgctgtcaatcaaaaagatgatgttaaactcatccagaacaaaccaaaccatgtttaaggggaagaaaagattacatcttcaaatgccagcatgccatcattaatacaatgtctaatgtagtcaatatagttcaggcaacattgaaaatgaaccactgcaaatactaggaatacaatttcaagaggaagcacaacattctgtgtttctatgcacacagtcctgtaaattatttgcagctcaagtatgtcatgttcttttaaattttcccctgggtacagcttgaacaacttcctacaagtgttgatatgtcatattctcattatcatttagttcaaaattaccatgatttaattaccatgaggttgcttttttgatacatgagttacttagaaattgaattaggctaggcatggtggctcccacctataatcctagcactttggaaggccaaggcaggaggattgcttgagtttgaggccagtctaggcaatatagtgagacctcatctccacaaaaaagtacaaaaaaactagccaggcatggtgacacatgcctatagttccagctactcaagaggctgaggtgggaggattgcttgagcctgggaggcagaggttgcagtgagtggagatcacaccagtgcacttcatcctggatgacatagcgagaccctgtctcaaaaaaagaaaaaaagaaattgaactatattgcttgatttccaaatgtttttgaggattttctaattttcttttggctattgatatgttgcttaattcaactctggacaaaaacagtctataacttcaattctttaaagttttttgagattgactttatggcccaggaaatggtcacttttggtaaatattctatgtgcacttgaaaaaatttatagtattttatgattgctgagtacagagctccatacgtctcaatgagacaagtttcttaattatgttgctcagatcttctatacccctattgatttttttgtctgtttatcagctgctgaaagaggtatttttaaattactccaattatgactgtgaatttattatttttccttttaattctatcagtctttgctttatttgtattttgaagctacattattagtacatattaatttagaattgttttatcttcctagcagatgggcccttttacataagaattctctatctctagcaaagttacttgccttaacatctactttagctgatgtaaacatagctgtgccagtgtttcttgatttgtgtttgcatggtatatccttttccatcattttacttttattttctgtgcccttatgcttacaagcagcatttaatcagggtttggtttatatctgatgatttctatcttgtattgtagattttctattttttaatttttcagtggttttactctgatgttcttataagtggttttctttgtgtttatcttgcttggggtttgtagtgctccttcactctgtgacttgatatatttcactcatttttttaaaatgttcatttattagctctttaaatatcgcttcattatcattatttatctctttcttttctgagactccaattatacatatgttcaaacttttcatcgcgtctcatatgtctcttatgcaagcttatctgtgattccattctttttttttctttttttgagatggaatctcactttgttgcccagcctggagtgcagtagcacaatctcggctcactgcagcctccaccccttgggctcaagtgattctcctgcctcagcctcccaagcagctgggactacaggcgcgcaccaccatgcccagctaattttcatatttttagtagagacgggatttccccatgttggccaggttggtctcgaactcctgacctcaagtgatcccccgcctaggcctcccaaagtgctgggattacaggcatgagccactgtgcctggactgtgatttcattcttttctctcttgtgcatctgtctgtgcatttttctattgacttatctaccaagtcacttattatctcttaatctgtgtcaaacccacttttaaattggtctgtttaattgttaatttggataacatatttttcaattctacaatttttgattgactttttgtatatattctggttctctggtggaattatctagctttttgtatattttcttgaacaaatgttcaccattattttaaagcccagatatgattaatccaattatctagatcagctgtggatctattactgtattctattttttctcttagtcttgtctcttaatatgcctgacagatttttactgaagggtgcacattggaataaaaaatgtgttacctatctggttgagtcttcagcttcagaaaggtaatagagcaaaggcagataaatccaaacagggactgagctgttttcatgcaggctgccttggtagctctccaaagccttcaaaaatgatgagatttttttttaaatcctttttatccagttgttctcaagggattccacccctgcataggagagctcaccattcctgggatcttcagcttctatgcctttgcatatgctcttcccttgttccctcattcttcaacactcaactgaattatcacctcccttgaagccttctctgacatcccttctagtcccatgccacccaggaggcactaagagcttcctcccctcagctcccagttcttaaacatgtcaacactgttttgaaatgatttgccaatgaaaaattctagaccagcaaccaacaacatccttcccaaaggtgtgttatatatggtacatgctgtatgtgctaaacaccaaattcattgataacagctaagaaccaggaaacaaaccatcgttaattatggcatctcttgaaaaatctaaagatctggactcactgggcttaaatgactgcatgataacaactggttgagtaacaactgtttccctttcatggagcagttactctccagttctcagttcctaccactctctatagttgtacactcatcatctgtcctcatctgaattacctgccaatgactactggcatttgagtttctaatccatggtctatgtgtatgcctcctcaccagtgtgagaactcatgtaaacaggtattatgtcttttcatctctctcctaatacctaagacattcctggcacaccagagcatgtcaatgcttctaaacatatctatattaaaatgctaccaaagcattcagggtagtgaaactattctgcgtaatgctgtaacagtggatacatgacgtcatgcatttgtcaaaacccacagaactgtacaacacaaagcatgaactctaatgtaaactatgggctttagttaatatctacatatcaataccggttcatcaactggaacagatataccacaccagtgcaagatgtgaataataggagaaactgtgagggcggaatatacacaaactctctatattttctgtgcaatttttctgtaacctgaaacagctctaaaaataaagtatatttataaaaaataaataaatacaaatgccacctcaccagaaggatcaaaggggcaactaaatccagcaaagtaagtgtctcacgtggaatacaggtcaggaaatgagtgaaaacactccaatggatgcccacctatacgatcactttgaagagcagcaggaaaataagcctctgctgtctgggttgcagattgggggacaggagagaaactaatacacactcaagatggtggctgagctgccttacacactcgtggccaggggtgcttgcaagacaggcggaagttcaaataagagcctacagaggaaatccaggccaaccacaaaatagacccacaaaggccagcaggagagtatctagtggagctccctgggaccttggactcacccagctccactgtgccatggataattttccaggtctggtattttgtcttgtattttatattctgcataatgggggacttggccggcatccactctgccacacatcctaatgggctaaccctcttctgcaactacccttttctttttctgcatctggttactaatcaagcttaatgggggaagaaagaatcaaaaacttgtagactgtaagctccaagagaacagagaacagagctgttttattcactgacttgtacctagtagatacttcattgacagttattgggtggagtgagcaaacaaataatcctacaagatatgcagtttccaatcacaaagaagcagagagggggaatgggggcctcctgattgtggagggtatcttataagcctctcctcagtcaaacatgcgagtgtttccaaggacccatccaacattgcacatctctgccatgtgccatcccatctctgcaggctgcatgactgcatggctgagggcatgttcaatgagcccctgtgggagccatgggcactgggaggcaacccactgctcttgcctgttctgaccatgggaaaaggacagggagctcagctccagctctgctactgagaggctcttcgcatatgtcaagctggacgacgtggacaccctcagagcggcctctctccattgacaataaaagtgtgttttgcttttcgatgaatcgatttggtaaaatgttttctcactctttcctagacatcgcctggtggtattaccagtatcagagaggtaaaaaacagtttaaactaacctgactttggtcacatgacttgcaaaggcagagcttcttaatcaagctcatgttttgtaattagtcttctcatgcaccagctttctgtgtcctttgttaacaagccccacatatatagaaacagttggaaatgttcttttagagacaagttacaggaaaagctttgctccccgtaagaaatggttacgttttccttttacagacatttgtaaaaactcagagcccatttgcagctcaagtgtagtaattgcttcaaacaaatggcctggatttctgtgttctctttttctccatggtcttcacctcctaatctaatcaacatatactgaggcagtttttcttattactttatctctttttatttcatatttatttcctataatcagcttcaagtcctttgtgcaacaaagtggcatgtgtttaaataaacagtgaggagtaggctatgtggtttgtaggtgggagggtaagtaggtatagatcaaaaaccaaaaactcaatgcctattgcacagggcaagcagcataaatgaattctgtgagccaggggtgaacaacaggacatcctagaggctgtggctgcccagaggggacagccggtgttcagctctagcaggctgctgaagtgtctgaatttgagaccaaaattgtcagataatcccattttccaagacaaatcagacatccagatttgtacatggatctctcatctttaaacatggacaactaattccaaaataattaagatacattttacaggtcaaacaagacctatctttgggccacactcaagccgaggatcactattttgtaacctcaaagctagacggatggccgggtgcagtggctcatgtctgtaatctcagcactttggaaggccaaggtgggcagatcacctgaggtcagaaacttgagaccagcctggctaacgtggtgaaaacccgtttctactaaaaataaaaaaaaattagccgggcatggtggggcacacctgtaatcccagctactcaggaggctgaggcaggagaattgcttgaacccgggaggtggaggttgcagtgagccgagatcacaccattgcactccagcttgggcaacaagagcaaaaatccatcttaaaaaaaaaaaaaagctagatgggtaagtataaagtccaaatcagagacaccatgagggaggcactattggccagtccagggaggagatggtcatggtcacggtcctgagcctgacagaggggtcacctcactggcgagaagacccaaggtgtgagtcctcccactgctcacagtccaggtctaactggtacacaagcacacagcttcgtaggagcatgtgtgctgcaaggctggctacaagcgagtttgcaatttgtgcttgaggaaagcagaatccactgtggggacatgtggaaaccagatatgatgaaaggggcctggactggctggattctaggtccagatatgtcacccattgctcaacgacttaggactcagacaaagccagttagtgagaaggtttagaagagatctcctatgctagaatagcttagcattggctggatgtgtttaacagatacagaaacccactgaaagtacagtcatgctctgcataatgacgtttccatcagcaacacaacatacacaattgtggtcccataagattataacagagctaaaaaattcctattgcccagtgacttcttgaggttcctgaccctgtgtgggctcaggctaacgtgtgtggttgtgtcttcatttgtaattttaaaaaaagggttttaaaagaaaagaaatgaaaataaaaaatttttaaatagagaaaaagcttataaaataagaaaataaagaaaaatatttttgtacagctaggcagtgtgaattttaagctaagcgttatcacaaaagagtccaaaagtttgaaaaaaaaccaaatagtttgtaaaataaagttagagtaagctaaggttaatttcttattgaaaaaaaaatttattaatttagtatagccctaagcataaagtatgtataaagcctacctcatgtttagtaatatcccaggccttcacactcactcaccatcactcactgactcacccagagcaacttccagtcctgtaacttccattcatggtaagtgccctaatagttgtaccattttttattttttacaccttagttttattgtaccttctctaaatttagtatgtttggacacacaaatacttaaaatacttaccattgtgttacaattgcctacagtattcagtacaataacacactgtacaggtttatagcctaggagcaaaaggccataccatacagcctaggtgtgtagcagggctaccccatctaggtttgcgtgagtatactccacgatgttcacacgatgacaaaactgcctaacaacacatttctcagagcgtatccctgttgttaagcgacacatgactgaataagcaaatgtgcagtgattgtgcattttttttcctgagagagtctaaacccctcattccacactcagaagagtctatgatcccaaaacattaaggatcacttaatcaaaatcatctactattcaatctgagaatttcctgtgtagcatcctctagagttggtgattccatctctctttgcccctagtgataggtattcatcactgtgtgaggcactcacagttagaaaatcacttcttaatatcacatgcgcagggcaatggtcccctcactcccttcacacgtaaggttatggaacaacaggcatgagaacgctgaatggcttaaaagtactttacaaacaaaaggtgctctaatttattcttgttatgtcattattgccatagtattacatctcaagttaatttttatctcaaccattcaaacttaagtctgacttagtaactagctcatcattattttttataacaaagtaatgactagcaacatctggcatcagactttgaacaaacctcagaaggaactgtcaaggaggctccccacgggttcacgctcttctctcctcctgcacacagggaacagggccattctccttcctttactgggactacctgggcttcatccagggaatccccaggtggcaacaggagggtggtgaaaaccgctgcccgtcacctgtaaagtttcctgtgaatgtgtctacagcggccagcaccacaaggcatacaaagaaagggaagggagagctgatgtgagagcggcagcgtgggcactcctgtgaggttgccacagctgtagacaagttaaatcagtgcagttcaatcaaaagtcatgacccatgagcgtcacaaccagcacgagtctacaaaggaatacattaaaactaagaccagagcacagctcacattagtgagggatgggatcatttcatggagtttttgtttcaaaatatttcattaacatttcacttatatacatgtgtgtatactgggttgtgatttaaattacaattcttactataaaatacagcaaaagaaagaagaaacaaagagagggccactggtttacctaacatccacaggcaggctacttcccagcatcttgagccccaaagaagtaaatttccttccacaaccgatgttaccacagcctgacacttagccaatgatgaaaacgaaaaacaaaacaaaagcttggcagtcagtatccaaatatgcagatactacagaatctgtttgatgtagaagttgatcctgctacccagacagcaaacaactcatttattaataaagtccagttcctccttaatgaagtgggtttaatagttgatatctcaataattacttagtgcattttttatgaaggtgatgggaaacaagtgctgtttcttgagtcggaaagagtctctcaagctcccacaaagaaatttcccgagcttgtgaggaattcagtcacaggaagatcaaggaattaagtgtactgcaaaaaacccttcatgcttctggctaagataaatctaacagtgtactggatgtcttcaagaatacctcatttactcaaaaaatacaatattcccattttctttatttgcattttaatgtgatttttgcttcatctcctttcttcactcaagccacctgggccgtacccagggaattcctaaggggcaaaaggagggatgtgaaaacctctgcagccccttcggaagtttcttgtgaatatatgcacagataaacagatgtgcattttaaaaataaaaatgcttttagatctaatgctaggagattcaaaccaacaattaatttctctgttaaaatgggttaaaatagatgtaaaatattaatatgtatataagcattctgaattagacttatgtgaatttttctccttttctttctttctttttgagaataagccctttcatttacgtagaaatgcttcagcgtttagataattgctacttatcttgttagctacaaacacaaccataattaaaggctctgtaagaattatgaattctggggaaattggccacttgtctctgtggcgtaaacagtatctaatttataacaaatcatctgccttagtcccagcaggataaggtgatatgtattgcccagcacatgagaaagatggcaattaggaattgttaccaagttacgggagcctcacacgaacatccatcacctttggggatatgtacaagatacaaacttaatttgatggattccttttgtattgggatcaaagtctcaaaagggaaagtgacaatttcagggaaaatctggtgcaatgagaccaacactgatgagagaaatgcacacaatttaatacacctgctcacctgatgtggcaactcagcctgtgcttgctgtgggttgccacaggatgagacatggtctgtgcatattcccagcagccacccatctcatcactattcttgccagcccagatttacagttgttcaatagatggatttggtaatatctgcatgacaacaacaggcagagaaggttagatggcaattgattcttgattggtgtaagtttatagaacacattctggcagggcccaaaggaaatcactcacctacccctctgtgatggtaaaacgttgaaaattccacggacttggaccttgtgatccttcagtggaagatgggcagattccttgctttaattgacagacactttctaaataactaatgcaatcttatattacattatagtccataagggagacatacttaaactactacttacaacaactgtttttagagcctttcaaatggtttgtacaaagtagctcccatttaagatattttcctagtatttaaggctatctagtagacattacaaaacaatacgctgtaaatacattcagatttttatcagtaatacttaacatgccgtaatttgaactttctgctaaatcatgctatccattcctagttggccccaatggtgagagtttactgtttctttaaataattttgtttccctttgctgtctagaggtgtttatcattctgcttacttgcctgtgtctctggaatattcagaaggttccatgggaaacaatttgaatatgcaaagaagttatttttaaagcaaggaaaatgttttcatatggatttattttgagcacttctgcctttgcctccactgggaacatgtttctctccaacgccgaagccccctccctgtgtggtgtttgacgcagaggctgacagggcagggaagtggggttcaagataggaaggccattggcagtgtgaccccagcccacagtcctagatcccaggtcgtgacaccactcttttgacagcccagattgttacctaacaagaatgactcccaagctcaaccattccaatgccatctcctctggttccagataagattgaagatgagctggagatgaccatggtttgccatcggcccgagggactggagcagctcgaggcccagaccaacttcaccaagagggagctgcaggtcctttatcgaggcttcaaaaatgtaagacccgtgcacgctctgaaggcctggggggggttcccacgtgaggctacactctccccaatgccaagggagctcataaggcgtttcccatatgtgaggctgtacaaggaaggccagctctataaagggggcatgagagggagatcacctggctagaaaggaaggctccaggcgaggatggagcaacctcaggagacagtaaacggccaactgcccagaaatttcacagggtggcacatcctcaaggaattcaccctggcccagggtcaagccttagcccttaacataatcataccttccaacctggtggtgcccccacaataatgggatttggccctgctgacttatgctaaccaggctcaccgagactgatgtgtaagccgaatgtcggtgtattaatttaccttgggaaatggaactgacagtggaaacagacactcctctcccttcgctgggacccgctctccttggaagccacatggaagccaggttacaatcaaaagtggagtcagaggacgggagttccttgtttagttgttactttaaatacattaatgtgttcctgcagtctcaggccagtttgagagctctcagatacaatcctggatattaatttattttttaagtttaactctcagagtgcaatcttattcccaaatcctggagtggtgtggagtggggtgggctacagcgacatgcacctggtcaccctccctccaggtgcagtctgtaggtagagctgagctgggtcagttccaaactgaccacagcctcaatgttctccaaactgctgacccacagggattccagcccctcctgggagttatctgacaggtgctgggatgcctcttccttccacactagccttgactgcacatgccaagtgcccagtttcctaccattagggcttctttccttcgatggcagcattagcagtgggcagccgagttggagaaggatcctgtgggaaagttttccaggcaggcactgggctcagagggaacagcatccagaaaagagaagaaatctacactgcttggcatctaccatggactcaataccacctaacataggttcataagatacccttggggaagttattgttacccccattttacaggtaaggatattgaggatcagagactggcttggccaaagtcacaaagcttagtattggctgagccaggatttaaacccaggtttttctgatcttaaagccccaaatctctccacctcacagtgcccattctctgacaatgtctcatcattttgcaaagcagctccagtcctgagatggcactacttgggagaagtggaaatgcacaggtccctgtccctggggatcatgaggaaccccagacaccaaggctgggcccagtcttctcctagtgctggccctcaaatgcctcccgctgactctctccccttcccacaggagtgccccagtggtgtggtcaacgaagacacattcaagcagatctatgctcagtttttccctcatggaggtgagtctgaccttgaaatctatcttgcccagctccctctctggtaagcagccttcccttcctccaagtcctctcttccttgccatttgcttccttctcgaggaagagacaaactcagggcaggacacctccctcatcgtgagaggtgggagtctccaaagctttagcaggaaagaactctgaaaatgaacccaccctggaaggggaagaagggctgataatgcaacatcacaacgtctcagaacagctctagaaagcaggtattataatcccagatggagtaactgagtttcggggaagataagcagtgtactcaagattgcacagctggtgagtagcaaaccaggattagattccataagggtctgaaacaggttttgccatgctggcaccaccattgtgcagggcacttttgaatcttttccttaaaatagctgagacaagctggaattttgtaaaagaacttcagtaaataccgaagactataaaaataaactaattgaaaaagaggcaggaaacataaagttgtgcttattaagccagtttacaagtgtgccaggcccacaacagctgctctgttgccctgcccgactcctgtgggaaccagctgtgtccccatgggcctgggaccacatcggtgactcctcctgtggcctccatgtgtcacatgccactttgcatcctgtcaccaagagctgtctcctgcaagacatcttccctggatcctgacaaaatgcaaatccaagtattccaaacacttcttgggccctgtttctcatgggcctttttggcagcagacagatgccttccttggtgtgtggggcccctacccagatcaggtgggggaggcagttttgtcccatgcaggccccagaattgcagtttgctgagttccactgagccactgtttattgagttctcactgtatgccaggcacagctgtagtttaaaatactttttaaaaaatttcaagagataggtcttgctacatcccattgtagagaggtaggaaagggaagctcagagaggtcgtgcttgatgcccacagtcacatagcttatgtagtacagcggcatccaagttcaggtctctctactctggagtgagtgctcatcccaggcattcatggccgttcagaagaacattgtcatgcagtcactgtgccattcatacaccaacgactccatgcatagacaggcaggagaatggttttctcatgatggctagagggaggggcaagggctcatctcactttttgctagatctaacttcacacccaaacccaaagagttgagtcaatgggccccactccataattttctcctttccatcaccctagcatcactctcctctctttcttgtcgaagccctgccttgtttggaaggttctccctgtgtggaattcctgcccccatcacctgccctccttttctgccttgtagatgccagcacgtatgcccattacctcttcaatgccttcgacaccactcagacaggctccgtgaagttcgaggtacgctcatctggggtccactctaggggtcctctggttctgcatcacctccccctctaaatctcaaggcattgggggaaggtctggaccatcaaaagctctcagtcagaccaaagacatgtttatccatttgtaagcatttcctaaagatggggaaaagcagcagcaactttccctggcctgcaggaactcagggactcaggggactaataacaacagtgtatgagcttccgggcacactgcttcccagtggcagcccctgtacttagggctttgtatgtattaattcatttactccaattcccacaataaccctatagggtagggttttattattgattacctttttacagaagaggagagtaaggcaaagagagatagagtagttttcccaaggtcaaagagcacataaatgataaaggatggatttgaatgtaggcagaatgaccctcaatacagactgttcctacagtccacgtcctcagccactagaccatacggccactgggatgatagacagaccactgcagccatggataaggcaaaaacagggctggctgtgttgatctgtgtctctcagagctccattcttcctcaagggggcaccttgcaaaaaaaaacaaaaaaatggggcagggtagggaactgaaggcaggagctcttcacagagcatagccacatcctccaggcagacaagaggacgcaggaggcaccattctgtgagagtatcacagtctgacccaaagacacagcttcacactgtctgatggcttgatggttaatgtcactctgccttttccccttctcaggactttgtaaccgctctgtcgattttattgagaggaactgtccacgagaaactaaggtggacatttaatttgtatgacatcaacaaggacggatacataaacaaagaggtaagtgagctggggccaggggtgtgagagggctccagtgaaggtaactaacccaacagaaaacagccccaggcatgaggatagcactgtctgaatgaggcaggctctgctttggggctaacagagctggtccctggcaaaataaagaaggcctccctcattgccctaccctgccctgttcccaagcgcccagaaaggattaaacagattcattctcactgggtcacctagattcagtagatattacacagtggataaaaatgacttgtttcagtgtgaagagttactcttccctagggaacctgcatttgggaaggttaggagccacaagtcaaagctaaaagttgaaatggtggaattgtaggcagcacctagaatagaaaagaaagatttttaaggaagaggaacctacaattgggtcatattggccttaaactattttgcctattaatacaaccgccaagggggtaatggaaggtacagctgtctttacagaaattatcacaaataatttctgaatcttcactgctttgcacttttagaacctcagaggacatgtctctagccagtgaaataccctcaggtctatctcaaaactcactttggtatccactgtatcctggtatctcagtggaagctggaaattggcatcctgtaacactccacttgctgagctcctgtgtgccaggcacggtgcctggaggtatagatatcagcaccaatcttcacctcaacccggcaagcttctctctgtaagctcagagagtttatccaactttcattcctcattcatttagtcatgtttttaattaacacagatttgaaggcttattaggtgttctaggtgctggaggtaaagaggtgaacaatcagactaggccccacactggagcagcatagagagatggacaataaacaggccaaaaaggaatcagcaggtagaagatattttggcagggaaggttagcaaaggcctctccaaggaggtgtcgtcatactggaaccagttatacaaaaagccaggaaaagtgttccaggcagaaggaacagccactagagaggctttgaggcaagatagagcttcatgtgtttcaaaaacagaaaggcttcagatggctgcagatgaaggtatgaagctgaagactagtgcaggatgagcctgacaggtcagcagagtcagatggtggagggctagggtaaggggcccatccatattcccctgggaagctcttagatgaacatgttttttgaaagacacaaaaggcaaaaacagacttaaaaagaatcagaaaatctgactagctctgtattatttagagaaattatattcacagttaaaaaccattcccaaataaaattataggcccagatggtggactggtgaattctaatatcaatcctacaaaaaaattttagaaaatagaggaggatggaacatttcccagcttgttttataagtccaatagtaccctgatacccaaaccaaagaaaaaaaggtcttatgaaaggaaacaactacaaaacagtctccctcgtgagcacagataaaaaagctttcactaaatattagcaaattgaattcagcaatatataaaaaggatgatacaatacaactatgtgagttttattctaggaaggcaaggttggtttaacattcaaaaaccaatcaatataattcactatatttaaagaaaccaaagggatatagactggaaaggaagaattaacactgtctttatttgtacatggtataattgtattaatagaaaaccctaagagtctacaaataaactgctaaaaataataagtgaatttaacaaagtgaagacatgagttctatttacaaaaatcatttataattctacatccaacaagcaaccagaaaattaaattaagaaaaatagcatcaaaaagcacaaaatactttgagaaaaattcaacaaaacaggtgcaagactcatacactgaaaactataaaatattgctgaaataaagtaaagaactaaataaacacagagataaatcatgctcatgggttggaaggcccaatatagttaagatgtggattctccaaatttgatttatagatttagtgtgatctcaatcaaaatcccagcaggtattttgtagcagttgatatgggaatgcaaaaaacctaaaataaccaaaacatctgaaaaagaacaaagttgaaggactaaacctaccttacttcaagacttaatgaaaatgtgcagtagtcaagatggtagggaattggcataaggatagacatatagatcaatggatcaaaatagagagtcaaaaaaactaaaagtagagctaccatatgatccaacaatcccactgctggctatataccccatgtaaaggaaaccagtatatcaaagagatatctgcactcccatgttttttgcagatctgttcataatagccaagatttggaagcaacctaagtgtccatcaacagatgaatggataaagaaaatctggtacttatacacaatggagtacttctgccataaaatagaatgagatttaatcatctacaacgtggatggaattggaggtcattacattaagtgaaatgaaccaggcacagaaagacaaacatcccatgttctctcttatttgttggatctaaaaatcaaaacaatatgaagatagagggcagaaggacggttaccagaggctgggaaggatagtaggggggctgtgggggaagttaggatagtcaatgggtacaaaaaaaatagaatgaatgaataaggcctggtatttggtagcacaacaaggtgactgtagtcaataatttaattgaacattttaactaaaagagtgtaattggtttgtttgtaacacaaaggataaatgcttgaagggatggatacccatttttcatgatgtggttattacacattgtatgcctgtatcaaaacttgtcatgtaccccataaatatatacacctactatgtgcccacaaaaattaaaaataaaaaataaatattttttaaaaatagagatagacccacccatatgtcaatgcaacagatgccaaaaagatcaaaggggaaagaaccgtgttttcacagctgtatatccatttggaaacaaaaatggacattaaccttaacctcatgccaaacataaacatcaacttggaatggattatagacttaaatattaaaacaaaagctgttttcttaaggaatacataggagaaacattcttacaactttggagtaggaaaggataaggaatcatttcttaaagtagataaatttgactttatcaaagttaaaaattttgtgctttagaagacacctttaagaaaatggaaatgcaagccatggacttggaaaaaatgtttgcaaattatataccagatatataaagataccaggataccaaaccaatataaagactggcatccaaaatatataagggacatttataatttaatacaaagataaacaacttcatataaaataggcaaaagatttgatgagatatttaagaaaagaagatatatgaatggccagtaaacccatgaaaggttgctctatatcactggtcttcaaagaaatgcaaattataactataatgaaatacaattgcacagaatggccacaattaaaaagactgataataccaagcattggcaaagatgtggagcaatagaaactctcatagatagctggcagaaatgtaaatggtacaaacacgttgggaaacattttggcatctttgataaagctcagcacacacttaacatacaacccagaaatcccattccagtcaggcatggtggcttacgcctataatcccagtactttgggaggctgaggcaggcggatcacttgagctcaggtgttcaagaccagactgggcaacatggcgagacactgtctctactaaaaatacaaaaaaaaaaaaaaaaaaagccagacatggtggtaagcacctgtggtcccagctactagggaggctgaggtgggagaattgcttaaccctggggagtggaggttgcagtgagctgagattgcaccactgcactccagcctgggtgacagagcaagaccctgtctcaaaaaaagaaaaaaagaagaagaaaagaagtcccactcctggatatttacccccaaaagaaaaatatgtaattccataaagacttgtacaaagatgttcatagcagctttattcatagtaatctcaaaacttaaatgacccaaatgtctgtcaacaggacaatgggtaaatacatcatagtctgttcatccaatggaatattactcagcagtaaaaaggaatgttatagttgcatgcagcaatgtgtatgaagctcataaacctcatgctgagtaaatgaagccagacgcaaatgagtttacactgttttactccatttacatgagattttagaaaatacaaactaatctatagtaacagaaattagatctgtggttgcctggtgtcaaagcttgagaggcactcactgcgaagaagtgtgaagggatgtcttttggttgtgaaaatgttctatatcttgagtgtggtggaggttacatgggtggatacatttgtcaacattcatcaaacagtacacttaaaatgggtgaatttgttataagtaaattatgctccaataaatttgatttatttgttgaaaaacttggtgtaagggggaagtgcctaaccaatagaagacactcaaaaaatgtgttgaaggaaaaaaatcctgtgaaataaagcaggtaagagaaaataagaactcaatatcatccaaaatatagattacaaatcctaaatgagataataggaaattaatcccagtgctctgtttaaaggctcatacctgtaatcccaacactttgggagactgaggcaggaggatgggttgagcccaggagttcaagaccagcctggtcaacatagggagagcctgtctcttcaaaacaaaaatttaaaaattacctgggtgtagtggcacgtgcctgtgctcccagctactccagaggctgaggcaggaggatagcttgagcccaggagttcaagcctgccctgagccataatcactgcaccacactccagcctgggcaacagaacaagacccttcctcaaaaaagcaataaaataaaataaagaaatgcacatgactaacatagggtttattccaggaatgcaggaatagcccagtagcagagaaagcctattaaataatttatcacattaatatatcaaaagatcaaaccatttgatgctaaaatcacatttgatataatttaccatttattcataataattttcaggattcaattaattaggaataaaatacttcttcagcataatagaaaataccccagcctggtacacagcttcatactttatggtaacacgcggagattctcactgaagaaaagatgaggcaagaaaagatgatgaagaaaagatgaggcaagaaaagatgatgtctgcacactgtcagacatcaccactgtttaacatttcctgaaagctcttcaaacacagtgaaacagaaaaggaaatgcgatctaaataggaaaaattacaacattccttgttaatgacatgattttctatctgagaaaaaagacagcaagaaaatcaacttaaaacaactagaacttttaaaaagctggcaaagtgactggtaataaaatacatatgcaaaaagaaattgtgtagccaatatatcagttgtgactagctagaaaattgtaatacaaatattctcattgtgatcacaataaaatttaaagcacatgggcatttttaaatatccataatttagatgaagagaaagaaaattttgataagtagagaaacataccatcttctgaaaggatgtatattataaagatagcaatattataatgacagcaattcttctctaattaaatttattttattttgaatcaaaatggaagtgttatttgggaaggaaatttggcacaattgttataaagttacattggaagattaatcagatgaaaatagcaaagataattttcaaaaagaagaaaaatggtgggatttgttctaccagatactgaaatatattataaagctgaaactattaaaatattataatatcagagaaggaacaggtagatcaatggaacaaaatagaaatcccaggtacaaataccatcttggttcataataaagggagcatattgaatagagaggtaatgaatcattaaatgattcttggaaaactggttaactattttggcaataagtaagtaaatattcttactcggtaccataaacacaaaatcactatagatatgtacagttgctttttaactaaaaaagaactaaaaatcatatgtgaatatctgatcaaagaatggaaaaagcataaaatcaaagttagaaacaattttttaaattattgatggctttacactgtaaatattttaaaattctgcatatcaaaaaataccataaacaaagttgaaaagtaagtgacaaacttgtttttaaaaatctgcaatttatgatgacagaaaggattgatattcctcagtagacattcatcttaacaaaggcaagagtcatattcatcgtgcttatctttgtatttctttgacacaatatctagcacatggtagatgcgtaaaaatacctttaaataaattaaaaatctattaagatattttaacaatttaataaatctacacgaatatataaagagctctcacaatccagtcagaaataggtgaacacaatgagcaaagcagatgaaaaaatagttcatgggaaaataaataaaaatagtcaatacatatattagagacctcactaagaaagtaatgtatatctttaaaaacaatgaattatcacttatctattaaattgcaaaggttttgtaaagtctttgttgaaggttggtggaaagtggtttttcatacatagttgctgaaagtgttctgataataaactttctaaaaggtatttgaggaatatgtatcaaaagcattgaaagttatgcatcccattctccttataaaaccacaccttggtatatgtcccaaggaaataaagaatagacacaaagacttaaaagcaagaagagtcttcaggtaatagtgccccagaatgtgatagccatgatatccactaacagcagatttgtaaaatgaattacagtaaatacatataatggaatagccagtggccacttaaaatcatgaaagagtaatataaaataaacattagtatgatatattaaatttttaaatatattacattttaaattgataaagtggtatgtatgatatctcaattttataaacaactaaatgcttatatacacatgcaaatatatgatactctaaaatattcaaatactaccttgcaaaacatataaagaaaaaaatacagaaataggatttagttggtcttcaactttggttcactcattattccatcactgaataaacttactagtgcctactccctttttgtaatttgcaaactaggcagaattctccccattaatctatcagacctctctggagggcagagttaataaagtaccccttaaaagaaaaagaaagtgtggataagtagcttctcagaaaagatagcaggatcttcccctggcaatcatttggagataacctcatccaagttgtaggctatgaaaatcctgagagagcaacaaaattgctctttctgtgattaaaaaaaaatatcagacaggaaaagcatcaatggccatgtagatgtgaagggcttgtaaagcacacatttaaaaataaacacatggatagagacatctatttcctcgttctatctgttgagggcacctcagagcaatgacatccctgtagcagtgagcatactagtacctagactttgatttctaaataccattcttcgataaacagaaccagtcttcttgaagaatagttgattctaagattgggaaagagaaaatacaagatgagcctggagtactttattatgctgaaggtataaaagtgcttaaaaaaaaaaaactgcaggagtcaacctgaaggagttcccaatagtcagaatgaaagcaatttgagcaaaattaaaaattattaagtactggattataacctgtaaaatatggtaaatgcccacaagtccatgctaatgtaaataaacaactgaatacataaataaatgcaggagagaaggtagctcttccttacagaagaattgtaattaataagtatagaaggaataaaggaaatacaaaattaccatcaggcaaacactacagtaataatttttgcaggcaagatccactgaaagatactaaatcagtaaggaaacttgacagacaccaccttaatcaagtgatcaaggttaacattatcagtaataagacatctcaacactatgtaactccctgatatgacgcactgagaaggttataccatcacttctgtggtattcttgccagaaatgcataacttcaatctaatcataactaaaccagggattaactcaaattgagagacattctacaaaacaactgacctgtactcatatcaaaagtgtgaggtcctgaaagacaaggaaacaaagaaactcaggctgggcatggtggctcatgcctataatcccagcactttgggaggcagaggcaggaagatcacttgagtccaagagtttgagaccagcctgggcaacatggcaaaaccccatctctacaaaaaattagccaggtgtggtggcacttgcctgtagtcccagctacttgagaggctgaggcgggaggatcacttgaacccgggaggtcgaggctgcagtgacggggattgtgccactgcactccagcctgggtgacagagcaagaacctgtctcaaaaaaaaaaaaaaagaaaaaagaaaaaaagaatgagaaactcatacagattagaagagactaaggagacacaacaaataaatgcaatgtagaatcattgaagggaaaaaaatattagttgaaaagctgagatcccgccactgcactccagcctgggccacagagcgagactccgtctcaaaaaaaaaaaaaaaaaaaaaaaaaaaaaagaaaagctgataaaatttgaataagccctgtagtttagttaataatagtgaagccatgttaatttcctgggtttggtcattgtgctctggttatgcaagttgttaacattagaggagactgagtgaaaggtatgcatgaactctctgtactaattttgtaaattttctgtaagtctaaaattattcataatatgcaaaaattaaacaaaaaataaaataaaataagcacatggaatgagactgtcccctgggtctctgtagaaaccaggtcaaacatcccaaatgctcttttacccccattctgagttgggccagaatggtcagaataatggttcccaatgtaccttgataaacacggaaactctcaggaccgagtcctaaggttctctgattcaataggtttggagtggacttgagaactgatctttttaataagggcctcagtctgtggaactattggcctcatgtgccctgtggataatcttggctgttggttcatttttcttaactgaaaacagtggcagaaactatggggatttttaaatctctaggctagaacattaactttttaaaaattcagaatagtattttatttgcctcaagcctgtgaatggggatcccacaaatcaccccccactgaagacaatgcccataacaaggtaacctacccatgagcttctgagggatttaggaattgtctaccatctcctctctaagaagggctcccacaatatatccccttctgcttgcttctaactccctatcacctgctaaagaaggacctcaccttttaatcactttcattgccaaggggcacaaggagccccaaactctgtcacctaggaagagcttgacctcatggtttccacactgtgtgcttttatgtccctgctccaggagatgatggacattgtcaaagccatctatgacatgatggggaaatacacatatcctgtgctcaaagaggacactccaaggcagcatgtggacgtcttcttccaggtaagtgcacacaccctgcacatgagctgtaagcccagcctagatcaagtcaacccacgagcatctgagcaaatgatttgtgtccaaccctgtactaagcatggttggtaacagaaaagaattataagatacattgtcctcaagaaacagatgatctccttaagctgcaagtgtacatgacagaagagaacaagaaagtatattattaaacgctagtggtatagtatgaactctaaatccataaaaatttggggatcagggtaaacacgaaagacttcattaattacaactgtggaggtgttaagcatttgtgtctgggaagtaaggggaaataagattggaaactaggatagggccagattatgagacctttaaatggaagagtttggccttgctctggtacaggatgggcagctagtgctgatccttgactaagggagtggtataatcattggggcattttaggaaaaaattaatctagcggtggagtatcagagaatatcaagagttcactctagttcaacctcccactttgcagatgggaaaagagagtcctctctggccttgtgcaagtttgtacagcaagtaacaggccagaatcagaacctcttttgcccagtgttctgccagatggacagggtagcagggagtctacagaagaagcagaataagccagcagtgaggtgatgagtgtccagagcaagtcttttgatttaaggaagctcatggggctcaaagtgttgtaatcaggacctaattggagttgtctggccagtgaaagacaactctcattctcagggcaaagttggttaatgaaatgaatgaaatgagctccagctcgttactctgagctccagcaagaaagcaggggagtaagctttggaatggagatcaccagattctgtaaagtgctttctgttatgtctttcagaaaatggacaaaaataaagatggcatcgtaactttagatgaatttcttgaatcatgtcaggaggtaaggagagatctcagggcacaataactctacatctgggaaaggaaacctggggcctggggacctgcagaaggaaggtgatgagaaacctgcacatacctgcaacccctcccatcagagccaacaacaccagcaacaactgtgaagtccacagttccactcctcaacctgacctgcagttggtcttggctaagcacaagactgaacagagagcctaagtaggggtctgggggcatgtgaaaactcagagggggtctctgtgaaaatagacttcccgagagggcaacaccattattttttagcctgcctctggcttgatgacccatttcccagactacaaggaagcagctggggggaaaaaaacctacaattgtgtgattctcaaaccacagtgtgcataaaaattgcctggaatgattctgaaaatgcatatttccaggcctcaatcccagagactctagatctgggtcactttaacacaaatgtcctggaccaatgcttctaacactttaatgtgtgaaacaatatccttgatgattttgttaaaatgcagattctaattccataggtctggggtagggcctgagatgttacttttctcacattctccccagtcacactggtgatgctgatcctgggaacacaactttcattaagtctaaccaatagaccagccccagagtccaccagagactgaactggaaataattgcttcatctacttttgagaaatccatttgtacccccacattattttagaaatgttcagagttactctgagctccagccaagaagaatagcaaatgtaagaaagccggggagaagttcctagcagatactgagcccccatcaagtttcaagcacatacataaacatcacagccaccctgttatgtagatgtcctatgtgcagggtgatatccaagatatttaacaactagaatggaatgaacactgacccccttgggggtgagttctcactgttaattcccttgagagctggttgtaaaacagcctggcaccttccccacctccaaccttgattcctctcccaccatgggatctctgcacacccagcttcccttcacattccactgtgagtggaagcagcctgaaaccctcaccagatgcagatgcccagctgaactttccagctgccagaataatgagccaaataagcctatactgacattaaccttttcatttctgatattgataatttgaaaagcagtcttaataagcatttatctactttattgatttttttgaaagagagcgctttggggggttttcttactgtatgtctctattgcatgttctgtattttacatttttctattatttcttctctgaggtatagtattgaatgtagaaaaatcctcaaatgttcggtattaagcaatacacttctaattcatggttcagagaagaaaatatctcgaataaaaataaaataaaaatatgacttatcaaaatttgtaggatctaaagcagtattccaggaatgcaaggttggtttaacattcaataattggtcagtgtaattaatcacattaatagaataaaaagagaaaaaatataatcatttcagtggatgtaattgttcagagcttcttaaaagaagcaactcactattttactagatgatttgtttcttctgaattcctctttaaggctacaggtggtgcttcttactttgaactgatcactttctaggtccccacccttacttcttgtttttcatacccttgtagagttttctccatataggaaacccatgcttgacatttgctcaccagagttacagagctctcagggaggagactcagagttctaaccctcttgccctccttttttcccaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaatcacttcttcatgactccgttaggtaagagaggtaagctgtgaaaagggaaggctagtccattcatttgacacccaattattagtgcagttgtccctccatatgtgtgaaggatcagtcccaggactctccataccaaaatctgcagatactcaagtcccacagctagccctgagggactcgtgttttcagaaaatttggcctccatatatgcaggtttcacatcctataaatactgcattttctatcacttttggttgaaaacaatctgcatgtaagtggacccaataagtttaaactcatgttgttggagggtcaactgtacttacgttgtgccaggcctgtgccaggcaatgacttcatcctccccagcccccaagccttccccagcaaacatccaatccaaatgcaaatactgtgaccaaatgcaaatgcaacttcgagacaagacccttcacaacactttgcttccaacaagattgccacttctaagaccctctgatatggaaagcctggagcccctgtggtgtgagtgggagtgcagagataaagaggatgacggggcctcctgctgagagattttaggctctagaggaccatcaagcggcttcagcctataaccagcaaatgattactcatgttgaacactgtgggtcttagtttccccatttgacatcacatttgaaagactaaaagctaacagtagcattcttggaaggaaaacaatttactgaaaccctattttgtgccaggtgctgcactaggggctttatatacattatcttatttcatgctcatgtggagcattccagatggtagagtcctggttgtactgatgaggttgctgaagctcagagaggtaagggggacctgcgtaaggtagcacagctgatagggactccatagggaggctaaactcttctcgctctatcatagacccttcctacaaggggattttgcctcaccccaaggatgaggatacttcccactaatctcattcatctgaagtcagttcagagaggcattggtgttctttgagtctgtgtaacagatggagaaacagatgcagagaaggggaatatctcaggcagccacagtcaccggcagggggaggccacaaaaacatctcctgcattcatgacacatcccactcagatggccattggctgctgcctcttatggttggaaattgtaagtgtgatgatgagaatttgttggatagttcagacctgttcctctgggcttcctgcatgtagccatgtggttccctaaggcttctgggcatgtggctggtccccagcaaagcatctacttaggcccaagagaggatctgtcctagagactcttcccatatggggtcctaacctgcatcttgaggctttatgatgtctaggccagtgttccctgccctggctgcacatcagaatcacctgggaactttgaaaaatgtgaacatctggatgccacagcagaccaactgaaggaacatccctgaaggtgggacctgggcctcagaattctttagaggccacccaggtgggtgtactgggcacacagggctaaggtggagaactgacacatctagagctgcgaatgaagcgcgtggtctgagccatccccctggccacaaggatcaattcagggataggcttgagacccacgctggttcaaacagcatgaatctccaaactagtgctgggaatgatgagacaaagatgttctccctcaccagacatgaatgagagcgcacatagccctaagacatgccagtaactatttaggaattctgagagtttatctaataatcagagggttaataagccagagatcacataaggcaaggcagagagatgaaaaaaaaaaaaaagcaagcagaaacgagcctttgataatatcattgatctgctagatcaagctgcttctgaagctggacatacctctgaccttttcaggtgcctgtgtcaggtgcctatataaggtctaggtcaggccgggcacggtggctcatgcctgtaattccaaatttttgggaggccgaggctggcggatcacctgaagtcgggagtccgagaccagcctgaccaatgtggagaaaccccatctctactaaaaaatacaaaaattagccaggcgtggtggcgagtgcctgtaatcccagctactcgggaggctgaggcaggagaatcgcttgaacccgggaggtggaggttgcggtgacccaagatcacaccattgcactccagcccgggcaacaagagcaaaactctgtctcaaaaaaaaaaaaaaaaaaaaaaatctaggtcagtggctgccttccttccccgctggctgcatgtcagaatcacctggggagcagaggaggggaatgtttttgaagtgccaaatgcctgggccttatcccaaatgaattgcatcagaatatctggaggtgaggccctgaggatcagtatgctgtaaaggctcaccaggtgattccaatgcacacctatggctgcaaacccctgctctagagcagaggaagtactggtacccctctccctgtgttagccagaccacaagtaagacaccagcatcagccctgggcacttaaaactgagaggaaaatcagcagcttagatattcagagagaattcattgtggatggaagttttaaaagtagtcctcagatggataaacaacagaaagggagatggttgtcctaatgaagagcagggaaaggacacgttgcagcaatgagagcgtattggcctcatctcccacttgtcttcttggagggatcctgctcctcttgaaccatccaacaaattctcaccatcacgcctgctgatggggactcaactgtgcagcaggtgctatggacactttgcccaatccccttggtactcaccatcaccctgcaggtagactcaactgctgccaagtgcaatcacccgagagtttttgtctgtgactctaaccatcacagagtgtgtccatgacagcccgctatgttttgggtatttgagtctctaagcctcatgttgacatttatgtccaatgttgaaagggggcctaagataaggtgtttgggtcatgggggcaggtccctcaggactagatgaaggccctctcttggggctgagtgagttcttactctgttaattccttcaagagtggttgttaaagagcctggcatcaccaccacccctccgccccactcctcacttcctctctcaccgtgtgatctgcgcacacccagctccccttcaccttccactatgagtggaagcagcctgaagccctcaccaaatgcagatgcccaatcaaactttccagccaccagaaacgtgagccaaattaggctttttttctttataaattacccagccttgggtattccttatagctacacaaatggactaagacacagggccattctgccatggacatatcagtccaaaggatcaggtcatcaacacctcctagaagaagcccttggccaatgaccgatgggacttggtggacaaatatcccagatccttctcctctcagcaggaagaactctgaggtctcttctatatcatctcctagacttccctggtaggactgagccccagttgctcacaacagtaacttatgatgaataagacagacatgtgtcctgctttcataaacttcatattctagcaggaggaaactgatgacaaatgaaattattttagatgaaatggcatgcataaatgtgtggcatgctaaagagtatacagggtggctgcgggtggagagtaagtcttctctgaagagcagaccactgagcttgacatgatttggatcatggggttctccatggacaacatcttttttgagtctcatgacaaccctgcggggcaggtatcctaggcacctatttttcagatgaaaaaatgatgcccagagtcatagaaggaattacatacacagcaggaagtgggcttaaaagtctgccaagctccaaaatccatgcccagctttatttcttacagagcataaagaccattctccacctattcctaaaactagctctgatgatatacaaacaccagaaggtgtcaggaagcagatgctatgaaaactattagtaaaaagcaatgaaaacaaacccacaaatctgagccaaattattcctcctgtaaaaggaatcatgccaaggacttgtgcaaagatggccatatgggtttcttagaggagctgaaataagcatgtccttccacatcaaaataaggctcaacctaactggcagacttcagctagccctgcagtctgctccattgccttactggggaccaacaaagctcagaacttgaagactggggggagcccgagaggcagccagccccaccgggtaggatcctgaagacccatgatatgctacaggtcccagttctagaataaaacatagggaccaagactaagccaatcattacctcccatgcctctggccacagtgaaattttaggaataggcttaaaacctaaactcacgcaaatagcatggaatgttagggcttttactgagaacaatgaaagttgctcattgtcctgcctgacatgaatgaaaaacacagagccctgggacctataggccaccattctgtaatctgcagggaagccaagctagaaatgtaggtaaagagaccacagtgattcaaggcagagggatgaaagaatgggttgctgatgtcattgaactgcagatcaagcttcatatgaagttacatttacttctagtgttcattgcacgtatccataaatatcaagaaatttgcttttctttttttttttttttttttcttgagacagagtctcgttctattgcccaggctggagtgcagtggtgcgatcttggctcactgcaacctccgcctcccaggttcaagcaattctcctgcctcagccccccaagtagctaggattacaggtgcatgccaccacacccagctaatttttgtatttttagtacagacaggatttcgccatgttggccaggctggcctcgaactcctgacctcaggtgatctgactgcctcggcctcccagagtgttaggattacaggcgtgagccaccactccaggccgaaattcactttttaaaggcaattctagttgaactttctgtaacttgcaacctgacactttccattaataagccccgtcgtctaaccctctagtgtttcttctggccactttattccccgccatgcttctccagctacatctcatcactctctactcccagcaggaagcctgccaactccagtctaccccttctgccctcatcccaaagcccagtcgggaccccttatccagactagtgcaggcgagaaacagaggtctgcaatcctgtgtcactcttccctccagtgtgaactatattcagctggtgtccatgagaacgcctaaagggggacaaggattttaaggcaggggtttgagaacgaagagtatgcagtccaccccaacccgctccctgctctacctgagggtcaaagcccctcactgttcacaatgacacagactaggcaagtgctgggggagagccggggaaagacagacaaatgtggattctaagcagaagagcaagagagaacactaaacttgctgtggtcaagaaagaaagtaaaaggaggaaagaaggaagcggggaggtgaaaggggggcagaggaggaatgaataaaggggataaagtccttatgtagtaaatgctagcccaccgtaatagcgaattttatgtgttaacttggcaaggccatggtaaccagtttttggtcaaacatcagtctgtttggcattgctgtggaggtatttttcagctgagactaacatttaaatcagtagactttgagtacagcaagctatcctccataatgtgggtgggcctcatccaatcagttgaaggcctcaactgagagaacataagtcccccaaggaagagagaacactgcctccagaccgccacgcgattcgggacggcaacatcaactcttccctgggtctcgattttagacttgccagtccccacaatcacataaacccattccttaaaataaatcagtctggccgggcacggtggctcacacctgtaatcccagcactttgggaggccaaggcgggcggatcacgaggtcaggagatcaagaccatcctggctaacacggtgaaaccccgtctctactaaaaatgcaaaaaaaaaatagctgggcgtggtggcgggcgcctgtagtcccagctactcaggaggctgaggcaggagaatggcgtgaacctgggaggtggagcttgcagtgagccgagatcacgccaccgcactccagcctgggtgacagagcgaggctccgtctcaaaaaaataaaaataaataaatgattctggggatgtgtctgtctgtccatctgtctctctccacacacacacacacacacacacacacacacacacacacacacacatcctgttagttctgtttacctggagaaccttgactaacatacccattaaaaccaaaatatgtccttcagggtgttaatgtttggttgaagaaacacagaagtttaacaattgtatcaggctgggcacggcctataatcccagcattttgggaggccacaatgagaggatcacttgagcccaggagttctagaccagcctatgcaacatagtgagacaaaaaaatgaagaaaattaggggtgtggtggagcgcacctgtagtcctagctactcgggaggctgaggcagaaggatcgcttgagcccaggagttcaaggctgtcgtgagccatgatctcaccactgcattccaggctgggtgacagagtgagactctgtctcaaaaaaaaaacaaatctgtaccaaaattagatgattctagataaccaagaaggaactgtgcgagggcactctgatgggtggtcagagcagggtggagagagggacagcatttctggagcaacttctactgtcagcaccgaagaacagcacctaatttactaacacaaccaccctctgatatacaaatagaaataaactcccctttttccagacagggagagctcaataaggtaaaaccaccagcccgaggtcgcactgccagtaattaatgggttcagaacttaataatgataatgataatgaccatagcaacgtttattcggtgctcataatgagccagacaccactctgaatgcctaatataaattatctaatttaattctcaccaagaaaaaaaatcctatttcatttgatgtcccactttatccacaaggaaaccgactcagaagtgatggagacaggtttcaggtcagctggtccaatcccaaagcccattctacacgcgcccctactctggctacctcccactccaacagaggcgttttgtctccgacacctcccccctgctgttcacacaaagggaggacaaccctgggggttctggtaatcctggaaggcttcctgtcagaggtgggccgggggaaacgcgggcaggagaagggaagtctcgctcaggggagtggtgtgcatggggcagaggctgccagggacgctgaaggctgatagccgggttggcgcggaaatgggacgccgcagggtgggacaggcgggagggatgggatgggcagggtgtgatgccggacgaaggaaacgggcctgcccggcaggtggcagagagccacagaagagctccgagggggtggtgcgtgagatggcgctgcaggctggaaaggggctgcaggcagggtgcctccagagaccgcaagagaacagcttgcgagggaccgtgggaacttcaaggaaccgcaccgccctcctggaccacccgagaaaacaggggaagtgggcgaatgagtagaccaaagtactcatgacagggcaggagcaagtgagagaccctggaggaccatggagagaacgtggtaaccgatggagagggatgaaaaccgagccgcgggtgtgagtctgaggcgcccccaggcccaccagcgtgtgagcggcaggtgctgttcgccatcagccgctagatggagccggcgcctcgccgaatgcgccgggatccgtcgcgtggatgtcaggtccgggccagggagccaaagcggcggctccgcggggaccctccacagttccggactccagcccagcgccggcttcagggcgtgcgaccctgagcttggtttaacgctccgccaccgcggccttgaaattcacaatttgtgaacaaggggacccactttttcatttttatttttgatttacattttattttatatgttatgctatgttgttatgtatttttgaacgggtctcgctctgtcgcccaggctggagtacagtggcgcggtcatagctcattgcagcctccacctcccaggctcaagccatcctcccacctcagcctcttgcaaagctgggactacaggcgcgccagcacgcttggctaattttttgtattttttgtacagacagggtttccccatgttggccaagctagtctcaaattcctgacctcaagtgatctgccttcctcagtctcccaaagtgctgggattacaggtgtgagccagggcgcccggccccaccttttcatttttgccctgaacttggcaaattatggagcaggtcctgcccagggctttcagtttccagcactttcttgccttgactcattttccctcccacaccgcagtgaggagaggttagggtcccatttttttatagaccaagaaactaaggctcagagaggcgaagagatctatttaaaatcacgcactggcccttggtggagcagggccagaagccacatttgtgaccccaagtacagagctctttcccacccacctaagaggctgtcccctggcaggcagggtcccacctagaaggccaagaccctcgcccacgcccagcagggagcctccttcaggcccacctgtgcttatggatagcttagggtgggccagggcatctgggctccagttgctcagaggctggggcagggctgggacaagtggcagagctgttcccagagtctgtttcttctgatgattggaaactccctggcagccaagaggaagaggcagtcctcggagcccaagctgccagtcctggctctgcttcctggacagccagccacagacactggcggtcagaaggaccttccctcggggcagctgccccaccacggagctcctgcacgcagagcgggagggaggaaaggggcctggcttccaagtgaatgagacagaccagagcttgagtcctggctccccgcattccagctgcacgcccttaggcaggtggcccctctgagccttgctttcatcagaagtaaactcaggatcacattctcgggactgctgcagggagggttgcatagtgaaagcacctggcaagttgcagagacttcataaatattccttcatttactctcggtttcagtcacaaaggcagctgagttgtctgctctggaatcttcccctgggggatgaagcacagaagcctgctctgggggtcacagactctcccctaagcagggtgggggcagagtgctcggtgaggggagggctggagagcaagagagctgtgagaaatatgctccatcaggccagaccagccaccggaggggatgggggggcatggggggtgggggcccactgcaggtccgaagcggcctgccaggtggctttccacgctggttggggctgcagacaagcagatgcattgaggccaggccatggggcaggaggaagacaacacaaagataataatactcgcattgccccatgtggttctacaaccccaagctggtgccaaagccttcccctcgctgcatcctcacctccgcactttacaaatcagtgacccaaggtcaggagagtgacacaaagacgtggaccagcctcctaattcttgattcagtgatcaccctggtattgcagagtcagggccccagaccatggaacaaaggggcaggaaaggcaggatgtccctccttgttc

SEQ ID NO: 1270 - DNA, 788218 bp, Homo sapiens
agtatgtatcttttttgttttgattatttggtcaacataatatttttgaaatttattcgtattcttatatgcatcagtcgttcatttcttttctttgttgtatagtagttcatagcataaatacataatttgtttatacattcacctgtcaataagctttgaattgtttacagtttagggttattatgaataaagctgctgtgaatatctggttttatactatgagtggaattgtctctttttaataaaaagtacatctgtaactttactggcactactaaactgttttccaaagtggcattaccatgagcaatgtatggaaggtttagttgctacacatcctcactgcccttggtattgtcagtcttttaaaatagccatcgtagtgtacatgaagttgtttctcattgtagttttaatttacatttccatgatgactaataatattgagtattttttcattgaatatttattttaagctaattaatattttatttttaattgtttcatataattttttacttcttaatagtttcacatttttatatttcataattgtacttagggagactattctcttttgtagttcagtttttttttacccaatcaacttatttgattcttttataattcattagtgttttccagttgattttcttggatttttcatagatataatcataatgtgcaaataataaaagtttgcctccattccaatttttaaagacatctcactttttaaattgtctaatagcataagctagacataataaacaaagctgagtttcttaaactttctttctggaatcattattggaatgggaagagttctgtagttccttcattacgtctaatgctgatttttaaaatacatattgtttataatgttaagaaaattacctactttattgtgatttttgatcaaggtgtttttatcaaatctctttcaccatatatagaaattacaatatgatttttacctcagacatgttagtgtggagaattacactgtaataattcctaatattgaaatatgtattttgtacatatgttgcaagttttattttcatatttgctatatttgaattaatatttgtaagtgaaattggtctctaatttttttgctgtaattgtcaggttttgtaaacaatgttttgaacatttcataaaagaattgaaagcattatttttctatgctctggaatagcattgaaaatacctgtttttaaattttgggtgaaactcacccacaaaattactaggcctaacacattttttattaagggtgagtatgcttcaacaatggtctccatttttcccagggcaataggttaatttcgcttatctcttttctaagcaccagtttatattttcctaagattttcatttcatcaaaattttcaaatgtacttttacagagttaaacacacttcagattcatattatttgtttttatagttatttaccatttatatttttgtgaacttgtactttcttctttatttcattgttttttgttctcatagaattgctcttgtatatgcattagttctataactttttgttgtctagttcattaatgcctgctttaatattttttagtttattttcttgtctaaagttgatttcattcactttctttctgacttcttgtgttgtatgctgaacttattttattatttcttgcttaaatatatgtatttaaatacatgaattttccttttcacagtgttttatcagcattccatagattataatatcaagtattttattattgtgattttctgaataatctccaattttggctttgatttttgctttgagatagttaatttccagctagtaagtttatttttctttctgatttttttgttagctaccaattttcttgcactaaataatgtgtattggtattttgcagaatagtatgtggtagagttttaagaatgcttcatgagaagggaacatattctgttttcattatatatataattatacatgtatatataaacacacacatatatacacacatatatgtccatataacatatatacatacacacacatgtccatataacatatatacatacccaagtataaaacttacatatataatctatcttattaacaatgctgaatttttcatagtcttgcttatttttattcactcaatctttcatggaataagagagattaatatctcctactattaattgcttctaagtatttctccccacatttcatatatgagcagtcttgaaaaagtttatgaaaatgcatactatgaaaaaactatgcatggatttcaaaacatttttggcacaaaaaaactagtactaacttcttataatatgtctggacaggatctaagaagggtaagacatcaatttgaaaagagcccttatcagagcaacatgaattctgctaaaattgaagcaagaacaaacagcaaatttatggtgaagcttgggtggaagaaaggtgaaatcactgaagctttaccaaaagtttatggggagaatgccccatggaaatcagcagtttaaaatggataacttgttttaagaagggatgagatgatgttgcagttgaagcccacagtggcagaccagctacatcaatttgcaaggaaaaaattaatactgcttgtgcaataattgaagaggaccaacgattaacagcagaaacaatagtcaacaccacatctcaattgattcagcttacacaattttgactgaaaaattaaagctgagcaaactttccatttgatgggtgccaaaactattgctcccagattggctgcagacaagaaaagagctttcaatggaaattttaaacaagcaggatcaagatcctgaagcgttttccagaagagttgcaacaggagatgaagtgtggcttttccagtatgatcctgaagtcaaagcacaatcaaagcaatggctactaagaggtcatagtggtccagacaaagcaaaagtggactggtcgagagcaaagttcatggcaacagatttttgggatgctcaaggcattttgcttgttaactctctggagggccaaagaacaacgacatctgctcattatgaaagtattttgagaaaggtagtcaagctttagcagaaaaatgtccaggaaaacttcaccagagagttcttctccagcaggacagtgctcctattcctctcataaaaaaggtcaattttgtaagggtttcaatgggaaatcattaggcatcactttacagtcctgatttggctccttttgacttctttttgtttcctaatcttaaaaagtctgtataggccacccattttgcttctgttaataatgtaaaatagaccacattaatatggttaaattcccaggaccctcagttctttagggatggactaagagctggtatcacttacaaagtatcttgaccttgatggagttcatgttgataaataagatatatgattttaatttttattttttatttcagtttttccatgaatattttgaagttccctcctatttttgctttacagaatttgatggtgtgataatttgagtctggtatctgtggttgttacagcttgtgtgattatactgtacttttatcataaaaaataccatgctttttcttgttcaataatttttgtcttgatgttaacattatctgatactatgaatttgctattctgtgcttaaaccaaaaattctattgatccaaatgcctttgcatatgcttttactttcaactgttctaagttccttttcttaatttttaatttttattttaagctctgaggtacatgtgcaggtttgtcacataggctaacaagtgtgccatggtggtttactgcacctatcaacccatcacctaggtattaagcccagcatgcattagctatttttcttaatgctctccctccccctactacaccccccctccaacaggccccagtgtgtattgtttccctccccatgtccatgtgttctcattgttcagttctcacttatagtgagaacatgtggtgtttggttttctgtgcctgagttggctgaggataatggcttccagttccatccatgtccccacaaaggacatgatctcattcctttttatggctgcatagtattccatgatgtatatgtaccacattttctctattcagtctatcattgatgggcatttgggttgattccatgtctttgctattgtgaatagtgctgcaataaagtttattttttgataacatttttatgcagcataatttttgggtttactttttcaccataggtctttaaaaaaaagcccatttttatttacttatataatatgtttgtctcagatttgccatcatattttctatcttttctattttttgttgccccttttgatggttcatctataatttagtaaactacatacctatgtttgctttatgtaggtgtgatagttctgaaacttcagaaatttcctctgtatttcatttttaatgcccctagcaccactcttttaacagcagttttttctctgatgtattcaagagttaattgactttggcggggcagggagactctgacctacagatgacaatccttaaaacttttagccttggtctcatcctagattccactcacctgctcatttatgtctcttcagggaagcagtggccctgtctattagagagaaaggaactctagagggtggaaaagaataggaaacacctgaatgtcataaaaggtgggtggacttttaacttagatctatacatcaattagaatattaattttctatagctttttattcttaaaatttaattttgttattttactactttcaatagataagttaattaaaggatacactaattaaaaagatgttaattatatctattaatctggagggaatataattctgtatttttaattaagaaaagcaagttgcaaaatcttatttgtagtatgagcttttcatttgccaaaaaattattaaacatttccccacctattttacatatttgcattggtttcgcaatggaggggtggaaaatataaaggaggttttaggagattactttaaatataaatatcttttcattatttatggtgagcatatgctagttttgaaattttaaaaagaaatttaattaagaaatttaaaaactggataactttaaattaaatcacataggaagttcagttagagaaatataaatggaaaaattggcaacaaaatgtcaaaagatgtttaactttgctcataatttaaacatttatatgtagttgaaattaaaatttaccttcaaatctcacattggccactatttggtggtctggtctatgaccactcctccttcttttttgtttgctggattccccactcaagaagtagaagaggtgatctcactcccaaactaacatgggcggctcaaagtctaagtcaaacatataattattatgcccttttcatatcaagtcttttattattgtgagtgtggtcatgtgacctcattctggccaatgggatccaaaagaaagtgtactaggtgactctagaaaatgttttttcttcaattaaaaaaaaaagtcccatgagaaaaactagcctcttctttttttatagaacattattttctttgtatgtgaccactacaatagttgtaactgtcctttggcaatgagcacagccattgtcagtgtgctgaagacaacagaacacaaaaatggaaagctcccaggttcttggtaacaaggttcagctgctgaatcaaccaactctataactaacacacctgtggacttttcatttccataactaatttttagttggacattctattacttacagtgaaaagcatgctggttaatataataacccatgttgaagacggtgtggaaagccagcatgcaggggtagagggtagaattatgatttaaaacatctttgggggatagtttggcaaatcaactacaactgcacttaaaactttttttttaatgacagggcaattccacttctgggaatttaacctactgctatgcttacatttgtgcacaaagatatatgcacagagtgttcattgaaattgtgggtgaaatagcaaaagaataaacacaacctaataatcatcaataggggaaaggttaaatagatgatttttatatggaatactatgcagcccttaggaaaattgatggatggacaaaaaatctacacattatattgttttaaaaagatatatagagtgcatttaaagtgttataaagtatatagcatgctatttttggattatgattgtatatgcaaagactttctggaaggataaagaagaaactattaaccatggttgtcttagggaggggagctggacgtctaagacagaaatgggaggggtatttattttcactgtttattctgtatctttaaaatgtgtgccaatagcatgcataatctattatgcttaattaattttgttttaattaattaatagataaaagattattggagggcatatcctttcttgggaagatgcctcgatataaaaaggactccacaaaatagaatgacgtcaggacccagtgcagtgctgtcgagttgaaccctgagggtgaatgtaagcagagccttggagttaagtagctcaggcctgcaacctccttctgcaggtgggtagagttctcctgctgctgcattggtgctggggatgcaattacaggaagaacagtttgttggggaatgagactcctgcttgctagcctggcaggtccagtgctcaaaagctgtggcaaagcagcaaactcagagtactggataaactgtcactatgtctcacactttcctgctttatacaggccacttggaaactggcagctacgagatgcagagctccggaatggtctttggagtcagcagaactgcgttcccatcctggcaatgccacttacacccagggtaaccataggcttttatttattataaatgtattttgttagctaattaaacttatttattaattttcctaaaagaattatctttaacatttttccagtagtaacaattgtgcatgttggatctacataaatctaaataaaacagaaatgtataaagtgaaaagcaaaactcctttctgtctcttaatatttcccctttgcttcctactactctgataattgctgcttatgacttgaccttatttccttcccaattttaatgaatgaataaataaacctaattgtttaacatgaatgggattctactatacattttattttctccctatatgcaatatagaccaagagtcagcacaatttttttgtgaaaagtaagatggtaaatatttaggctttatgaaccttatcctttgtctcagatactgaactctgctgttgtatcagaaactcagctatagatgatatgtaaatgaatgggcatagctgtgtttcaataaaactttatttagaaaacaagcaagtggcaggctgcattttccttcaagacgtagttcaccaacccctaatatataacaattaagtctacctcatcttttttactggcactccatggaatgggtgaagaaattcactttcatagtcacccatatatagatattaaaagtcatttcccttagaagctctcttaaataagcaccagttatccactagctggattagctgatgtctgtctcctttctcctgtgaacaagttaacggctttccgtggtatactgaaattgtgtgtcttgcacagaactccttacttcacctgtgtccttgggagttcaccagctgagctgaccagcagtctgagcttgtttaaacacctgtacttgttatcgtagtatgcaattgaattaaacagtatgttaaccagagaaatagaagtgaaggaaagagattgttgactccagaaaaatgaagttgattatttttggaaacacctaatttaaatgctttttcaaaaaaaaaaactgttgaattaggtataggttgagttaattacaatagactaaaaaccagcgagcatgtggtagactttggggtgaaggacccatagcatcagctccttgggagaggaggccaagcggccaggctgagtatgggttcaggttcagcccaggtccctctttgattttcagaaggttgactggtctggggaatctgccttctgcccgatgaagcccaggctctcaccttgtctgatcatctttcctgggtcttgggggacctcatgtctctgactacatttagcctacgtttttatactctctgaatgtgagaggttattaagcatgagattctgtttctcctctcaaaggctggtccagtaacatttaaaatagcgttaagtctgtatttacattttgatgtcactcttgctttatttccttagcagactctctattctgttccacccatgtttttctcccaagcagaatctatcttatctgacattgcaaagcagttaacattgattctggtgaatggtctactttgatttttgctacagggagattttagtacaaattcacatatattgttttctcaacaaatggaaaattatgttccacattcattgtgctgggtttgccgagcctgctcttttgaaactcactgtctcatctcttatatttgccttctctgtcactgtcgatgttttcctaatacttcatcctttacgcagactccttccttggagctgaatttggcagtggagtttgcctaactaatggggaccatatgctctgcaattacattccccaacaacattcagatttgttagcaaatattggagaaggcaagttgagaaactggagtgcaaaggacagtcaggaactggcacattctgacaggtaaacctgcatttgctgaccactggaaataagttccagttagggcttatactgacttaggtagaagggggatttgtttttttaaaatatctatcagttggtatacttctcttcaaatagctaagtgcgcctctgatgtgttcccaatggcaaactgtgctttcccctgcagatcaatttttaatacatgactatcacctgtttatttgttgatcccaaccctcccccagactggagaactggaatcatagaattcctcactgttgttttcccagctcccagcagaggactgttaacataatagctattcagtaaatatttggctaatgagcaaatgagacaatctctagaatacattaaatctcaatacattctgcacattacatctgtatgccttggatggctttttcccattctccagatccttccctttctctaggctggaccagctttactcttgggagtccaggcccctgaaaagagtgcaaactctgaaggttctgaagaaggtttagagcatggcccaacatggcaacattcatttttaagggcttttttttttttttttttggcttttaaaagttccatctgttgccctgttggggatgagcgtggagcaggatgagttaaacctttaacacattgtcctgggttttgataagctaaatgcaggggaaagaacaccatttgtctgtgcaaatggcaggaaatggtaactagcttgagagtgggtggctgaggggagaaatgctttagcttttcaaggacctactgaatgctgtgcatttctttagtggccggcttgctggagccttctgcaggagcacctgtcccattggccccagtgtggctgcgtagggctctcaggcaccacgttgaatgacagcagctcttcctctctgccgtgcctattgcagtcttgggcagcacccactgactggctccttgaagaccatggaggtggggaggtctatttgcactcgaagctgcaaagggaagctcatggtttcaatcaatccacaactttgccttcatggaggagcatgaagggaggagacaaaagctgcctgattagaactcagggacctcaccatccccagctcacctctcacccccatggcatgtaactgctacaaagacacaagaaacactccttgttttagaacacaaatacataaatttttaatctgcgaaaaatacaaaatgaaaccatgtacaagttatgtacaaaccctttttacaagacaagagagttatcactggttgttacagatgacagagttgggtagatcatttcagagcaccagcatatagtctcttcttcaattcctgtcaggtcagagtaattaatcataatcataatcataatgccaacaatcaaaagattgaaagatgaataagccacgctctttttcctcaatgaacatgtaggctgaactctgcatgtgtgtactttttttttctttgtcccctaaagaaaccttgaagtgcaggttttggtgttaagcagagaaaggtttcttttcaacatctgggtggtgggatgtgggccagaagttttaggcaggatgtgattgtgccacctgggaatgcaacgtttttaattaggatttcccaacagatctgggtttgtgtttgaaatgttgcagttctggtcaaaggcgtgtcaggctgcattgagcggaaggaaggggaggagagcgagcgctctggggcagatgggactctggttttgtgtggaagtgaggctcagtccaccttgcgggcggggctcctgtccctgccagctgccttcccacgctgaccctgagtcccatgggagggaagcactgggtcactcccgcaggcgtgtgtcaatgccttgtgtacatttccatctaagattctaaacagtggggcccggtagtgcttcccaaggcaggcatggccgagagcattggtgtcacttctgcccctgttctgttaactagcaagatggaggagaagcagcagcacagaagtcctcaagggataagcaaaggaaacctttctaaactgaaaaacctacctaaaaataaagtccactttcacctggccagaacatctcttctcacaatgcctgttcagaaaagccaccaaagcaaggtggtcgtagcatttgttttcagacccctgaaactaaggatgcagtgtgtgtgctgttcagggagggaagaagaacagtgcagtgacatgcacaggaaggtgaaaggagatgcccaccctgagacccctccctggtgagtcctccagaaagactgccgatcaccacaggttctgtccagcctccatccaccatggcagccacagtgatacatagtggccgagtgactgcccacgtgggccagacctcatgacaaactctgggaatatggacaaataagcagagttcctgcccttcgagtgagtcttttgacttgtgcctcaccatctccaacacctttcatctccaacctcatagatgatcttccctctctttcttaaaattcccctcttgtttctcatttccctggttctggagtaccctagatctcctgtcccaagaagttctacttattttgctccttcttagtcctgaaaaacttggctgtagcccacaaacacatctgccagctgatctaaacctacactttctccctaaaataattcatccaggatcctcactttctaagtgcctctgtgggtctggcttccacatctgcagggcctgttgtagcccactcctttactcccctgtcccactcctcttgcctgtgtggccttccctcacggacagctctcagcttttcttgctctggatgaacccaatgtaacatttcttagctgctgtactcactgcctccgcttcttgcctgcttctcttgttttcctattcctccacatggttctgtccttgaggacagattaggtgtgtgtccactgcacaatgaatatactctagacccacagccattgccccacatccagtccctacaatcccaaccaatcttctacaactattacgatctataacatttatttgctattcagtgttcacatttattcaaaaattatttattgaacacctgttttgtgcaacatgatctttccaatatatgtgtgccttgtgttcccagttaggcaggtgggctgtcttcctctaatagtcttaccatcgtgaggacacagcagctgctcagtaaatatcaattagcagttactgattaacatcattcaccctgccacatgccagataatcctgccttcatacctagaatgctgatcctctacttatctaactcctaaacccccctttctctagaaatcctaccttgttgaaccacttcaaaccacagcatttctcccttgtttcaactcctaccatattgaatgtgaaactatgtcattagggctcaccctttctctaatggtgctttgagcatgttttctttctttagttgtattataagctgattgatggcagaacccatattgtgctcatttctcccccactcactccttgtacaaatattttatgagtgctaattggtttctaaacaagggctacctgattagctgcaagggtgttttcataaggggaattcctatttggcagttctggactattaattattctctactatttgtggatgtcctgcctcatgttcttattatattactgtctagaaaacagtatgattggcaggtttttaaaaatttatgtatctattcctaccctctaatctactttgtgagtttgttgctgacattctagtaattcaggagagtcaggacgttctacgtctgatggtcctgtgacagaaagcaaagcaaaatgtgtgaggaaggtgctgcacacggtgagttgttgacttggagtgtgcaccctttagcactccttgctgctgagaaaatgttcagttttgtgtgcattctcatgatatcttccaggaagaactgacatctcactactttcaacctgaaaaatgcacagccattgctgccccatcactctttgcttaaaactctgagtggcttttcatgactttctaaatcaagtttcaaactttatctaggcctttagactgtactttgtagccccttccatgaagtctcatctcagttttcctcagttcccctacacaaacttatcacagtagacaaaatagtcaatctattgaaatcacattcctacaaatacatcatggcccattaagtcccatctccctggaaaaccctcatattccacatctttccagtcctgtcacccatttactattgaaatgcctccaaagcccatcaaacattgtatacctctgcattcttgccagcctacgcagttcaatgcaaactcttctttctttcaacccaaagaactactctttgtaccatatgcatgcccataactcatggtattttaaaatactgcttattatatctttttcttttttttctttcttcccagattcttaatgtataccccaagtttggcttatctttagatagggagtctcaggtcctttttgtgattaaaaaaatatgccaaaagaggaaggtctgctacaggtggtctaagtcagaattctttctccaatctatccatgtggggctgtgatatcatggagcttccaactgttgtagggctaaaggtgcctctgcctttgagcatgtaggcttctttttatacatgttttaagcaagcttaccataaaaattgaaaattaggctctgtggtctcttaagaaataaaattaaaaatgttttccaagttttcttatttttatggaaatcttgaaattattaacaactgatactttattggaaacaaacaatcagaagagactccacttaaacaaccaatatgaccaaactagtacaaactgcctaggaatcatttataattactactgtctcataaataaatccaaatagcgtcatcacctcctcaaatgacctgggatttatatgctaaatcatctctgctggattaaaaaaattgccttttgggaataaggagaggatcagaaaggtaatttaccagaagattgtaagtaaattctgtttcttttgctttttaaagagggtgagtcaagtcctcattagtgaaggtcctttcaaggctcatggtgactggtggctttaccaccattccaaaagcagcaagtaagaacaaaacagaaaatggacagattctgccctggaactcagtgttcaagctgaatggatctacttagtctcctaggagtcaagccggctcacatctcagtcaattggttggatagtctttgtttctctcccttcctacctttattcctcaatttcttccttccttccttcaatgagattctctttcacaatgaaacacaatagattaaaattacatttgtgaatgtaagtagctaagagatggttagtttattaatgaaagaaaataaccaaataaacagaggacaggaaatgaagtgagaaggaagactggttacttcctgaagattcacatggggaaacataaatggggaaaatggcaggaatttggggtctcttgaacctctagttacatactaggaattggagacatggcatagagatgaagggattaactgaagctgggccttgaaccaaaaaaaaaacaacaaaaaagggaaggcagggatgaaactgagaagaaaaccctagaaacaggcagcaaaatttgaccaacgtgatgcaggtgtgtccaaattgagaaatctgcatcttgaacctaaagagaatctaaagtgaaaagaccaggaatgaacctacctattctatgtccagagcagaaaatgttcaccactcctgagtaaggctgggagtgttgcctgggtgatgcagcaaaaaggacctttattccagtcctggacacaatagtctgcatgggcttagccaaggagaagcagccactcccatgttcccactcctaacttagatcacgtcccctgggacctgaaagagaccttagagtcatctagatgaatcactctcatttacaaatgaagtcactgagactcagagagttttaaaaacatttttaaagatcaagtttgttgtttgtaaatgtggctcttgcaccctcatattaaatggtaactagggaacttgtgctttttctcctttcaacatgaaaaagtcccaaatttcttatgctttttcacttttcctttatctaaccctaacacttctaatttcctgtttatttaaaatcttcaatcaatttttttacaaagtacatcataaggtgccagaacccttgggaggaaagattggaatgttctccaacgtgccttagtcacaatcacttttatttaaggtgttttataatggttcaagatgatattctaaaatataaaattgcttagacaaaaataaaagttttctcaaggagaaaggttatgatggtgatgatattttctgctttgtaaacagcctgttggtgacccacagcacccaagaatcattagtttgggagaatggcttttctggagccctaaactgggataggaaatcagagcctcataatgtggactgtaccaaagaccctccttggtctcaggcggatgtaggcagaaagacagactgttgcagtggagatggatgggactcagggccaaagagctcaacaagtaggaacaagccagggagaagctctggcatttgcttgagccctccagtgatttcacaaatgttatttctgtttccatttcgtttctacttaccaggcaccagcttttgccaaagggcccaacaatcagtcattttcctacccccttaacaaaatgcctcattttgttttctagtccagaacaattcattattacaacggcaacacagtatgaacttattgctctatttaaaagaaaatgaatttttaccaatttggtttttttgggggggaggtgcttatgaatcaaggagccctttgctataggaaactatcctaactattatgattttttttaaaaaaagtttagattaaaatttctagccacaaatgcatcggtggatgtgtggtggggctggagtttgcatttctgcttccagattgccttgttaggggagacacagggaagagagggtcatgggaatggagctttgtgtcctgtgtccctctaatggaagatcctttatgtggccaccacagcctgccagaggagaccaaatcactctaacaaatttggaggtggttattacgagcaggagtgaagagcccactatggttcacgaaggaaagaagagcgtggattgacgtgaatatactaaggtgaccccaatgcaaaatcattatgtaaaaaaggcctagctttcaggaaagttgtcaaaatcctagcaaaacgttctccccacaaacacatttgacttctgttggaaaccaagaaatgtttataagcctgaatatagactgttgacatcattttagtctgctgagtaggctagtgattaattataagtagtttttaaacaatccaattggacatacattgtattcacaatacttttatagaactaattctacaaaatgtgacgacagagtaaccacagtccgacaaatcactgcaggacaatgcctacgaggtggaagcacgactatattggctctgcagggagtggacagaggtggaagctcattttgcctacgctggtaattggagtacttagtggacatatgtcttcatgatgatctcattgctttgctctgatctgatttgcactaccataactaggtaccacaggtcatggcccaaagagttaatggactagatatcatgaaacttcggggagatactttggttagcttggttccattaagtgtccacagtttacattttttaagaaaatagaaatcactattacatccatgcttctccagagaccttgatgatcatatcaaagattgataattttaaagttgaaagacttgctaagttgattggaacaaaacagttgccgggagactgtacaccgagcatgcaagcgatagcagagctctgagacatcgtaattgcatctgatggctagaaaaatcttttgaccgcagtttaaagtggctaatttatttgatttcactgctggtaattttcaaaggccttttctaacagtctatatgaagtgcattcgttgctttccttttgttattattatttttaaattgttgtaacaagttcatgtgtttggccccagcaactaaataaaggagagcatgcaaattaaaatctgtctccatgattgtagaaatttcctggtttttaaacaaaaactcagtgagaagaatgactgccctctcacatcctatggtaaagtaaaactactaatcagttttacaaacttccaggctaaaagctctgagacttggggagtggggagaaagtccaccagaccctcccgaagttgacattactcgctcaggtggtttggaaatataaaatgagaagcataacagcacgtaggagtctccaccactagaacagcaaacagagcaatgccttgtgtgcatctggtcctcagcttccacatcccaggtgtgcccacaaccctcctggtgtccttagttggccagacaaacctgatctgccaattgtagaaaagcagcagaaggtcttccctttaaaaatatgaacaaaggggtgagaactacagaatgaaaactagaactacaaaaatatgactttcaactgtgaaaataaataagtttccatttattaagagctggtgtcaatgcagatcaaaatacacacccatccaggcgaggagcaggtattcacctgtccccttagtcttcttttctggatttactaaaatacatgtatacatcattggccattttaaaattgttttaataattcatttcccttaattacaattaattgtggtggtgaccatcattctcctcaaagaaaaagagagaaagaagagaaaaacacattaaggagtctgaccacttattcatttagattttgcattgtttagatatagggaagatatttgacaatgaaaagaaaaaatatattttctttctaataaataaaaataatttaaaatgctagaggctatacatgactattttagtatgttcatttataaatgaaatcattttcttttccaaaatacatggaagcaatattcaaggcagacaaagagaaagatctgtctactttattttctggcaattcttgcttatcctaacgtttccaccagtgattcagcatgtaagaagaaaagtcacatcaccatttatgaagtttgtcaggctttaaaaaaatagttctggtctcctgggagtcaacattcatcttcaacttctctgattggtggaatcaagctgcttgtggatttatattggttgatctggttagccatgtgggtactcatgggcttgatttgaatgtttctgggataggcattatccggttcatctgtaaaccatttcttttctgctaaagggcaaaatggatagagaacaagaaggagaaatgagaagtttaattagtcctagggtaaagcctttggaaagttcattgaaaaacgcaaaaaggtaatcgatagaagccgacagtgagtaattgctaagagagacagtgcagtgtagggaggaccccagaacctgaaatatacctctgcttcctgtagcaagtgatgaacaaaatgtgccactgggactcataggcaccatgggcggacctcagaggctaaggagggattggagaatggactctggcaatgtcccttggagttaatttcatggccagaaaaggtttggtggggaggggatgttgcatatatcagccattgggtacagacattgtgcctgaggagagatgtgtgcatccattgatttgagtggaacggaagggcaccatcacccttgctgcagagcgagtgatccagaatcttacacagaatcaccacctcccagccttttcttggctttgcttataatacacacacttaaagccatgtctcaactataccactctcctgtttcatttgtagccactttggggggtctaaactaaacccatagattttgctggccaaaaatctatgaaaatcagaatagcgaccaatgttttaaagaggattttgaggtggcttttatttcaagaaagaaaactctgtgttggtataaagttatgaatagagttccaagtggcaatatcttaactgactataataacccaagctgtcgacaagggagctcaatgaagtcttggcatttcatttccaccctaaatacagaaatggctgagagagaatgctgagtcagggcgtttgggggctggggtgagaatgaaaatggtctagcatcctcttagcagtgcaaagctattttacaagactcaaccctcatccccacctctttctaggattgaaattttctgggaaattggccatgtgtatagataggaaaggactgggcaaataggacattctaacttgggaatcatatgcctcactttagtggcttagggaaagaaaagaaaaagaaaaagggtaaaagctatcaagcacgtccactgctatagagacaatggcctctgtagctgctttttctgcttaccagaacaatttgtaactgccttgtcagtggtcctgaatggacacattagtgaaaactgctcacctggtttgatagggggcgttgggggtggggtatgtgcatgtttggctaatgatttataaattatctatgatcagttcatgaccactctgcttgtttctcctcagttcctacttctgctgtttcaagtgccctgagctgtcaatgtcgaggagggctgtcactggagctgggatatgcctgagtcaaagcctcgccccagtttaatgcggcagctcagtttaccccacaggaaacttgctgcctcttgcctcgttctccccaccccctctcctgctctggctcactcacctattataattaagttcactttgatttgaacagattggacgataggaattcataatgctacatcctcacagtgaagctaactgattaagtgctttaaattattccccctgacagaatgataaagttacaatctgttctgagatgatctacagcttgccagactcctacagcttctttctacattcatttatctttttgtcaagcagagttttttttttttccctaagcttcaattccatagatcttttaaagtcatcagcacatctgaattattaatgaggctttagaggcaaggttcctgatgggctggttaaaaaaggttgtatagaaatccgggactgtgtacacatcaaaataatttcagctccatttaaaaaaccatttagttcaagtgtgacatagatgaaccattatgcatttgtggaaaccaattttttgtgatctacgattaaactaacctttcagagaggagtaaagtgtgatggttatcatgttttaaaagctttgccaggccgctgaaacaatttcacactacgactttttccaggggtttatgtgtaaagatgattttcagagaggttgagcctggtgtttgtgctcaggttgcctgagctgccctcggttttggccatgctgttatgcagactgactttgcaaagggatttagtgctaggttggacatgccaggttggaagagtgaactcagctgatggaaatgagtaggtcttttgggtgaaagacctaagacagctgcaatttgctgaaatttttacaactgctgaagagaataattgttcggaatttagtctttacagttcaattcaaagttggcattttgacctttcgcggcagagagaatatcaatttccttctgctgtctgtaagaaagagagcattatttcctcatttaaacttctctctttccttttacatttcttgccattaaaaaaaaaaatctaagcagagtagcccatgttttggccatgctgcctcaacacaaggagtgagttgtgttaacacacattgtggtgaggagttgaggtcttccttatgcctgagaaacagctgtttaatttgggtgcctcctaagatataaatgtgtgtgtttttggagacttggttatgtaggatgttcaggaaacggaactgtatgaatgctctgggcgttttactaaaatgtctggtgcaaaggtattttacgaacagattctcccaacatgcttccaaggaacacacatttcaatgatcgccagccattcagcatccatggagagtgctgcaagtaggacaatgataatttgatgtattgaatcttgccttctgaagaagaaacaatgccaatgggtggctacaaaattgaccacgaggaagaggactcagggaagcagctctaatgaatgctgccatgacaaggataaatccaaatccctgactttatctccactccctgtttcatctcacataccagaaagatttccaggggctttattttcatctctaagatgagaagggcaattgatcggggtgggagggcttcctcgctgccagagaaaaatagccttatttcttaataagcttcttaaggatgagatgcctgttgtcagtgctctgagtacaatgtgtgacatgtcaggagttcgtggagttaggaaagaagagtcatttcagtctgtggctgggagggggctagtgggacaagataaaactctggaaaacaactgcagagagatgctggtagagcaattgccactgccattggcagatgtcacctatcaagaccagctatgctatgagctgtccaccatgaagaagcaaggagatgcgggctaaggagacagcgcagggcaggaggtgaaagttaagcagatctagctcacgtactagttgcatggctctgaacaagttattagcaaatttatcttagcttcattccttttctgtaaaatagggctgatgatacaaacttcctaatagtgttgtttagataaatgaagccagtacccttgaagcacttacacaggtccagatacatggtaagtaaatgtgagttgttaaggttatgagtatttggaataatatcagcgggcattatatcacagtggctaacttcacagactctagtgtctctcagattctgtgtctttcaaatggagacacagcatctccatctgaagctgttgtgaggattgagtttgtataggtaactaaagagtgctcatgagaatgcctggcccaaggcaattgctgaagcgttagcttttagagtaagtttagtactagcctgagtactatcagtactaaaggatgatgtaagcatgggtcgtacctcttgaatgtgatgacaaatgatgcccttcagcagagattctgggggtagagaacaggggtgtgtatatcggggtgtatcctgaagaacatggattgtggcagcagaggtgacagagggggatttggttggtcatcttcatttggaaggtaaaggagaggaagaggtaacctggtgttatttctggggagcttagggtttttcccctcccagggtgactctgtgcctctgaaatactggctttgactcaccaggcatcctatcccatctgagagccatctgtttcttgcatttctagtttcatcactgagatcacagggtttaaaataagggtcaaaacctcctccagccacagggctgcaggtcaccctggaggaatgggctcttgcagggaagggccccagagctgggctgactgagctgccaccagcagaggaagaaacaggctgcactgtgataattgagcttctctgttggctctgtgggttgtcagtgccatgggatttagccttttcacagtactcccttgagaagatcgcagaaaaggggagacaatgatacagcaaaagcatttggaataattggccctcttctcactacaccacaagctgaggttgagagagaaaaggctcaaaaagaaaagatgctgtttggagagagacaaccgtggagaacagtaagggctaacaaggagcttcgaccttcaagggtaatgctgtgtggtttcctgtcccgcgcttgtgataggcagcctggcacacttcctctgcccagcaaaccctgatgcctcctccgtccccacccacacatactacctcctctcctctctgtgagcaaagtatgcttatttcatagagatacaaattatttgtaccagaacaaaagcaattaccgtttatgaaaaaccttctcacttctttgcaattggctaccatgactctgtctcttttaactgaaagtctgatgctgccattctttgagcaaactgctctcccagccctcctctgtggcccttggtccagccaacaccctgaggacagattcttcactaatccctttcggataatccctctcacctccaatggttgcaatgggcatgcaatcttgcatgggagacagtcagccagtgtagtgacaggtgcccacagctacttctttatcatattgtgacaaagcagggatgggctgaaagaagctgattgagaaattgatttttaccctgtcttgacttccacaggccctggagtttctgtactctcctctttctccttcaaggagcctgttgctataggaacctggcaggttgatttaattgtctctattgggatgcagacacctttaggcttttcccatgctgcagaagagccagacaaaagctttttctggtcatctgggatcttgatgatgctgccaagaggcatactcagtgtctctactcattgagcttacagggctattcccctttctcagaagccatgtgaccagcttgagaaagtgccaccaacacagcagcatcataaggcatgtagaggcactcatatttttttaaaaaaatcaaaccaagaggacaagggtaatatagaaaatggttaaaggtataaaaatgtgtaaagtcaatttatatcaaatatttattgagcaccgatggtaaggttctgggtcataatctttaatattcagaacagaatttgaaacctctcccaattgtggcagaagtttaactgtgtgtataagagtccagctttctccatccatttgaactggctttgggaagaacctgggtagcagactttagggacactgatgatgccacgatcacccaagtgttgagactgagaaggcttcaccgtgccttctggtttaccagcctacttattgttcacccctttcaaagcccaaagcaagttggactaaatggcttacaaatttcttctcttctagaatggtgcagataacagagttcctaactttttaaatgtatatactttattttcaaagaactctcactttctacccttacttccttgttttttttttttttttttttgcgggaggcagtgaacaggaagagatataataataagaaacttgtatgcctacttcctaagtaagcagatgttctactgaaagaggaaggggaagtttggagtcaaatagaaaacaatggaggggactcttcactctattaaggaaagtataatatagtaattttggcaaataaaattgaagtagtaatgatccttctccatcatcaaatttatcattagtcaaatatggtgaattctcaattatctaccactggggcatgactgtgtgcccaaagtccaggaaaacctcaaaattccatctcttatcatagtctgttcccattccattcccatcacaatatcatctcattggagttgctaacagactgtatataaaacgcacttcggatttacttctctctatctgcccggtctctggttgggatttaacaaatgtctgaaaggcagctggcaggaaagatttgggtaatacagtgactgaaccatcagctcccagataactgggtgtgggctactgagttgatatacacagcagaacacttttaatttgagtcatactgatcaagcataaagaagaccaatgcttttgccattaataaccctcctggtttaaaggaggatgaaatattgacagagaagcaagtttgccaaatggaatagctgtaaatgttttccagggaagtttatcaactggcatcatcacttgattgagtaggtcttgccaagatgaacacagagatgtgaacagaccgatggggggactgggattggggggtggcaatgggggaagtgaaggaagctgggtttcttgataggaaaatgctttcggacttggagcaaggtaccagggtgggcagggaggccacgtgcagattaaaaggcaagccagatggagagaagttccccccaaattacccaaccccacacccaagaacaccaaaacaaactctaaggaatctagcgatagcagcagcacagcctcattgcgctgagcaatttagaaagtggaagaaggaaggaagagaagaaggaagggaaaaggagagggaaaggggagggggggaaaagcaaaacaaaataaataaaaccacaaacagaacaatataaataaaaataaacaaaccaataacagaataaaatttgtaactcctttttttttaatttcacaaaagttttcacaaggacaacgttatagaagaaaacccccagcagtggctaggtcatgcagaaccattaattgtcataccttggcccattctattcatccttgttgcactttagagagagaagtaagctatgtgagttttacaatgcttttaaactgtcatatttcctgttgagcactttaactggcacattcttatagttataaatgttctgagggcgtaactttataacctcctttgcaaagaatgcatgaagagctcttcatgatccaatactaggggatacatatatatagttatatatatagttatatatatataattatatagttatatatatataattatatatagtttatataaagagatagttatacataatataaatcaatatatagagggacaaaaataatttgaaaaaattcttccactcatagggcttgataatttacatgtatacaattattccccaccacaatactggtttgaatactacgctgcccctgtctttggtgtgggggagggtggaggttctgactgagcctcaccatttgtcagtaaaagtgcttgtcaattcacacagcaagcaaatatccaaaactatcatgcttgaggggacgggggatccaaaatctaaatccaaaacattcaccataaaaacacctttttagagatggtacagctgtgacatgttttcctcctcccttttacccctattctattcgatggaattctttgaagtaaaacttttcaaatatgtatataccagcctagtccatccataagggaaattggttatggtgaattggccagtttttaagaaataccgcactgcctaaagcatgatttgcatgcacaaagcatctgacaactatatgttgaaaaaagggtatttttctacctctcctctcatgcttactaagtgttaaaaaagaaagaaaacaaaagaagaaaaaaataactataccaaaatgtgtttggctcactgttgcactcttcttatcccacgtctcataatgacaaggagcagctctctattgccgtcattaccctgcctaaattggctacattaaagaaagtgatgatgaggaattccttcccaccagctttctgcattgggacagccagcaccgcacagctgtgccaacagttgaaggtggtggctggcttttgtctttgttgagtcaactgtggctgatcctcctacattctaatttatttagcatgtcggctcctagaaaagcatgatctgcagctgggtttgtcttcctctcactctaccattgccccagcccttcctcctacctggcattggggccctaactaatcaaacaaaggggagtaaaaagatcccctgagaatgcatggaaaaatacttgctctttcctgagcattatttattctgtacataaggtaagtaattcaccttttaaaagatgtaaaagtcccaggaaggcagtttttaatgacttacatctgatatttatgatacatatggcttttcatcccaaatgtcaaaagtgaaagaaaaaaaatagctattcatatggcaacataaggagacagaataacaatttaatatgcaatcaaacctcttttcacttaaactaaatgactagaatttgatacatccatgattggaatactattctctcctccatattaaggtgagaaatgttcataagaactcccagagggaactggctctgggacaaaaggccttggtgagtaactaaaaaaatcactgatgttctcttgcaacaagcaggtccttcataatcatctacacaaatcgtgaaagcttttcaaatgcttcgcaatacttcggcccagagactggaaacaatcaatatgttttcattgctgtttggttgcttgtttcaaataaacatgtgctaacttattgtgtgtataaaaaaagaaagaaaggaaaacaacaacaacaacaaaatcaaaacccaaagcaccctgataatcctgataaatcagaatcaacttttcttttacattaaataaacttgctctgcctaactgacgttgatcacaagtgctcccttctaatctgtgaactcgttcctgcagtgagctatttatgtctggagcatgcctttgggttatttttcccccagaatcataaataacttttggtccgtctgcttatttgctgttgtgctcaagggttttatggtggtgaaataaaaatgacaaccacatgcacactatcatacatatgcaaatatgtgtaaaaaaaaagggggggactacaggggaaaacagggaaagttactttgttggaaacaccaactggggaaatgagtggcagatacagtttcacacagtggcggtggatacacatatcaaagccgctcttcctgcacgtacttctgtttgtcccgggactccctggacttgggccggttctgtcggtttgctgtggatgggatggagtgaacagaggagctcttcttgctggaggactgcgacgagtgggaggaatgggacaggctggcccgggactggccggcattgtggtcaaactgcattaagcagaagatcaggtccgtcggcacgagctcaaactcatagggcgggttggtgatgacatacctggacagggaaagcagagatgtcacctcctgagagtaactgagtaaagaattcaactctctctgaaccaaaagcaatggcctggttactcaggactttcagaggatctggaagatgcactcctagctggtctgaggccttaaacattctttttcttgttaaatggaaacttcctctgtttaactcaataaaggaggccagccaggagcccaggcagagatgtggaattagagccagtaatggaagaaccaaacttcgcttctcgtggtctacatgtacctttctatacaaggtcaaagtcactttcaagtagcccaaccgcaagaggtttcatgaagtgtgatgcaactttcatttcataattttcggacaatcccagatatacatcacaagatctttgtttaccatgacagagtgtctccttagactattctcgctctttaccttttaaaatctactttggtgagagaatttggaatttggaattcaccacatggaagaatctaagaaacctgcctacttatcagcactactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggtgagtctcatgatggctaaattttgagaacccactggtctatagcaattgttctcaattctggctatacactataatccctggttattatatataaaatgtttacataatttaaaatatatatatgatgttttcttccttccagaccagttaagttagagtaatcagaatattttttaaaagctccccaggtgattctactatgcaagcagggatgagaaacgcttgtctctgcagcactgttgcctagggtatattatgcaaactcactgatcttggtaattctaggatgtacttttaatttttgcctgctatgaatttattttaatgcatatgagaaaaatataattggcacatctaaactgttatttctctgcttaaggtgataatatataattgtctcaaaaataaatatataaaagttaaaaagcgagtcaatttaaaatatgtgaagtaaaaatatgggattctgagatatggcagaagaaccacttatcttagggcggggtgtggtggctcacacctgtaagcccagcactttgggaggccgaggtgggtggatcacttgaggtcaggagttcgagaccagcctggccaacaagccttctctctactaaaaacacaaaaattggctgggtgtggtggtgtgtgcctataatcccagctactcaggaggctaaggcaagagaatcactggaacccaggaggcagaggttgcagtgagccaagattgtgccactgcactccagcctgggcaacagagcaacactccatctcaaaaaacaaacaaacaaaaaacaaaaaaacaaaaaaacttatcttaaacactagcaatgtaaaatatctctatattaggtaccaacagatgttatcctagtagctagagtttgggagagatgtttgtgtattcagacttttgtaattaggtgatggaattattctattaatacaaaacttgaattcttaccaaaatgtctttacatctactattagtaattatagaaaaatgcttcccatcacctccaaactcagtgttggatttaatatgggcagagtaatttgcatgttgaggagatgtatacagacctttgcctttacagtaggggacaggaaaggatattaatatttctgtgattaggtgggagggcagagttgaaaccaatactcacctctttgtgcactgactgggggtgctgaggtgagcatctctcagccggtaaattccaaaacaaagcatattatatgttttcagagctttgcagaacagatcaccataacaaccaccatcctgggagacagcaaaagaacagagagaaacatcctttttatttgcctgaaaatcaagggacagcagggaaacgggtcttttcatcaaagcttgttttggtgtctcccaagttggagggtccatgtgccaagggacggcagtggaagaagtcaacatgtttaacagactacacccaatatgtgtgatttttagggatcaggtaacaatggggttttcctctggtgtctctccagttttccacctgtcgcagtggggtttgaaagctctaaggagattatgcttctccctcactttaagtcaaagtgtaaagcttgatggtctcagatgtatgctcagctgaggagatgaacccttctctgcaaaatggtgattatgttcagtcccagctcagctgtaaccgctgtgataggctcgtgttgtcaaaactgtctgagtgataatgaaaaccaccgcaaggaggaggaccccaccaggtcctatggtgacagactctttcaggaggtaaggaccctgtgaaaagcacaatttacagacctcagagatggcaagggtgcaagagaatgtgtttccctaggagccaggggtctgcaggctgaataactaggattcgcagttctgatcagttcacagccaccttcccggggtctggggcctgatgcagaaagtgaaagcaaatgcatccacttggaaatgctggcttcagcggccaggtggcttcaggtagatgttacctgtattatatgaagggcactgggcactgcgggatggcttcactgggtataaaatgactgtctttgtccttccaatcattggaattctcatattggtctcataccaaagaacactgatgggaccaaatcttaccattatctaaagtctttatcctaatcaagtgcatcaataagtaaatgataggtataaagagccactagctatgaaaattccctttcaaaaaaagcctagtctaacataggtcccagtccatgatcaaactaaaatatggggaaagtatgcagcactgtttcagaaaaaacagagacagaccctttccttggctccttttccactatttagtctttctgggcgacaccattgtttgtgtaacaggtttatcagtttctgtgacttatggctgcatctcttaaatgcatctgtggggttgggctgggaataagggcaaagacagcacacttctgtcacagtgcctacactaggcagatacatggaatcagaagggagacgctggccacttccgtcacagggaggacatgagggaacgtgactgggtccactctcagaaattacaaggtctaggttttgatttacaggcattaaaggatccacataagattcggtttgtttggccggtggttctggatacatctgactactgactaccctggtgctttgaaaaccaccagtgcctgggtcctattcacatataaaaactaagaaacctgcaggctgaggctggccacctccatgtgctattaatgtatagttgggttgagtatccctaagctacgctaagagcctgtggaaatatttcccaaccttggctgcatgctggcatcacctgctgcttctcaccttgtgcagaggatacgtgaagagaacaccaaggagggagaaagcccactggctctgaagccaggatgccttggtgcaaattcccaataggtctagtgctcattctctctgggcctcagttgacttagaaggtgtgatactagaacttatatcaaagggttgctatgaagattaaaatgaatgactatgcatagagcaaagtgtctgatccagagtaaactataaataaatatcacctcttacagttatctacaataggaaggagaaaagccagatgcctagcttgtcacatctgataccacgttcttcaggatcaagcttttcccaaacagcaagctcaggtgacctcggtgctgtggactcacccctaagtccgcaaatggcccatcgagcagagctaactgggccacgcggcagcggtccctattggccagtgtctgcggggtgctgtagccacctctaagggcgttttcctcagcaatcagagcctccagctccggcgtggctcctccggtcaccagggtccgtatcagggtgaggatattgtcattgaagtacgtctggggaaggagagaaagtgagggaaaagtcctttaagcaaacaccctaaagtcatgacagccgacatccaaattacaacttttcttggtatctcctgtttaaagttctggcctgtctcttcaaataatttcatgtggggagtgaaaagacagcagcctccaattattccgttattttctctcttgcttggctctgctacgacagcctgacttaaaaaacccagttcaggggattttttagtaaagggctcaaatctgaataattagtgtttgccataattggttttagtagggatacaaatattgcctccccctcctaaagtctacgtgactactatgagattctggacacgtgtaataaaatgcagcctgccccagctactaacccaagcagcattgtctctgaggccctgtcatccatgtgccaggaagcttcctccccacgacaacggcaaaacctttcattaatgccacacgcttaacgatttaccacatgcgttgataactgtctaactcagaaatctcgatcaattaaatatgccggataaatttatgaaaaggtgaatgtcctggtaagtgtactttggcttttgttttctaaaataacctcagtagtctgaggcaaatatcacttattaaagaagtttccctctaagtgtacatttgtgtcacatctgaaacataacagatctgtcaggaacaaaagaatgggagtttaaaaaaaattaataggatgtcaaataaaggagctttaaaaggtatttgtcaccagcctaatttgagaaattctcaggtaagggtgtgcattccattttcctatgtaagtagaaatcaagcaggctaaaaaactcaaatcaaagtttgcctgtggcttttgaggatgcactttggaaagaggtaaggaaagatgcaattgcacctcagcagcttcttagagagtttagctggcaaggcatagtagggaacaaaccaagtaagggtgagctcaagttcccatcccaggtttgctaactagttctatgtcttggaggttgcctagtcattctggactttgatttttctcgtctgtaaaataacagtggtcattaaaaccaaatttatattcacataattccatgaggacttctgaattaagatgatagttactagcggggctggattcacaatcctcattgaaatacttacaaaaacacccattgtgatacaaaattccaactgcaaaagaatttaggaatgttatccatagcctgccagaccctaaaggaaatttatgctcagagttaagatatgcccttaggcacagaagcagaaaaaggatacttaaagtaggatatgtttctggagaggttatgggatccagggatccagagctgggctgaggggtttaatgctgacttcacctctcagaagctgtgtgaccttggaaagttatttaacatttttgtgcctccgtttcatgatctgtaaaatgtaataatagaaggctgtggggctctatgacctacccatgaagcacttagaaacatgcttggtgcacaggaagcactgataaacattttggcctcatatcagagacatgaggcctttgccaagtagaggaacagtcagctccattctcaactttcctttgaatttttaatcttctttgttttcttggaggcgtggggaactcagggctttaaaaaccaagcaagggattttaaactcgatgtggtagaaaatgggaggtcagccaagcatggtgcacacctgtaatcccagaactttggtaggccaaggtgggaggatcatttgaggtcaggagtgaggtcaggagttgggaccaggctggccaacgtggtgaatcctagtctctactaaaaataaaaaaattagctaggcatggtggcgggcacctgtaatcccagatcctcgggaggctgaggccagagaattacttgaacccgggcggcagatgttgcagtaatctgagatcatgccactgcaccccagcctgggtgacagagtgagattctgtctcagaaaaataatgaataaaatacttagaaataaatatattgaaggaggaacaagactggtatactgcaaactacaaaatattactgaaagaaattaaagaagacctaaataaatggacagacatcccatgttcctggattagaagacttgatttattaagatggaatactaccttaatttccagattttatgtaatacctatcaaaatcacaaagtccatttttttgtaaaaatggaaaaattgactctaaaactgcaacagacccaaaatagccaaagcaatcttatagccttataaaagaaagacgaagttggaagtttcatacttcccagtttcaaaacatactacaagactatagtaatcaagatagtaatggcataggatagacctatagaccaatggaaaataattgaaaatccagaaataaactcattcagttatgatctattaattttcagtgagtgtgccaagaccattcaatggagaagttaatatagtcttttaaacaaatggcatagcaacaactgggtatccacaggcagaagaataaagtgggacctatacctcacactatatgcaaaaattaacacaaaaggggtcaaagatctaaatgtaaaagctaaaactgcaaaatgcttagaagaaaatataggagtaagtctttatgacctttgatttggcaatagtttcttggacatgacacaaaaagcataaactacaagaagaacagattaaattggacttcataaaaatttaaaaaatatttgttctttgaaggacactatccaaaaagtgaaaaaaacaacctacaaaatgagagagcatgtttgcaaatcatatgtctgataagggtctaatattcagtattaaaaagccttttataactcaaccaaaaaagacaacccaattttttaaacgggcagaagacttaaacatttctccaaaaagatataaaagtggttaataaacttatgcaaagaggctcaacagctctagtcatcagagaaatgcaaatcaaaaccacaatgagatattttacacctactagaatagctgtaataaaaaagactgatgataataacaagaattggtaagaataaggagaaactggaactctcacacactgctggtgggaatgtaaagtggtgcagttaagggaggagaccacccctcacattgtgttatgcccaatttctgcctccaaagaaagaaaaagtaaacattaaaaggcagaaatgaaacccacaagcagatagcccggtgccacaccctgggcctggtagttaaagactgacccgcacttaatcggttatgttatctatagattacagacattgtatagaaaagcactgtgaaaatccctatccttttttgttccaatctaattaccggtgcatgccgcccctagtcacgtaccccctgcttgctcaatcgatcacaaccctctcacacgcacccccttagagttgtgagcccttaaaagggacaggaattgctcacttgggatactcggctcttgagacaggagtcttgccaatgccgctggccgaataaacctcttccttctttaactcggtgtctgaggagttttgtctgcagctcgtcctgctacacagtcactttggaaaacagctaggcagttcctcatatgtttgaacattgtgttgctatatgacccagaaattccactcttacagtatatacccaagataaataaaaatatatgtccatatgaaaacgtgtacacagatgtttatagcagcattattggtaatacccaaaaggtgaaaataacccaaatttccattagctaatgaatgcatgcacaaaatgtattatatccgtgcaatgagtattatttggccgtaaaaaagagtgatgcaatgatacatgctacaacatggatgaaccttgaacacattgtactgagagtctatcagacaaaccacctctgataattcaatgtacattcgtttctatttccttaagtgtcggccagtctgagaaataaagggaaagagtacaaaagggagaaattttaaagctgggtgtctgggggagacatcacatgtcggcgggttccatgatgccccctgagccgcaaaaccagcaagtttttattagcaattttcaaaggggagggagtgtatgaatagggtgtgggtcacagagatcacatgcttcaagggcaacaaaaggtcacaaggcaaaaggtcagggcgagatcacaaggtcagggcaaaactagaattattaaggaacttccatgtcctgctgtgcaggcgttgtcattgataatcatcttaacagggttcaagagcagagaaccggtctgactagaatttgccgggctggaatttcctaatcctagcaagcctgggggcgctgcaggaggccagggagtgtttcatcccttatctgcaactccataaggcagacacccccagagcagccattttagaggctcctcctgggaatgcattcttttcccagggttgttaattattaatattccttactggggaaagaattcagcaatatttctcttacctgttttcagtaataagagaaacatggctctgttccacccagcccacaggcagccagactttaaggttatctcccttgttccctgaaaattgctgttatcctgttcttaaggtgcccagatttcatattgttcaaacacacatgctttagaaaaaatttgtgcagttaacggaatcatcacagggtcctgaggcgacatacatcctcagcttacaaagatgatgggattaagagattaaagacagacataggaaattattaagagtactgattggggaagtgataaatgtccatgaaatcttcataatttatgttcttctgccaaggcttcagccagtccctccgtttggggtctctgacttcctgcaacaagagtctatttatataaaatatccagaaaaggcatgtctacagaaataatgagtagatcagtggtggcttagggttggtgggttgatgggtggagttgtaggggagggtaggataactaaaatacaaagtttctttttgatgccatgaacatgttctaaaattgactgtagtgatggctgtacatgtctgtgaatatgctaaaaaaaaaaccactgaatcgtacactttaaatggatgagttgtatagtatgttgtgtctcatttttttaaaataaatagttaaaagacaactaaatttgcactggccaactttttaatctaaggagccatgagtattagaggtgaaaattacacacacacacacacacacacacacacacacacacaattagtgatacggaagtaaaaccaggaagttctaagctaaatagagaaagatatagggatttttgtttgtttgtttaataagagtgctggttgatattgagaaaaagacaacaaaggtcaagtgataaacagtaagtatttacaaatcaaagttgtaaacaaaatgcaagcgtgtaaaacaagcaaacaaacaaataaaaataacctgtcctgagctgggaaatgaatctaggatgcagatcaaaagcattcagcaagttaatgtggccaactcctagacctgtactcggtgaatatttgaattcaaaatattaaatggagaataaaaatgacctaaaacaatgctgtaagaaatacaagtataaaataaggctaggctgaagcttctctagaaaatgtaagaggaatgtcaaaggaattttgacaggacacatttgttccaaaaattctacatatagttaaattgccaataatttgtgaaggcaactgaaatattttttgactctttgcgtacataagcatttattgatttaatttttttaaatacttagaaacaaaaattagcttctttaaagataattttaaacccttagtaactaaaatatgagcaaatttggtttactgttaaaatatatttaaaacagaattgtaaaagattattgtatatattattacaaaatggaatgcaaatgtcaaaactaattattaaaaaaatgacaaaactagctattaatatagtattgctaaaattatgttttaaagttagaaaaatgagatgagatagagatgatgatggaaataaaggcatgaaaattgcctgatcttatacaaggaggaatcaagaactactaaatttttctagacaataatacttagaaaatacatctatagaatggctggtaacaactaactagagttaaaaatagaatggaaagtttacactacagaaaataagcatacaaaatatagtccacataccaaaagatggatcataaaacatataattatgatagaagcatgtaaaaaacataatgcaagactatagcatcttatgttatataactaaacataaatgagctaaatgatcctataaaatggcaaagattttcagacttgttcaaatgccaaaatcaaactctgatatctttaaaagagaaaaagggaagaaaaaaagtatagcttcaaagaaaaattttaaactattatgttagataagttaattttatattcatagttgacacaataaagctataattttttatggacaaatattataactgaaatatagaaagcaaaactaattagaattacactagaataaatctggactaagggtaatacgtgaaatattcccactatcactgtttttagcttttacaggccaaatagatcaaaagataagaaaattgaggatataatcaggttgatttagtgtatttttactaaactttgtaacaacgattacaaaaaaaaaaatcaatggccaaaaccatcaaatctcaatacatataacaaagtataagctgtataacctacattttaaaaattaaatacaatgtaatagaggcaaaagtaaatattccagaacatcaaaaaaattttgttaagtatcctataactactaggtcaagatggaaatcaaacttagaatatgaaatattttaaaattaaagaatatttgagaatgacatataaaaatatcatgtcttgaggccaatgctatagagacaaattcagagcctttaatgctattattaaatacaacagaattataataagtaaaattaagtattaaaagaattctttttttaaaaaaaagcaggatgaaaagtgtcagttaatgaattagcaagaggatatttagtgaattgttaaattcaagaaataattccttgaaaaaataaacttatgacaatataactgaaaaaacacaaataaaattagaaataaggagaataaaatgtcagatacataggagaattaacagtattattccagatactctctttaataccaatcactggacgtgaataagaatcgctactgtttttaggcaaaaagcaaagtagtaatcatctatgaagagacagaggagagtattaggaaaaaaggaaaattccatgttccttaacatgtaaataggccatttaatgtcattttttccagtaaaattgttgtttgacatatgtgtaattgcagatttgaattggactttttaaaacttgataaaattatgctaaatttcccctggaaagagttgtacaaaattgtcctctcatgtagtatagtaaattttaaaggtttcctaaccaaatattgtagacaatgtgaaaaattagaagatcaaccagaatggatttatgagaaccatagcttagtagttataagaccttaatacaaaagttggcaaatctggctcttgggccaaatcttgctctgccatccattacttttttaaaataaggttttgttgggacccagccatgtccatttgtttatgtattgtctggggctgctttggtgctaacaaactcagagttaagtagttgtgacagagactatgtggccctcaaaggctgaaaatatttaccatctggctctttacaagacagtttgctgatccattccttagtataacaaggaaagcattgcataccacagggaagggattttactcaatgaatgatttgggggaaactggctctctgataaaaatttttcaacaatatggtaatgattaaacaatggttctttgacatgactcatattgtacagacatgaatattgtgctttcagataatatttaatggcatggtaataattatataatactaaaatgttttttaaaagtaggatccccaaaacaccatgaatcacaattcatgttaaaaatgcatacctgcaaaactattggctagggaaattaactttttctgtatttaaaatttaattttaagagtacccacttttaaatattgaatctttatggtactgggttttaagttttaatattacttttaattggctttttcatactaatgattccttttaatgttttcaattatcatatgtttataaaatgtagagatcatttttattattaaactttataatgtacactgtttcataatataacaaatcatgcacttattactttttgaattattttttaaatataaatcttcaatgtttaatggaaagttatcagaaaatgatatcctgtttattattatggtcactcatttatttctaccataaagtattacaaaaagtacataatgctctgatttggggacttccagagggaaaaataatgcatacctgaactgatagacgtatttatgtgaaagtaactgtaagtagtacacaaaatttctacttagtagttaattcttggttttagaatttggggtttttttcctataattttattttatatattttctgctgtgaaaatacatttattttaaatttctgtaaaaaagaaagtaaatgttactaaatagttaaaggcaaaaaatgtagccacaaacaacttcacaaaaatatagcaaactgtttaatctcaagatgcttgatagttctcatgttcagcatgcactttttatgcataaaaactgaattcactatataaaatatgtatttacatcattatatacagattaaaaactgatatgcttcaaaactatcataaacacaattaaagggcctcctaggaaaaatgacaatcggcatttgccataatgtatgagatggctcagtatgacgagagtgtggattggtaaaattgtttcttggagatatcatgacaatatgtatcaagaaattttaaaatgtccctatttgttaaaaaaaaaaaaaacccagtacatttgcctcaatataataagttgctacttgttcaaagatttatgtacaataatttttattacaggattaatcattgctataacaaaaattttttaaagctaaatagccaaaaatttagtgataaatcgattctggaacatccacagactggagtctcataaagtcctatggaggctctgcaaatcatgacacctaaggaaataataaaatactctggataaaatattaactgaaaagggaaaaaataaccaacctataaaatgagataattctgtatttatccatccatttagaaggaaagacaccaaaatattaaccatgcttatccttggtgttggaaacataggccatttatattttcttctttatatgttttctttttatttttatatgtttcttctttatatgtcttcttttatatgtttctgtgctttccaaattttcatcaagaagtatgaataactgttctaataaaaacacagtcaattttttttaaacaaagggcactataggttatccattgcaatgataaatctagaaggtcaggctgggaggttattgttttgtcaaatctttgggatttgaccctaacatgttcccacttctgtgttgaaatcagttatacccaaatctttttgatcagtcactgacatttattgagcacctactaatcgttgggccttggtttagcctgaaattgtgtgaaagtcaaagagtgcatgacttttagaattgctcatcaacaggtacaatttcatagtcagtcccagggtttcacaggtgtctgaacaactctgggaccactcatatctctgagcataattgtctgctctctgagctggcactgcatcccagatgatggctctccttgatttttccatgcaggcatccaggagcagagctgtggggcagcagaatctgtgatgacagagaatgatgatgtatttttgccagcagatgcttttgctcctgttttgataccccaatattcggatgcagaaaaggactctgagcattgctgacgggtgtgctctgcacacctatctcttcaggatctgaataatttggtggaaagacaatgccttttctggaaaagggtgtcaggtcagtcatattggaggatgcaaatttccttatgtgatgggagtgagggttggggtagggcacttcacggagcattcagcagtctgcaattaagcatcactccaaggctttctgcataggtgatggctgtttctgcatcatggggcaaaccaggtgctagaacttcaaatgccaattaccaaaggcgcttcctgcggaggaaacctctctacaactcacctgacccagaaggcacacatttttttctgggttaacataaatgctaaaattgaagaaatgaaacattctaaaggcaggatcatgtaggtgagatcctttgcctcctaagcttttgtcctgccagtcttttctgtgccttaccatgatacctgtgctagaagtcttctgggaagctcttgtatagaacctccaactctggcagggttagtcttcagggatgcttcaggcagagaccttctcaatatctatccttgcgtcacatgggcattgagtataagacagctgagttagggtcctgttcagagcctgggatcagggaacccgcatagtctaaggaatacaggagtccctcttcccactgccaaggacaagtttgcaaacctgactagcgaagcccttcttctgattaaggcaacgtggccccctggttatgagtacagatttccaaatccaattagtgtggcttttaatacctgctttgctatccaataggcacaacaatgaaaaagttgcctaacttttctctgccttgaattcctcatccatataacagagatgaaaaaacaaaacaaaacaaaaatttatagattagagttaaatgagaggatttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacagggaaacctgagcccacagcgccatctagcccgcttggcccacgccccgctgtgcctgcaagtgtaacccgcccaagcatcctcctctttttatttttttaaagtataattaccggagcttatgtttcacagttaatgctgtcaagccttttaaactaattggtcttttatagaaaatttaactgaaaattaacacatcttttaataacattgccttaactttaatggctctctgcctttcgtttataattgctctaaaattgtcattttccatgtcatagctgccattttttatatttgctagttttcatggtgtagatttttatttttagtatttttctttcgtgagggatgaaaatgattggatttttttttccctaccccaggcctgcctggcctgatgtgacagcagtggtctgtcctgagtctagcaggacatacctccatgtacccgactgacaccactgctagctcctctgcctcgggacggccatgtgccctctgtctccgtgtgagcagttgaaatggaggctcttgagtggagtgtaagaaatagggttatggagcaataaattgtttatgtaactaaaatcacatggcattaggttagcttggactgatagagaactcaggcctctccataacaccaggttcaagggtttggcccttaatgaaagtacaggaaagacagtaaatcatgtgaacccacattccagacggtcacaccctccagtcttactgatataacttcgtttctggcaaacaggccagctctctgatattaaagatgagaacatggaatcatatcttctgggtaccccaactcatctacccactaagctcccaaatattatctaagatgtgtgttcatgaaagagagaaagagagaggataagtgcacacaaacacataaatatatatacatatatgtacatgcatatataccaaaaaaatctgcttctttgtaattacatgtgatcttaagaaatacgtatctgctctgtgaaagatttttatatgcctttgccattctccaattagcagaaagtcataaggagtaacatcattcccatttaacagtagaaaaaatgtgcaagggctgccggtgagccaggaccagaagctacaagtcctaattcatggcccagtttccctcctccaagtcactgcctttgttctgaaaatatgaatgcactggacatgcaaactcctgccctgggcattgtggtgcagtgggcagagcaaagacacacctgccttaactggctcacattgaaatttctctctagctcctgggggatcctgcgcatgggtctctccataggctggcattcacgcttctcagatgtatcgtacactagcaaaaggggcctctgcttttctctgctctttctcttaacactgttataatatgctttttctttatttttccagattaggtaggccctgcaaacctaaagcttcattaaatcttgttttctaaaaaaaaaacgacaacactcccaacttgtgtgcattggaactcattagctcttgtagtagggttcccctttttctcctcagaaggaggtggctcctcactgctccttcaataacgatggttcagtgtgattggtatctgtttaggaaaggtccaaggctcaaggaaaatggacatcatgtgcacaacctcctaactcagaggacaagcaagtgaccggaaggccaaggatgctgtctgaccacagacattgcaatgcagacacataagattagaagcaaaacgcaggaggctggtaaggccaggacagtgggatgaaccaagcagggaagggacatgaatgaagcaggcctggtgggatacaatagagagtagtgtggactgtggctaaagggagcagctgctcagctcaagccaatagctgctttacgggaatctgggactctgccttctgactctaatttaaagaaggcaggaaccccgattttatataaaatcttattttaaaatattggcaacaaattcaatttaaaaataaaaacttgataaatgcagaagttgtctgtggggtagatgtagactgcaatgtgacatttcgagacttctattacagatcttttattagaaacaagatatcaagccaagtactatgccaatatattgtgctatttcttcttctaaaatgagtgcatgaggatggggtgttggacaaaaaaataatcaagggttgcgcttcaggaatcaactcagtgatgagctcactgtcctagccagcgtatccagaaacagtggcattaggaggaagctggtggctttcagaagaaggaggatcctctcgccaagtctgaagtgtctcattccagacttagaacttggccagatgtggtctattgtactcggaatactcagtgtggccagcggccttgccttcttgattgccttcctgtctaccacattccaaccataatggcctccaactgcttcctccaacaaaccaaacccagcttgtcaccactgtgcagctttggcctttatagtgttctctccctctgtttttttcagtgtcagcttcaatgttacctcctaggataattttactctgaccactgagggtaaaacaggtctccacacccattcaagctatttcatgttcttcaaatcaattatccttatgtgacactattcatttattcacttacctatttactcttaacccactagaatgaaagtttaaataacatgaaggcaaggtcttcatccttcttttttacaactgaatccgcagcatggggaatcatgcctggtgtccagtaagtgcccaataaatgtattgattaaaaacactagcaacaataaatacatacagagcttgtcaagtgctaagcaccgctctaatcgctttacaacctttacccatttactcatctctgcaaccctgtgacataggtactattactatcttcattttaaagatgagaaaactgaggcacagggaggttaaggttacccagccagtaaacagcagttctggaatccagatctaagccatctggcgcttgagtccatgtccagtattcacttttcagggtccaagtggagcttaagttggggctggggttgggagaaagtgatagctggatgaaaaagaaatctgaatactcatatgtgagtctcatccctaaaaacagagaggattcctttcacctggtgcgactgtgtgcatcaagatggtatcattctgaaaaatacatttctaagttgtgatcttcttagagacatatatccaaaaacctaattattccctctcatcctgtgtttctgctgttgatttgtgagataaagccacagggccatgtctgtaacatcctgatctgttccaggaatgcctgtgatgaatcaaaatattattcttttaacaaatgaagcagtaagcagcaggagttgggttatgaaggacaatattcagagaatgtttagacacatgattaaatgacaatttggggaggagcgctagaataaggagactgtcaacagctgaagagatttgtgtgtggatgttgtgatgttgcttatgagtgaatgcctgcaatgaaagtttacctctgtctcctgctgtttggaggagtctcactttctcaatttatattcatgacagccctttttgttccttctagttactgccttggcacttgactaatctgttttttcatacattaaggttggggtagaatgcaaagaaatcacaggtaacattttaccaaaacgtctggatccaactagatttgtggactcagaccctactcaagacctcattatgaagcttgttcatcctagacaatgaaaacaagacctggaataatttgataggcattttgattaatgatttgaaaagttaccatcaatgacttacttaaatatgtcttgcttcaacacttaaaccaagagtattcacattattgtccaaaagattcgatagtgtagctaaagtgcctcgcacagttctgggcccttagtaaatgatgctcctgatgataaatacaatgacagttaccagattcctgatacccttttatcctaggctagaatgcagaagacatgctgctcccatactattgcatccaaacatgccttagtcacactatcccaaacatttttgtgtgcatttcaaaggagatgagagatggcttgtttaaaaatttcaaatcaattcactttgaattctcatttgaatttccaagaactgactacctactgatgatatagatgcttgtgcaactcaaatccagatgggcccccacctccaccctgtggctaccatatgcccctttggctgtgttgaaaagaagttctccagtgctcaaaccgattttattccttggaaccagggctggtttcatgggtgttcagcctatgtggttgcacagggctgtactcagacacatctctgttgttttattttattttattttattttttgagacagggtctcattctgtcacccaggctggagtgcagtggcgctatatcatctcacagcaacctccacctcccaggctcaagcgattctcaggcctcagcctcccaagtagctgggattacaggtgcacaccaccacacccagctaatttttttatatttttagtagagacagggttttgccatgttgcccaggctggtctcaaactcctgggctcaagtgatctgcccacctcggccttctaaagtgctgggttacaagcggtagccaccgcacccagccccaagtctcttttgttttaatactctgctgtcaccattttgaaattcttaataattcatgaaaagtgaccttgcaaattatgtagccagtcctgctagaaacatactaaatatctgatatgtagaaacataaacaattttataaatttggaattttaaaaatgttatcagagtattttgtagttctgaaaaaaaaattctactgtaaatagtttaaccagctcttagaacagtcttctgagatctctgtaattaggatcagaactaaaataaaaatttctaatgagatgaattaccaaaatccatttgaaactggatttgcagaatatgaggcctatgactgagaatatggtcttcttaggaacacatcttgaggcttctatcattccttctggcttgctcaaggagtttgcccaaactgagcccaacatcactagcaggtagaaaggttagccttggtatcatcaggccataagaaagatcatgagccccaggaaaccaagggagcccttttccaaggaccattttatctccttgttggcttggaaagccatggcatggcatgaagcccagttaaccttaattcagacgaatgtcatttcacagtcatttttaaatccaaaattctgatttttaaataagatatgcttgcagttggacaatgttcaggcatacagaataacccaaattagtcttaaaaagctttatgttttttctttcctcaaatagaggtccttctgggattagcattatttaatgaatagatgagaccagtacataattagcatatcagttgtttagcacattcaggagaataactttcagcactttaagaaatatacgtgtgtaaaaactctgagttctgtttatggttttaatgtgttcagaaaagctctttatcatggattctccaaaggtcaagtttttgttcagcctatgtctgcattttcacaaattgagaatttgagaactccaaaatgaagaagattttctacataataaataaagatgctcagtgggaagacttcataatacccaggttatgactcattctaaatgcctacttttgccttttgcagtgaaagatggctccataatgttgggacccattttttaatcgttatttgtttttcggttgcaaaagtgaaaaaacaaatgcctgattgctagatgcacatcaagttataaaagaaaccaaagctgtgtttgatccctgggccagcccactgtcctctctctgccactaactcctccctccttccagccaggccttgcctccatgcctggttctctcccaaggacttcagtctcagtgacaggcctggcagtcatctttgacccactgtcctctccaccttctgctcatgctcaatcttttcccaagtcctattaattgtactgcccaataccactgagctccatccacctccctcgatcccaacaccagctctatcctagtccaagccatgacagcctcttactcagacctcctgccgccatcttgtacctctgaatcatcctccctacaacagccaaggcaatccccttaaagcatgaacctgattatgtcactctccaactaaaatccttcagtgcctcttcattattcttaagaaaaagtccaaaaccatgaaaatgtgtttcaaggttctgcaggtctaaccttggccatcctcctgcacccttgtctccccatggtccagcctcacagggtttctttgccttctttgagagcctcaggtcccccccaacaccaggttttgcatttgctttctttcttcttcagagaatgctcttcccccaagatctcccctctttatggctcaaattttagcataaaatgtacaactcccttggggaatttttctgggatccccaaaaccaggtcaagccctcacctatatttccttctagcctgccttgccttccttgcacttgaggaatttataatcaaacatttacttgtgtgatggttttataatgtgggtctccccttctaaggtgtgagcttctaggagtcttgctctccactgtggccccagtgcagcccagggcctcaaaggttggaggtgctctattggcacatcctccacccttgagtgaggaggagggaacaggataactcaccgcgctcatgagtgagtccaggacactgacggcaaatgctgtcccacaggcaaagggctgcgtgaggtacagttctgtatcagggtcatcatcatcgtcttggtccaaaaactgaacattagtatcgttcactagaaaaagcataaaataagaattagctctgaagaccacacacaggcattgaagccagagggagaccaggctactggtttagaaatactgaagtcattgagaaggaaacaaaagcatggaataagctgtagatggatctttgggtaaggggggcagtgggactcaatggactgttcctgtgtcactgtttaagtgtctgagacctggagagcaataagttcaagcaggcttgctccacggcaggccactggaggaccaatagactgtgctggccagtcctttggcatagctttaggatcatgacctaaaaacactttccagtgttttttggtaaccaagtcctttgagagatggacatatttcaatgatgagcagccatgctgggatagtcattttagccacaatgaaaagaaagcagcttattgggagtaaagagcgctggaaggggagcacagcaaaggcagatagcaaggaattcagccacaggcataacccgcagcctacccactgggattggcctgggtagttcccggggtcccaggccctaaatctaggtccacacccaataggccctgtttaatacacaggaaaccccaggtgggatggatgcctggctgtctcctgctgcttgctgacaaggacttgctctgaattttgagttgcatggggacgcccacgttctccctttcccatcctaaacagctcaatcttttatatgcttgcattcaagcagatgcagcattggatgctgtatttcatttccatctgaggattcctcaaggactcctcccgcatgtacgtgcaggctgattagttgtgtcactcagatgtctttaacttattaaaaattaaatgacaaattaatttccattcccatcttggctttggaaattatcagttttgcagagcaagtaataggggaaaagtcggtggggggatgggagaagggggcactcaaaatttctgaaataattattgtgattttaggaagagaacagatgaggtttcctttccctgattcctttctaaatgtatcaacagctaattcttttttctagagtgattgttttaatttttaagcaactttcttgataactcttcttttttaaaaaaaaaaaacttttgtttactgtatgaagcagaataaatgatactagcatgaaaggctaggcatggaattagtattttaaaatgacatcatcttgtttccccagagaaaaattctaatggggaaaatctttgctctgttcttccaaaattggtcacatttgggtccccattgtttaagcagcaattgaattgcaggctagtggtgaaagtccaaaatccaggctctgacaactgggcttcagtccagcctgtgctgccaacttccttgggcaaagcatttcatcattctataccttagtttgtttctgtaaaatgggggagttacagcagctctctcatgaggctgtcaggaggctcatacgaatgggatggtgcccagtaagcctggcccagcatctggatcatgccatgacttgataaataccagctgctgtcatgatctcccttctgacattaaatacctgtccacccattatagcatgaaaatacccagcttccctctgcctctcttggaaacactgaaggtcttgctcaggggtctttcaagaggtagcttttcctcacctcccttcacttgtccaaagggatgttgtaggccactgtttagtctttctgttttgtgaatcagaaaatgtaaactggagaccacatatggaagaatgcagttttagttacttgtaatagccaccaatggtgtgtgtggcaatgctccgaaaagcacagcatctgttacctcttatcaggaagatggggaagggttggtaccagatatggaggtgaagtgactccaagtagggggaggggactcccgattgccagtgagctagacatctggggtcataggaaaagcgctccaagagaccagccagggtccagtgaataccttgtataccgttctgaaatacccagtctcagaaggagagcaagcaatgctactcaaggcctatttcacagaacagtaattatgtgggtgctaagaggtacccacgtaatcaccccaaagcatatgtggtcaaatacaattggaatagtcaggtgaaacagctgtaacacagtcctttcttgtgagactctgaggagcctttgccatgctaacatcaattgagagtctccaagtagatgaaaagtggaatgtgctacacagctttgaaagcttgtgtggccttggtgccctctgtgtctcttaaaattcattatactggcctggcataatgcagaacacatctcagaacatgtagataaataagaagtatttgtgggggatgtgggaggtgaaatggtctgaggagggtggtatagtggctagagaaataggtttcaaggcagaagacaagggtggtgtgagcacctgaaagattctctgaacacaaggaagaaatctggtgtgggacaaaggcttcaggagagtcaatgatgctaatcaaataccagaattgttgccttaggtttggggcaccaagcttttccttttctcgtctactaatgacaaattaagatatcctagttagtcagcggcacgtgaattccaaatagaaaatgaaattcccggcagtgaggattctgaaatgctgctgtaggtttgtgagatggagatgtttggattaattttccaaccagaggcgtggaccacatgagccctgggtctcttattgccctccagttctgaggagagcaatccagaaacctagggcttttaaacaactacactaaacatgaaaaagatacccctcctatggttggaaacagaaaatagtgtgatactccctgacctgagtgaatttgtcctgataaatagctatacctacaataatgcactgctgagtggtggacaatttattccttggtttctagacatctcgcaagcaagattactgtgttgaaagcctgctcccttattttgaaatatatttttgggccaagaaaatggggtgttcatttcatttgtgagtcatgtgaaggcaggtgctcccacctctctatccacccctctgctgagcagcacttttgctgtctctatttagaagatcaatccccagttctgagacttgctgctgatgggtgcccttcatggagttattaaccaagtcacggggaagtggggaagaacctaacaaatgcagtcacgactggaggcctttatcgtccacctgagtccattgtgaatctcccagagaggattctgggctgggattgggggccagagtgcagggctgcacgtgggtggctgctaaccttatcctccgcacccttcttgaaatctgcctttagtaaaaaaagttctcctagggaccaggtgtttttatggcttcagaaccagagcttctgagaaatgccctagtaggggggaaaaaaaaaaaaggcaaataaagtcagaataaagaaaaataaacagctggagggaaagtgccatcttaggtttcttatcttaaaattttgatattctcctttgacttcctctaagagctgtgaagacatgtcattcaaactgacagtatgttggaagaggagtagaagggagaaggcgggagagcggggtgacaaaaaaaagtggggaaaaaaggctcaggccagagaaaatgaattagagcaaatatgctttggaaacaactgccaggtcagatgggtgtgatcaaaggtttactgatgctgtgtggggaaaaaatcattaagaaaggccagaacaagacagtcgattccaaccagagccacaaataaaacacattcaaagcagtgccatggggtagcctttctgttacagccggtgaaataaaaacaagctgatgatagttggaaacaccaacaacagaacaaaaggagatactgatgtgaaggaaaacagtgcttcttacccagttcagttatcattagaatgtgcgtcccactgtttttttcctgattgactgataccaaaggcaacttgcccggtttagctaattggatacagcatttaagggttggggaaagggagtggaggaaagtacagaaaaagaagagagtgagggaataacagaggaaacattctcaagtaaagggaccccggaccacaggtagtttgcatttgtcttgggggaagaggccactctacagttttgcacactcactaatggtaacagggagtgccatggccaggttagaagttagattctattgtccaaccaacatggccctcaaaaccccatcattttgggggccagaatggcatttgctgaaaatggcttttggctgagatattcaactacgatacgttaaatgtcaagttattacacattagcccagggcttctaccttgttcccaaaatgggtttggcttagatccgaggctttgtatatcagtggaggactcagattgtaggagctgtccagacagaatgctcaaaagaggttcttacagtaaaaatcaccagaaagaatccgtgaactaagcctttcctcctttcctctccattcccaattgaatgccccaatcgcaaatccatcatctcatgctcctttgaaaacagtgaccagcatgaaggaaactgtctattcatctcagaagaaagatagatcagttttcccttccggtaatctgccatatttctccccataccttcctcccagccccctcaaaacaaaccccatagcagctacaaagttgaaagggctaagaaataaaccaacctcctcatatcctgtatggtttgaaagacagaacaaaaactccccccaaagctgacattgacccctacctagttcagtgatgatggggatgttgaccccagttgtgatggatggttgacgtaacatcccgtgcactgggctgttatctggagaggatctatccattcctggaggtgtgaaccctagtgggaaggaaacagaggaggaagaaaaatcagagaagtagaaaatttggaaataatcagagtacactatatacatacaaccccaaaaatgtagcttatgcattattcacaggtcaacaattagtattcccgggataaactctgatgattaattctttagaaggacagggtaggaaaccattataaataatcgtaactcacttcatagttccctaaaaaatccagacttcataccaattatttattctgctcatagatcttggctcccatctctttccagggacacaggagaattatcccctgtgcccccttgaagttaggtatggccatgtgacacatgaaatgctctggcccatgaaaagtgagcagagcagtgcatatcactgctggttcaggtattggacagccatctctctcttcccaggccatggcaactgtgagaatacaggttactatggagatgaaggctagacaacagccctggacagttacccagacccacaaagcatactgagtgagtcaagaataaagctgtgttgctttaagccgctgagatttgtttgtttgtttgtttgttgttgttgttaccacaacataacctaacctggcctgactgttaccgtaaaccaatcaattgcttatcctcttgctggtgagtgacttaggcctcagttttcacagagttctggccaatgggaggtgtcaggaaatcttcctggggctttcaggaagtgtttccttgctcttaaaaagaaacacataggaagagattctcttttaatttactgagcacggttttatgtgcctgtagtgccaggaactgaggcaccagctgagggcataactaacttagtgatattggctcaagtgaatgacaggaagagctgtcctggagttcctggggcaagcagcctggagccatcccacctcaggatttctccctatgtgagattttatacacataaacacacacacacacacacacacacacacatacacaaatgtatttatacatatacatacacacaatataataagatgttcacatttttttctttctgtttaagctaaatggagaaggagtttacttgcatctaaatcctcctgactaatgtatatgccacctgcttatggctgatcccttgaacttcccagtgtgccaaacacagaccacataaggtatatgtggacacaggaaaattggaaagcagcctgcttggtctctgattttgcagtttgggcttctttgggtcccaggtccaagccaagtacatacctggatgaggttggaacaactgtaactttcagtttagtgagagtgagaaatatcccggctaggcagaatgtctgcctcgttaaggttttgcatggacacatatcaatattagaaacctatttacttcctacattcatctggtaaaaattaatttttctaacgaagcatacggcagctccacgcaagtggcaagacccagtgcaattacatttagatgataggcaagcattcacactcacttcggtttctccttttttccttcagcggaatgctacatgggcttaccaatgaattagggacttttaggaacaaagtcacttgctaaatttccaaggataaaactccaaatagattattatgtgaccagatatctgactcactttccagcaatgtgacaagattgtgttgagtctggcattttggctaggtgtgagtcaggaatgaaatacgggagctcaataattgcctgttgttttggaggtgcataatgcataaaatgccagagaaatataaaagggttttcttactttctgctctcccgtgtatacatttcttatcactgagtgccatactttcaaaaagaaagacaaagttttacttaatatccattccctgactgcacttaaattgattctttacattaatacactatgaaaagggtaagtcattttgattgacattgtagtgtccatcttttcaaactttcgaatatatgtttttcagccaaccacataaccaaaaacacgcatttttaaatgctagctgttttcttcttctaggatggtgaaggggaaaactaaactgttttcattagaagtttcattcaaaaacatgaaaaactggaagtgacagctgtgcagattcagtggatgtgacgtttttgaatttcttcaacttgacaagtaaacaccttaaatcggtaatgctatatgcataatacatggcctgtattttgacatccatcatcaaatgctgacttgagaaaatacgggtttgtacgtcaaggaatagcacccataaagcagggagaaatgcaggtcacacggtattaggaaaactgtatttcattacagaactcgcaacaagccacggcatccttttattttatcttatttaaagattccattttcagctgtgaaaagactcaattcctttgcatgaaaccttcatttggaaatgacatgcttgcttcataggcttctttcattttgctttcatattccattttccccttcagtcaccaggcctggttccattagcatctgcaactgacaaactatggtaggtgtccaaagacatctctctgttgaaggcccaactctcccctatgcatgactccccaaaaaagtgtgcttttattgctaagaaaacttcatgcctctttttgtttccctacttttctagtcacacatttttaaaagcaaaaggcaacaataacagcaaagttggcttcttctttttccctggtgtagagttatgttaaaggtgaacataatttattagcattgtttctttcttaggggtactgatatgggaaaattatggtcagaaacggcaggattgccccagattccttaaatggctttggagagaagagaaattcaagcaccttccataaaggaatgaggcaatccggcctttgatgccataggatggtgtccaccgcattcctcatagctgcatttgataaaggggcaggtctaaattgtggcccaatctctgaccatcttgctctccttcccattattgcttgcagccatgactatatcatgggtagcacctgaagtctctctacattaaacaacgccctagttctgcatgtgaacacactggcacatggaatatactccagagatctacagctagagaacagtgaaactgggaaacactcccttcattagttaaactaacacttgggaagttaattttagaaacaaccacttattttgccagaaaagatgactaagaatatcaccattagagacatggaatgagaagtcctcaatcaggaaaagactgaagtttaaatcatccacagccaaagctatcaccagatgggctcctgattctttagccatgtacccatagcactttgttgatcatggccatgggaggcaagttttgtgctaaaaatgacttccatatgtttgttggccatttgtatataacatcactaagtatcaggaaaatgcaaatcaaaacacaatgtgataccaccttattcctgcaagaacggccataatcaaaatatcaagaaacagtagatgttggcatggatgcggtgaacagagaacacctctacactgctggcggcaatgtaaactactacagccactatggaaaacagtgtggagattcctcaaagaactaaaagtagatctaccattttatccagcaatcccaccactggttatctacccagaggaaaagaagtcattattcgaaaaagatacttgcacacgaatgtttatagcagcacaattcacaattgcaaaaccatggaactaacccaaatgcccattaatcaatgagaggataaagaaactgtgagatatatatatatatacacacacacatatatatatcacatcacacacacacacacacacacacacacacatatatatgtgagtgaatactacacagccatacaaaggaattaattaacagcatttgcagtgacctggatgagactggagactattattctaagtgatgtaactcaggaatggaaaaccaaacatcatatgttctcactggtatgtgggagctatgctatggagatgcaaaggcataagaatgatacaacagacttcagggacttaggggttaagagtgggagggagacgagggataaaagactacaaatatggggcagtgtatactgcttgggtgaaggatgcaccaaaatctcacagatcaccactaaagaacttactcatgcaaccaaacaccacctgtaccccaataccccaataacttctggaaacaataaaaataaaataaataacttccaaagaccacctgaactccttacactgtaagttttctccccactccaatcttcagtggctggtgtggcaggtttttgttacctattttattcattcagcatgagacataagtgcttgaccaactttatcctatgacagatattctcattctatatactgtataagaactttaggtcagagactggattttcatttctttgaacttcccagattatctacaaaatgcccagcacatagaaaagaaatagaatgaaattgttaacagcatgggctgtaaagtcaggtgtcctggattcaaattctggcacctccacctataagccatggcactataagcattgtgcagactctctcctagtctgcttcttcatcgataaaccacaaatacctcccacataggacaattgtaaggataaaataaaataatgtatttaaaacatttagtacaatatctggtatgaggcaagtgctaaaaaatgctggctaccaatattaatattttattaggtatacaataagtattcgtggatcacttccccttccctatggataaagaactgaagaagtatttagtagattcttaaaaaagatttttcacacacagaaaatcctagaatactaatgagaaggcaatgagcattgtgtgtgtgtgtgtgtgtgtgtgtgtgtgtgtgtgtgtatatatatatatatatatatatatatatatacacacaatattccttatgtgatcataaggaaagaaggactatggctcagacaagatatacacaagtaatggctggaaaagggttccaggacactgtaaacccaagtgcattggaaaatgagaaaggctcaatggcattgtttttatgagactcaaagcaaaggcaagaatactctagacctaaactggttaataattgagaatgaagaagagagggggaaggctgaactagaacccaaagaaaaaaaatagccaacacttactgagtgcttactatgtactgaattttgctcacgtaataacttcggttctcagaaccatcctatgtatatactactatttttcagaggaggaaactgaagcacagagaaggtaagcaacttgccccaggacatacatctaggaattagcagatctcagagtggaacccagataaacaagtcccagtgtctcctctaagccaccacgccatattgcttcttatgtgccaggctgggctaagggttttttcatgggccaccttgtttattcctcataacagtccctgtgtgtttagggactgttgatatttgcattttgtagaagaggaaaataagattcagagcagtggcataactggctcaagcatacccaattggtaagtgtccctgggagccgcagccaggcagtctgacctcagactcctgacacctgcaggctgtgccgcatccctgacttgggtgctggccttctccttctaggtactgtccctggcaggcaagtctgaggcctgagccagtcttactttttattgttttcacttttaaacaatagcagataacaactgggacccattgtagttatgcttaacttgctttggtatggcagcatgcacaactcagtacatataataaatgctttattacagtacttttccatgggggaaacacaaagtactttctaaatcttccctagttaaatccctgagcctttccagggagagagggagatggaaattcttatcaatcatctcccctagaatagatggagaaatgaaggtaagtgcttctcccaccccgatagacttaacataaaggaattggttcaaatggtgggccaaattatcttttattgtgtgcatataaatgatggttagaaatccatatgctacgttaaactagggaaataaattaggccgagtcatctaggtttgctgagacaggtattcaatatgaagttgtaaaagggaaagatcacctttaaaaatgatctataaagacatgttaaaatcaagagaaacatctcatattacatcatctatgagatgaattaaatttcctgttaatgccagggaaaaaaacctcaaaggcaaatgtcagatgaagtgcagatcaataaaaatattttgataagtaaatgcaacaatgctatttaacacatgattggcaactgctgaaacataaattatccaaatttcccattgctgcttatgggaaaattatgcagattagaacttgattaggcttatatcatgagactcaatttggacttttaatctattaagctccaataaatgaggcatctgaatagctcccctgagcaactacggtaatagccacagcagtcatttttgcagtatgtattccaacgaatgcttcagcagctgaagtaaagaaaattccatgtatagaagcacaattgctttctaacttgtaggggaagaaaatccacacacaccaggttgatttgggaaacaggtttttggaaatgactgcaagaaaaatccagccaaaggaaaaacctcagtttaaccttgtaatattttttcacagtagttttcagtggcttcctatgaagctagaatccagagtcaggaaggccaggcagctgaccatgtttactcaataaaaaaaagattatttaccaaggcagcagcttctcctgaaactccccaaaggccaccccaacagggtagaggtagcccccaacaaggtgctggaggtcagtgtcaaggagggaagcggggaaatgcccctgccaatttgtgactcccccgcacaaagcctaatgacagtgcttggaaactgtataaacagataattctgtgactcctgagccaaaccataaggtgtcttttgcctcttcagcaatcattctatgctagaaacacgagagttttcaaaatcctctaatcaattcctccattcttcaaatgaagaaactgaggcttagaatggagaagttattatatccaaggtcacagaaccagttagcagcagaaccaggatagttgatatctgctgttttctgttcctttttaactccttctatgcataagaaacccattccacagtgtttgttgggggtgcagggaagaaactccgcccccaccctggaaacagaagtggcaacatgaagccaggcatcctgacttcacagggccgctgatggtcctgcataatcctggccacatcatcagtttagagatgagtctgtcctcctcaatctagggcctgtccgtattctccccaggacattatgtaaaagatggtaaaggttctgtggttgcaaagtcaggagtctgcaggtgtggggctactggcaagcagttagcccaccatggggtgaatgaaaacagggcaaatgaaccaagaggtggagagaatgagatagagctctgtcattgttcaagttcctgcacacaaatgtgcctaaaaccagagacattccagttatatgtctctgtttttacttaagcctttttgcattggatttcacttgtgccaaaatgtcccaactagtacaacaactgagaaaaatctccattctcttcgcggtgaaatgattcatgctggcctgattttctactgaaacaaatgactgcatcttcatttaaggtttcctgcttgtctccagtgaccagggacaagacctggcttaatactctccttgtttctttctatttacagtaactaacagtgacatttttagcggtacatttttttagagactgtctttgattagcacctttgcaagttgactccacccactgaataaagtgccccatcctttttagagtttacattttgggtccaacccaaaccaaagcaaattaaaccaaccaaacaaacaaaacttctctatagttatttgcccattaagattcgtaaaatatattcagctcttagacaagtctcacacacatgaaacaaatatatttacaggacttgtctctccaagcagacagtctctttccttagaattaacttaaagatgtagtcccagctattcgggaggctgaggcaggaaaatggcctgaacccgggaggcagagcttgcagtgagctgagattgcaccactgcactccagcctgggcaacaaagcgagactccgtctcaaaaaaaaaaaaaaaaagaaaaaaagaattcgcttaaagagcttactgtgtaagatgtttctcagaagggttggttaaggggaggaaggaagaaaaagacaaagctagtaacaactcaaacacacctaaaactacagatttggagagaaacctaatattcacccggtctaatgtctccgtttacccaagagctcatggtatcattgctttctccacaacatctcaacttctcagttttaccttatcttaattcatcttacaatttaaagataaggccagatgcagtggctcatgcctgtaatcccagtactttggaggccaatgtgagtggattgcttgagctcaggagttcaagacaagcctgagcaacatggtgaaacctcgtctctactaaaaacaaacaaacaaacaaacaaacacaaaaaaattagctgggcatggtagggtgtgcctgtattcccagctacttgggaggctgacgtgggaggattgcttgagccagggaggcagaggttgcagtgagccaagattgtgccattgtactccagcctgggtgaaaaggtgagaccctgtctcaaaaaataaaatataatgagacatacttgcttggccagtgtggatcaaattacttataattttacctccactttggcctaagcaattgtacttctaaaaatatgtgtacagccataatttccttacattaaaaatttggctgccagggtcttcattcataggtattaagtaacaacattccactgaaaacaacatgaatgtccaattttagggaaattggttaagtatgcatccactaaaaataatgcagaaaaacatttcacgacagaaaaatggtcatgataaaatgtttgtgaaaaaccacaggtaacatactgacatgtatgatccatttttttgagggtaaaagtatttatatctatggaaataagacaaatatgtcaactttcttatgtctgagcagtaaaattacagggaatgtgcattttctttttggtttctataattgctaaattttctaaaataaacacattttatttatgtaatgaaaaaaattttttaaattataaattgatgttaaagaccctgaaatctcgaaacctcatgtgatctctatgggttgagagcagctgatgaacatgatggatggacacagctggttcatctgtaagggtctgacaggtctttgaacatccacttgatttggcagttaaggagactgaagttctgagatggaagtgatcaggccaaggttacaaagcaaaggggctttaaaagaacagggcccagagagagttttcaggcttcctagttctctgttatttcagcctcccaccatcttgtaagagctactcaatctcagagcagaggccatttacataaagcacacatgggcagtgaagagcccaagaaacccacaatgccccatgcacataggggaagggaggagcagtcagagctggtttccaacacagagggaaagtggcacctgctgatgcccatccctgctcccaccagccttacccacttcagaaacgctgttccccctcttccctcccaacccagctcctgtcgtttctttacctcttccaggacgtctgccttgaataacttctcacatttagttactttatgaagatgttttcctctgcctttttttccatcccctttattcgttattttaaaatgtatgaattattactaaatatatacaaattactacatattaatgtttaaatgttgttaagcatctttaattcttctgttttatcttcatatacccactggacttcccaatttcaatatggcacagcttatgctaacctttctttattgtttttatttattcttaattcctgttctgggaccctccctctttgctgccaccacaagaggacaaaggctgttttgccactaacatgggatctcctctttcatgatggatcacatttccagtaaactagaggcttactatgccagggaaaaggcagatatatacattacaagacaatgatatcaaggggatactaataaaacacacagacatcccccctcatgctgccaagactatataccattttgtttccattacatcaatttttttctccccttttgcaagcattaatcaaagaaacgtgaagagctcattaaagtgatagattgactgaaaatgtaaccactttttcattataaacagtttctttatgttcttggtgctatgggctttgtttttcagcatttgtcatgtagttcaaatgtccttttacatttaaaataccaaatgccaaatgggccccagttgtttggtttagtatgaattgatggccagcacagcagaaaccagaactccaaaatcacgagcaaagtataacatccatatcttaagcacacagaaaattaagtagctgtaaaagatgggtttgccaagtgatccaaggccttgccatgaaattcaggaaagcagaatcgcatcaacaactttcagccagctatctctgaatggttctagagacaagacgcctggcccaagatagcaccaaggttccaaacagttgatggttctttaaaagaaagaatctttttttcttaagtgttgaagtgtttcctgtacatacgtttatgctggcagatgaataggaaactgggatcttggatcttggggtcaggcattcccacatacatacacacacgaatcttcactagatgagggtttgatgctggtttgactctgagcatctctctgtacagcgtggtcaataacttttgaccactacctgaaataagccataccatttgtggtctagaacttgaacactgtggctagactgaatgagtttgggtcctgcctctttctgtttctaatttgtgatctggggcaatttatttaaattttgtgtctcagtttcctcatctgcaaattggaagaggaagatgtcatgaagattgaatgagttaataataataatacagggaaactgcttacaacagcacctggcacagagcatgtacttcatcagtactaacttactattatttatcaacaacagggttgtaagctgacagagaaaacaaaacacatgggttttagtcccaggtcaactcctacctctctgtgagaatgtagaaggattcaatgtcttatccaaactcagttctcccatccataaaatgaggttgtagcaatgtcccaaatccctttagattaccgtgcatcatacataatattgaaaccacgataattctgtgttcagctactcaatattcaggaatgtctgtggagtcattcatggggttgttcttttaaggaagtggaacacaggagccctctcttccagaatcctatcacattgtcggtatcaacaaacatatcaacatttcatacaagagatgcgcaccaaatacattaaaccacaacaaccatgtagcttgcacatcacaactccaggtacacatcatatcctctctcaggagtagcccctaaggcatgatcctccctccaggagccctgcatcctttccatttgctaacagtcaaatcattcatttgctgctatgcgatcacagtcgtggcaatggctgtggcccttggtgtcttcatctgtaaaataggaatgactctaaggccctctcagctttgagatttatgtctctttcatgaccccaaattttaaacgtgatctccaacaaaataagctagcaaagggaatccagaggatctccttacagactccttcacaagctctagtgtacatccagatttttttgattcagttttatacctttgcccagaggataaaacttcacttctcaaaccaaggagaaggaagtactttctccaaagttgctctaatggctgagaaggccataaataaccatttattaaacaaacactatgggctaaaggaagagaaaccaccgcaattaggcccctgaggcctgcaggcacagtacataacgatgggactctcataatccaggcaatatataaccagttgttccattttcttgaagttatcttcataatcaagatgctatctcgggcattgtgggctttaaaactatttttaattttaatttaaagagtaattaaagaaagacaatggatatgcaggataataaagtaagcgattagcagcatgcaaatgacataggcttaatgataatatggttctagtctccaaacagcttgtcgagagaaagccctttctacatgtggttgttcagctaatgtgtctcaacccacaattacaacattgctgacaccattaaccagtgaaacaacaccacttcgcgaaatccttgttgtctcattaaaaaggaaagggtcaggtaatttaccaacgttgtatgtctagttttgttgttggtaattagcaaacattacccagcatagactcccactgggaactggaggaactttgtgaaatattaaagaagaaagcctttatatttcactggaaaattgaaaagaggtgcagtaatattctccctgtcatctttttgcatttaggaaaaggaaaatgcaacttggaactctttaatttcaggagaaatattcaaaatgcattgggaagtcactacccacattaagaccctggatcaccattgtatactggcaaatagaatctgcatccctgtttacaaaagggagttggagatgggaggacgggaaaattgcaaactttatctttattgctcttacttatgttatttgaattaatctccttgaaacagaagaaaggagatataaaattttctttttgaaatgctacgggacttaaataagcaccagaattatttattcagaaaaatacacacacacacacacacacacgaacacgcgcgcgcacacacacacacacacacacgcacatacacacacatatttagacctaaagagagaagaaatatattccagggaagagacttcctgcctccatgcttcctaatagaatcttccccacattggaactcagaccccgcccccaacactggccaatgcttggtgtgttgtcagggagtagaatggtatcttattctttaaatggaacttttggaacataaaacacattccaataaatgtgagcagaaaattatgaattcattaaactactttggtatcttgtgctatatataatatttatattccgactactgtaaaatatgctttaatatctttaggcaactataaggacttaaatatttataaaatggctaaagataaagtatggccctcttattcctacatacagatgatgtaaggcatgcaatcaaagacaataacactctctgcccatttgtcatcttaaaggagccgatcaacgcgccatccctcgtgtgccatctacataagagttgttgccgacacaggcaactccagaggagtttgcgccttaaaaactacctagagtgctatacttcatagaaaacagggctttctgaaaatggagacaaaacaataaatttgcaggcaaaacagctccaagaggggcttcaaagtactgctgtatttatctctgggacatgagggaacaggaagcattttgatttaatatttcataagatagagacaattgcttccttgcatggtatatacttaatgctcacagaaatgagttttttttaaaaaagtttcaatatcttaaatgcaaataaataaataaataaggagacacacctgcataataggaagggcttcctttggaaatatggaatagacccatataatcccaataaagagaaagccaccacgaatttataatcacctaggggcctgttaaaagtagttttatagattaagtgtgaaacctcaaccctgatgttattattatttaccttccttgcttgcctttaggcccatggcctgattgattttcaaaattcttccatttcctatgctgattaggtattcaaagaattgtttgtgcccacctgccttgacctctcaaatggacaccccctggtttattttcccagctcccactagctccctgctgggaaccatgtggaagtttgtgaatttctcatgtatcttgcattttcacaatgcccattatatgctttccaaatctcctagcaatcatgcctaggagaatgatttattctataaataaatttccaagataaatttctatggaaatgtaagctttagtaaatcagctgcctgatacaaggatcagagatggtttccttgagtaagtaaggggctaggctggtgtttctcaacttgggctgcacgttggaatcaccaatgcatgcctgcatcaatgtctaatttaattgctctggagtatggcctgagcatttcaagaatgttaaaagttccccaggtgagtgcaatgtgcagctaaggttgaaaaacagtgggctagttcagaattaaatccacccatttaagggcaactaatctttgacaaggatgtcaagaacacacaataggtaaaggacagtctattcaatgaataatgatgttcagaaaacaatatttacatgcaaaagaataaatctgaacacttctcttacagcatatacaaaaatcaaatggattaaagacttgaatgtaaaatctgaaaccgtaaaactcctaggagaaaaaataggggaaaagctctttgacattggtctgggcgatgatttcttggatatgacaccaaaagcacaggcaacaaaagcaaaaattaaaaagcgggactacatcaaactaaaaatctgcacagcaaagaaaacaatcaacaaagtgagaagccaatctactgaacgggagaaaatattttaaaaccacctagccaataaagggttaatatcccatctatataaagaactcatatactcagtagcaagaaaataaataacctgattaagaaatgggcaaaggaacctaatagacatctttataaagaagatatacaaatggccaacaagtagatatgaaaaggtgctcaatatcactaatcatcagaaaaatgcaaatcacaataagatatcacctcatacctgttaagattgctattattgaaaagacaagtgataacaagtgttggtgaggttggagagaaaagtgaacccttgtacactgctggtgggaatgtaaattggtacagccctatagaagacagtatgaagtttctataaaaaattaaaaatagaaccaccacatgatttagcaatcccacttctgggtatatatccaacagaaatgaaatcagtatctcaaagagacatctgcacctccatgtttattggagcactattcacaatagccaagatatagaaaccactggtgtccattgacagatgagtagataaagaaaatatggtctgtgttgtgtatgtacctgcacatatatataatggaatattattcagccataaaaaagaaagaaattctgtcattcaacaacatagatgaactggagaacatcatgctaagtgaaataagccagttatagaaggacaaatactgtatgatctcacttatacatggaatctaaaaagttgaactcatagaagcagaaagtagaacagtggtggccagggactgtggtgagggtcagggggaatggggagatgttggtcaaaggatacaaacttgccattataggatgaataaattctggggctgtaatgtaaagtgtggtgactatagttgatagtgctgtgtagtacacttgaagtttgcaaaaagaatagatcttaagtgtcctcatgacacacacccgggcacacacacacacaatagtaactatgggagatgatggatgtgtttattaacttgattttggtaataatttcacaatgtatatgtatatcaaatcatcatgttgtaaaccttgaatatatacaacttttacttgtcagttgtatttcaataaacctggaggggaagaaaatcattagggtagacaaaactcttaaatttgtatataaatatttatgtgtctatgaagaggtaggaggagggtcacagagaagattcattattagctatttaaaggggtaggtacaagacccctttcccagttgagaactaatatgctataggttttctggctgagacccaaaattactgttttaagaaaaaaaaaaaaaagaggcaaaggagggaggccaagtgccatctgttgactaggtggagtagcatgggtcctgctctggaagggtgtcacttcaccaacatcagggctcctaccacaaccaaaccccagaggttggaagtgtatgaggttttctgtcagcgagctgtcccaatctctgcttcagagagcagctgcgttgcatggcgccatgctagcctgtctatggaggggaagcgccccatgctcactgttcatctgccctagtccttcctcaactcctctgtaggcttttgttagtctaccttacctggtctgctcaccttccaaaggtgtgttggtttctatcatcatctattttctatgcatatttacagacaaacagatcaacagtaattctggctgctaggtacaagtggataatcctaacttatgatttgttaatctgggagtaggaggggatgaaataaaatagtaaaattgtaataataataacaaaaatagctaacattgcttgatttctcccatcctaggtaggaagtgctttaacagccattcattcagggttgccatgtatggttgtgaaggttgggcactacacagtagctaatctaagtgggtaccactcatatcaataggcattgtatatttgcatatttatgacaatattttttcccagcagatgacagaaaagtgtattgttcaaacatattagtagattatcaccatttttttcagcagatgaaaataaggtgtcttgagaaaagagtgactttttctggcttacttaaaggtactgtatggacaatagaaagtcctgtatctcattgaattctcatagtcatttgataagccaggtgcatttagtattcttagtgagaaaattgagataaaaagaggtaaagtaattttcccaggcctagtaagtggcagatctgggcttcaaacccaagctgtcattccagacccatgtgtgccatgactgaacttgactgcaaagtgctatttctacagcctttgatgtttaataacctttctgcagccattatgtctttgtattcatacactgatccctcggtgttttggggtggggtcatttaatatatagatatatagatgaggaaatgaaatctggaatctttattatgtcaaattgctcatgatggacagaaccaggatttaaaagctgttccttaaccctccatgactgcatcattactctgacagccatgtttgtgattcactatcatgaactagagcaacaaaacacatcttccaagttcctcctgctccagtctaccgctgagaggaatgttcatttctacatggccagggaagctctcaggaagcattcacagctccctggagcagaaagcagagatattttctgccctttgttgaactttggaggtctcagtcctacagccttgggccctgggttggtactgtgtaatagtacattcagcgaggccagtcaaaggttgagggccaggagctattagtaaaggttaagggaatagtacagtttatattagagacaacctggccatctgataaaggctcctccagacaagtgcaacatctttgatctctgtaacccttgtccagtgcccagttgtcaaatgaagggagactaaatcctggagggaaagtgtaggtttttaatacaggtatttggctgctttatctcatttgagggcacgttaagagagaacaggctgcaaacaacagatagcaggattaaatcatgtattcatgtatccatcccctccacaaacctctactgagtgtctactaggtgtgaggtactgtgctaagcatttagaaagatttctggcagttggcgagcatgaagaggtcagcaaaacaatagaacaggctcttctttggaggatctactcaggttaacagtgcacccacctacaagcatttcctttgacatagtgagccctttaagtaccttggttataccattagtacacaaatagccaggtgaccctctgtgaaaaacactcggcctttcctgtttctgtgccttctgttactcagcttcagccctttccacatgcctgtcggaacctttatttatattaatcacacttattttcaaattctggtccctttactctggagtctttcctgactaccacagcccaaagccacctctgccttctcataacacattgtgtggcagcatgcatgggacactgaaaacatctggtagaacatctctcctggagatctgtaacaagatgctcaaggactatcctgcttttctggaattcagaaaataattttcctccagaccattccatgaagtataattgaagcatttaaggactagccatatccttaaatgttcaataaatccagaactaaagtcatttataaatcagttggcttctttgcagtgccactttttctttctttctttctttctttttctttttgcttgtttgtttttggttttgtttttgagatgggatctcactctgttacccaggctggagggcaatggcgcaatctcggctcactgcaacctccacctcctgggttcatgtgattctcctgcctcagcttctggagtagctgggtctacagatgtgagccaccacaccaggcttatttttgtactttaatagagatggggtttcaccatgttagccaggctggtctcaaactcccaacctcaggtgatccacctgcttcggccccccagtgtgctgggattacaggcatgagccactgcatctggcctcagggccatttatttctttatttttttcttgagatggaatttcgctcttgttgcttttaagaaaagaagtaaagtttttaagactgcacatgagctattgcctatagagaataggtgaagacaaaaatgcactgaatagctggctagatttatctgccagcttgaggcatgtgtgctatcttcacagcaggtgtattgaatgaaatggctcacactctgcacaaggaatacactgaaatgttccaagccctgtatccttaagtatgtgtgtcaaagtcattccatacaacttattttatgtttctgtcccttttgcctgtagaccccattacttctatgacagcatagactatggagacaacaggggcactaacctcatgcataggatgcaaaccaaactgacatgcaggataaggtagttgacctatccttatccagaatttcatgaggtgtcttagagggtccatgggattacaagacttcctttacttctctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaaaatgttatttaagtgtcttcacaaagaaagtaacagctaggtctcaaatattccactctcttccttacagctccgaagtcccatctatattcacaagaaaaacagaaaagaaagactccaacagtcatactgttcacagagacaggctaagcacagtgcttcacattgcccccagatttactcatttgtccagtggtagtagcaagaaagactgaagccaacagaatcctagtatctctcattgttggaacagctagggtcaaggggctcaaaaaatggggattcacagagacaagaaccgttgaaaacaaacttcagccccttaggtgcaaggaccagtttagaagtgaggctggcacaccttgagcactttcatccccttgagtgtttgtcctgggggtgcccccatgacccttgaaagtacatgtatagcttcaggcccattctcatcaggataacacttgccttttaagagacaggctgatgtgccgagaaaagcatagactttgaaatcagatgtttggagatcaactccatgtgcccttgactagctataaggctatgggaaaggtacctaattcccctgaatctctgctttctcaactgtaaaatgaaggtggtaactctccctcagcaggttgtcagggagattaaataagatattacataggaatgtgtctggtgtatggctcacctgaaaaaaaaattacattttcttaaaaaaggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtggggacatgaatctgctctgcatccatttggaaggaaaagatgattctgtctgtttttactttttcttctgcacatccactctccaagaaagtctttcatgcatggagggcataaaaccctccatgagttcaaaaagtagtccaagtttctcagtctcttattatagctgctgctgttgtttttccttgtttctcttgctaggaatacattactagaatagtaaatggcagggttaaagaggatctctcatgtgatgaaatatgctatataggaaaaattctcttaagttgaagtcatttagaaaacagctgcaattgctgctttgctgaaatacatctgcacctgagattcttgtgatgagattcatcttgggatgtccacggaagaaatgtaacagggcaggcccctttctgtacttgagatctgctcagagccctaagccagattttctttattgtttagtaagctcttttaatgaaatgtactactcttattatagaggactcaagataagatctaaatcacaaaccaataaaagaaaattattggggtagatatctaaagttactacctagaggctactccagtgtggtatttataaatctctaaacagttaagtataattgtctttctggtttttgggacggaagccaacagcagtttcagttacaatggaagaaaaatattttagcgctgagctttgttcgtttagtgggtataaagagaaatggcttctcccctatcaccatttcagaattgagagagaatattgtggtaatgaaatgttatatgggagcagctgaaaaaattcttctctgacttcaaggaggggaaatgtgtgtgaggatacatgtataggtgcgtctgcaagaaacagtgagcagcctgggggtcaggaaagccaggcttgtagaagtgggagaaggcagagccctgggaaaaaggcaggtgtggaagggtggtgtggaagttgaagatggggtggtctgtccaattaatggaaaagccagatctgcagctgctcaccccaatgccgtccgctccccatctttgaacacaaagacagtgccgttcaggaaggacatgaatgcttccactaaaagactcatgaccccaatcctgacaaacaccatagctctccctctggagttacaatgcaaatcatataaaacacagatccctatgtaataaaaatcaagaacatgctggatatccttagttataaaggaccacagaactcatctctctaccaatctccctcccatcacaaagagcgtgtcagtaactctcctttagcaaagagacagtcagggataggaggctcgctgcatttgcaggctgtccatgctgttctggaaatatcttccttatgttgggctaaaatcctgttctccttaattattaaccattggccctggtttttgtccaatggagcagaagattaaatggccctttaagcctgctggctttgttctcttaaccacttggcaagtgacatgttgtccaggcactgccccattctggccgtcctctttacaacatttttctgtttgtttgtcaaatttctgcttcaaatcttcacagctcttgacacattccctcctatcccaacaaagatgaaacagtcactgctcaaaagaaatgatgcttttatcaccaaggtttatctagcctgtctttactgatcatttgaaaattaacatgcagaggtcctcaatgcattctgtcctgtggatttcatcccagagttccactttaggaaggcccttttcgttctgctttttgtcatccagtaatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattccctacttgaggctcttaacctttgttgaaatgtggagaaaggagggtgtccgcttatatgtggatgttcatttagtgtaactatagcttcaggtcaaagagggcgggaggaaagctgtgtgtgtgtgtgcgtatgtgtgtgtgtgtttgtgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttcctctaccctctctttctgagatggtatacttctgtcctgcaattctcttgcctctctccctctctctgaggctctcctttgctcctagagcatgagcaatgggccagattgctagaagcaaacttttcctggattaaggacttcatttccacccttcagcttttcatgcccatctggattttccactaagtccccgtggaaataaaccatgactaaaacccaatcctcccaacactgctttctcctgcagcctgtccctccactctgccatcctctgacccccagaaggaaacacacatccatgcagactgttttgcatgtacagtgactccttctagaacctcccattctttttccagtccaaggtttcaggcttccatctggatagccacagttcctaaccagagtccttgcatcttcttcctttccactccaaacaatgcttcacagggctgccagatccatctccctaaagctcaggtccaatcccatcactctcttgctttgaaaccttctgtagctccccagtgcctagtgaattatttacagcttcctaactcataaacacataaaaaattatttacagcttcctaactcaagaaagaaaagaaattcctcaatgcccaacccacatttcaacttcatctctccctgctgccttatatgtaccctgtattggggccaaattgtacttgtccctgtccctctaacacatccccaggaatctttgccgtcacttccattcgctccgtctcaagccagctcactttgcctccacctgttatctttttcaagcatggaattaattactcttttcctataaatctttgatgactcccccaaatccaaacccttagcaagacaagtctacactctaggactgcaccatccaatatggtagccactggctatggatcactttaaatttttatatttgttaaaattaaattaaaaggaaaaatttaattcctaaatttcaagtgctccatagccacatgcattcaagtcatccacagatgccacctcttcttttttttttttttttttttttttttttgagatggagtcttgctctgtcgcccaggctggagtgcagtggcatgattttggctcaatgcaagctccgcctcctgggttcaaatgattctcctgccttagcctcccaagtagctgggactacaggggcgtgccaccaggccttgctaattttttgtatttttagtacagacggggtttcactgtgttagccaggatggtctcgatctcctgaccttgtgatccacctgccttggcctcccagagtgctgggattacaggcgtaagccaccgtgcctggccgatgccacctcttcttgaaagccttctcaattcctcaaaatacctaaaccaaggatccctttgtgttcctctatttctagcctcgtccttgtttccttggactgtcattgtttatggggatacctcctccactcacctgaatcctgcaagcatagtgagtggctgaatccaagcaacctttggtcacctttgtgttctgggcctttagagtgcctgatgcatggagaacagccatttattcctttttcttttccttaggagttacctttcatggaagggtaagcaggaagcaactacaagatcatcatttcaaaacaatatgaaagcagaatgggaaatgccatggcatgctccctcttttcaggtatgaactgaagcagctcagagagcggacattgcctccctctgctcaccctttcttccaagatcagactcagttctcatctttttgaaccacagggaaacagtctggcaagagccactgttgtaccagctgatttaaattgaaatgttttccccagataaatgcgtgctaaataatacaccagctctccagccaaagggaagtgacaggcactctgtaaataaaggcacttagttgctggtaaagagctgtaaagtggttctgagctgatgtttgctgaccagcaagaagcagcttcatctgctttatataattgtcactgcagttttgcctgctgtatattaaaactgcatctcatagacccaactgtcacatcggatataccatctggcttgggatatgccaccttttctgtaattgtttttgacaacaagccatcacatcttgggtcttttcagaaagtgtctggtccagaatccctaggctgggtcagttctgacaccatgtgggctagaaaagtgacatcaaaagggagtgtgaaaagagaacagaagagaaaaaagaggctttgttagtctaggagccctaataacatgcagtggcagctgtccaatgaaggctctactttctcaatgtgaatgcacatttttcatgctaaattatatcatcttaggacagctttccatagggttgcatgcatattctggcccaagagcatgacatttgtcctgagtccacatttctacccagtgaggttctagagacatggagacagttcttcagacaatgcagagcatgaggttccataaaggaccatagaatacataagagggaaagcaaggtgtcagtggccagaaatctgtgtagttatcactcagaggaagttagatttgttttccaaaatgataagagtaacatgaaatccccagcactttgggaggccaaggtgagtggatcacctgaggccaggagtttgagaccagcctggccaacatagtgaaactctgtctctactaaaaatacaaaaattagccgggtgtggcagcacgcacctgtaatcccagctacttgggaggctgaggcaggagaatcacttgaacccaggaggtggaggttgcagtgagctgatatcacaccattgcattccagcctgggcaacagagagagactctacctcgaaagaaagaaagaaagaaagagagaaagagagaaagaaaggaaggaaggaaggaaggaagaaagaaagaaagaaagaaagaaagaaagaaagagaaagaaagaaagaaaaagaaagaaagaaagagaaagaaagaaagaagggagggagggagggagggaagggaagggaagggaagggaagggaagggaagggagggaagggaaggaaggaaggaaggaagggagggagggagggaaggagggaaagaaaagaaaagaaaaaaaatggagagtaacatgaaatcctttttgttccccataatccctattcccttggagcttgatcatgccaaatgcccagatgaaggatgacaaaagtatctcaggccagtgggcactccagttagtcaaaagggtctcagatatagaaaagcagggaaactcagctcacagagtcagctcacaggctgggaggagcccaaggagtggagtgctgggtctgcagccagaggtgagctctggggaaggagcgatttctctgtgttgatggctcccactggaccactgcctttacaaggttagagtatcaccagagaacagtattcaaaaacaagagaggagcagacagacagacaagaaaacaatgggacataaagtcttggtgggcctagagctttgacactctctcttagggagcagaacagactgctggctagtgagagacagatgctcctctccactgctgaccaggggtctacgagaatcactgctgagcatagaaacacatcctttgccttcttctgtcatttgtgcggtcttagtccatttgggctcctgtaacaaacaccataatctgggtggctgatagacaacagatatttatttcccacagttctggagaacggaaagttcaaggtcaaggcgctggcatgttcagtctctggtgaggactttctcgcagtgtcctcacatgacagaagggacgaggggtctctctcaggcttcttttactttatttatttgtttgttggtttattttattttgttttagacagagtcttgctctgtcacccaggctggaatgcaatggtgccatctcggctcactgtaacctccacctcccgggttcaagtgattctcctgcctcagcctcccgagtagctgggattataggcacccgccaccatgcctggctaacttttttgtatttttagtagagattgggtttcgccatgttggccaagtggtctcaaactcctgacctcaggtgatccacccgccttagcctcccaaggcgtgagccaccatgcctggcctcaggcttcttttataaggacaccagtcccattcatgagggctccaccctcatgacctaaacacctctcaaaggccccaccacctaataccatcgccttgagggttaggatttcaatgtatgtatttggcagggagtaggtggagggtacaaaaacattcagaccataactgtgtgcatgtgtgtatacaaaagaaagagtgccctttttttctttggaggaaaaataagctccctttctctttcctccatatctcctgtcaaaacctatttttcttgcttatcctgtgctataaaagaataaagaaggcttttgggcaccggggagtggaagaattgttaccagtttggcctttatataggatctaagaggctgggatgaggtttaagagaactggaaggaacaactatatcagatgtgtatgtaactaaattatacactgacattctaatctgtggccctggaaaatcatgatcgagtttggaggaaacaggcatgttggggaaagggagtgttttcctgcctcctcctgctggcttctgtctgtacttaaagggagaatcattgctttcactgttttcctttccccttgatggttcactcctccccaggagaggaggagcatctaccaagggttggtcacatcctgttcatgtgaaggtttactgtgctttaaaagggcacatttgagttgcctggggatcttgttggaatgcagattctgacccagcaggtctgggatggcccatgaggttctgtaactctaacagcctcccccaacagacacccatactggggcagggcagagaggacacatattgaaagtcaagggcttaaaggcaggaaccaaatgccggcttgcctctttcaactcctagaaggtcagcttactgtcttctcacatcctttctcgcctgtgctacccgggcaggccgcacaggatgcgggctctacctcttcaggatgcagctgggagtaagctcagagcctctcctaggccttcacatgttgtgctgtcctgcgggcacagctgagcaggtggataccaagatttagatttgggtgtggcagggaggacggtggcatggagaggtcaaaattaggcttcaggctgtatcagggtgatgtcagaaggacagaagccatttcacatgcaccaccaaaggggaaggttctcttaagcttgaccagaagctgctgtgaatctcaagatcctcagagaagccccagcccctctctcagtctgtagcagtgaagacactggctcccagaaagctcatctgatagaagatttgaacctgggtctgccagggtctggctgcagttgcctccaaagaatcaaagcctatctttctcctccactttccaaatctcaccccagtgcccatctcccaccagctgactctagcccagagccatgcagggaagaggattccaggaactattgttcctggcttttctgcaatgctaagcaaatgttagaaggcagtggtggtgatgtcaagttgacaaaaaataatgtagctcacaggtccaggatgcatgattcagctgagcttctagaaagcctggcatgatggggaggaggtcagacacttgccaagctatcaataaggtgatgcttcatatcccagtagccatagctctcatgggctgtgctcctacacccttccatcctggactgatgggattctggtccccatcaggcagccaatgccaccctctggcagctcgtctgtaacaactatcctccaattcatggctagcctacacggaggtgtcactcaatggaaaatgctttgcatcctatcctgccagatcctgattacagaggtcattttttatgaaggttttgctgtgttgcctttctgagacccctagacatctttacttgtaaccacctgcccagggtcccaaagcaaatgacaggaaagactaggggcagagtaggaaggcagacgtgtgtcacttaaggctgctttgcctcctataggaaaatgtgtggtctgacaagtgtcaccatttgctaaatgacttttagtgtccatagagttgccactctccagagattaccatcccttggtcagcagagtcctagaggcggctctaacaatagcaaagcttcattcccatcccagctcaatggcaaaaacatatactggaaggaaacggtcagaattgtgcagccagcttcttttcagtgctctgacatttagctgatgacactggtcatgaagccactccttgggaaagctgagggggtggctatttaaaggcttgtttatcctctggaaaggcaacctagtctgtgtgtgggtgaccaggtctcaagcctgcattctggaatggaaagaagaggcagcagatgcccctttgaaagccatcatggtgaccgcaggtttcactgccaggcaggctgatgtgagcctctttgaattactgagtgaaggatatccctcttgccagcccctgtcccctgcaggcacagcaaagaagtattacaggctgtccttaccttgggaattagcctgcaagactccgatgctgtcatcaaactgcatagatttgatgttgagtgacgccaagatgcattccttgtcctgcagcgaagtatcatcaatattattctgattggctgacaggataacgcacatgtcacagaggttgatgttgacagcccttaaatcagcccgacttaatggcgtaccctttggcatagaggaaagaaaaaaaaacagagatggggggagaaagagacagagagagagagagaggagcaaaagtgagaggagagggaaagaggaaaacaaattaaagattgagtcggagctttgggaaattatttaacaagtatcttttttatgccttgacattaagctggcctaactacattcaagggaataggagctgtgtgctaatctaaagggtagtcggtgctgatggcagcattttaagcttgttctcaatactcaatcaagctattactaacaaacgcgggagaggaataatgccagggttctacatcttcttcctgcctggaaattgtcttgatttaagtaactgtcctgtggcaacctctggctttcagaatgtaacaagggggtgggtttcaaatgcctgtttatttaatagcgggtcacttctgtctcaggcaaaagacagcagttccaatgcagccaaggagaaatggccagtgagcacagagtgatgaggtgggcctggatgtgcggctcaatttggaggctatggatggagtggaattaatgtgtgcaatgcaaaagagatatggaaaggagttaagcttcagatcatataattttattgcatattttcagcaagaaaaaaatacacagggaaatgacctaattgtccaacaacataggaatggagaaatatacttttggacatgcacacagtgaaaatgtatgcaggaggtaaagaggcagagctggctctccatgcaggcattggtttagaagcctaagatagagggggaagtgaaaaaaaaagttctacagcagttaaaaaaaagtatagtttcatttatgtaaaaaaaaaaacccacaaaataaaattacatatatataaatgtatgtaaatttggaaggaaagcacaggaaaaatagccattacactaataatggtaattccctctgggaagggaaataggattcgtgggggtgaggggaaagtttgcttttcactttatatacttctatattgcttgaatattttataacaagaacatatttgtatattacaggtacatttaaaaaataaataagccagtaaacagattttttaacataaaaaataacaacaaaagacagtggaaaaatcccagatccaggaagtaacaacagagtccgggaatgcaagcatagggaaaatagaagggttaggttaggacagggccatggcctccacatgctctgtgtcttcaggtgaagccacagcaaaatcatcaggccaccccatgccatagctccccagtggccacgcggcatcattttggggctcctgtctggccaccagcttcattggtcctctagcttgaatctagcttcctctttgcctgtgtggtgacctgagttaccttcaactcactgattgtgtagaccaagggtttgccaactgtcacatatctgggaatgtcctcctctaatctccctttctggagaactggctttggaaagagacttggctgcagagatggagcctatctaccctcttttatgagtcactggtagtcatgattctattctcaggccctaaaatattgtgcaactatggaggaaggggcatttagcactgtggttgctgctgagacacaactagttccaagctctggagcagcgtctttttgagagaaggagaatgccctcttctcctgtgatctcttggtacaaaacaagtccaaccaacttcctgaatcattttgccagtgcataagcttcaattgcctgcatccatattcttttaattttcatcttgtagggaagccagccgtaattgtgatataagatgatccctgtgcagttgtacacacgtgatttcaaactacaagaaatacaaatgacatacatagaaatcgcttatgtttctctgggctggccctataggcagggtactgtttaaccaataaactctgtgaagacataggtgaaggcccattttgtgaaaatctattgtgcttgagtatgttaaattttggagggtttgaaatgacctgcaaagatgacagctcattcatatacatgaagaaagatgagtgaacgtgtacaagggcacacagagccgggcgcggtggctgatgcctgtaatcccagcactttgggaggccgaggtgggtggatcacctgaggtcaggagtttgcaaccatcctggccaacatggtgaaaccctgtctctactgaaaatacaaaaaaagtagccaggcatggtggtgcatgcctgtaaacccagctactcaggagactgaggcaggagaatcgcttgaacccaggaggtgaaggttgcagtgagccgagatcgtgccattgcactccagcctgggcagcaagagtgaaacttggactcaaaacaaacaaacaaacaaaaacaaacaaacaaaaaaggtcacacaggaggaaacatacacaaacacacaaaacacacacacaaataccaaatatcacacatatacccatctctctccacacacatacacacacagactcatgtatcctggtaaaataataaaccctttacaaagacactttcagaggtcaggggactatgtggaggagcacatgacagaaagataaccatggaatcatataatcaaatcgaccatatttctggaatgagcaaagcatatatatgcttatgctctcctctgtgtatgactgtttgtctataggtgactattttcaactgcctgtgctcactaaggcagtgggtttttggcccagcatccaaaagataactgtccgatctttttctcactcctttaaatatttattgagtccctattgtgtcaggcattatgtaaaggcacatggtggcatctaatgagtaacatgtactgcttgtggatagattcttgtgtgttctttaatgaattatattacttggctctttttccccccatttctgaggttttggaagctgataacagaaataatacattttagctttgtaagtgggggaaaacccagacttcttaacatgtagagaaatccatgttcctcagttgtttcttgttttgtttttgtttttgtttgaggcaggctcttgttctgttgcccaggctggagtgcagtggtgctttcacagcccactgcagcctccacctctcaggctcaagtgatcctcccaactcagcctctcaagtagctggaactacaagcacacgccaccacatcaggctaatttttttaactttttgtagagaagaggtctcaccatgttgcccaggctgctcatgaactcctgagcttaagtggtcctcccgcctcagcatcccaaaatgcagggattacagggattagccactgcacctggcccctgtttctcagtttcagggatgtgaacttacaagaaaaatatttggaggataagtgagatttgcatgaatttgtgatgtggagaattacatcaaatgttgaaatgcataattctctacaatgttttgagagtttgtggactatgcattcattatgattaggaagtagttaattacatgactcctaaatcccatatcctcacactaaattgtggagtcccagactgttttttcagactgaagtcctaatgttttgcagtcaagaatatcatgcacacatgcacacacggacacacacacaaacacaaccatgaacacgttgctggacttctaaatgaacaggggttggggctgagctgcagaaggagttggccttctgtacagcagaaataaagaactctgttatttgcatttatttagttaaaaacagaaggtggcacagatcaatgtttcttcaagcattaaaaatgccataagtataatgctataaatagttctgtaagcaaatccttactataaacatcataatataacaatgctctaggttttgtataggcaggagtgagagtgtttagacgctgatatggttaatatacttgatacaagctaaacttcatccctgatgagggactgaacttggctgcaaattccttttaataaggtctcccagggtttggattttccttgacagagcataggggaagtgctgagtcctcaggcccatacccagatgaagaagcacaggcatgatcaaagctacaactattatatccatccgggattttcttttgtgaatgaaaagaagaaaaggcatcaataatgtgaccttggacttacaggcaatatggacactttggggaagttatgaagcgtctcccattcccgcttgaggtactcaatagagcccacaaacacaatgtgcttgagctcatggtaatgaaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaatatttgctgagagcttactatgtgctattatttttatttcatcaatgttatatacatgccatatagagctataatttgagcacgtgtatatgtattatatttttgtaataaatctgtccaaatgtatagccatacacattgctaccttctttgacaaaagatttaagaaaggtatgccataaatatgtgtgagcagaccttcataataattttcaggaggtaaaataaaaaggaaaaggaatatttatgctatttggaaagagaagtcttagtttccatgaaattgttgattaaatgagctgccttttctggcttgcttgctgagatgatgataaaatggtcagatgcctgcactgggctcagtgggagaaatttgactttagaattctagacttatcagtgagatgtccgtgcatcagcaggtggaacatgctacctaaagccaggagtggaaaactacgacccacaggccaaatctggcccactacattcttttgtatgttcagtgagctaaaaattgtttttgtgcttcaaaatggttgaaaaaaaatcaaaagaagacaatgtcataatctgtgaaaattacataaagttcaaattcccataaagttgtattggaatgcagccatgctcatacgtttaggtattgcctatgggtgcttttatgctacaacagcagagctaatcagtagcaacagagatcttataccctgaaaaacctaaatttttcattatatgacttattacagaaaaagtttgctgacccctgtccaatgctgccttggactttccagggacatttctggaggggcctgttttgcttaaatcattcagagaaaagatctccccaaataatcattacaaggggctagagagagattagtaagagcaacaggccagtgtcttcctccaactccaaacctctatctacaaaggagacaaatgaaagaacacagtcactctattagaggagaaccccaacttcccaggaaatacaaatgtttagtcactgctggccctttgattcactgagctagtgaagccaggaggccagccgtggacctttctctgcctctccttctggttcaatgcctcccattcctgtccacccactgcatgcctggatggccccatgtggcttacaatgctttgggggaggcatattaatgtccactgtacatatcaaactctgcttgatttaatctctagaattgaccactgcattgattgtataaatgccaatgttgcaattcacaacaatgtcagggttattacagtaacccccaaggagaggaagaaactagctttcactctctgatcattagaataaagcaggggctgtcaccattattggtttccctctgcaatagtccagggaaaccggagacataagctgtaagaaatgccttagaaactgtgaccaaggaagacccactggggagctcacatcacatatccccacttcctgcagaagacctggagttagttatctgggccgcacggaagtgcaagtgcctgggtgccaccaggagacagccaaccagtctataaagcactgttatgtgatggggctcctaattatttgtaattggccaggtcacctgggaggctagctcccttcaacaagccagaggaatataaactgggcccagggtggaagtgaattctagaatagggaggtggggaaggcacagttagttgagtggccgaggcacagatgctgaccccaggaacttcgatctgggatcaaaacacccatcctcagactggccacagctacatcacccagagaaccttatgaatatcctaattctagagcctcagccccggtgtgtctgattttgccgggtttaaagcacactagagagagaaactgatcatttctctatgtatctggaattcccatgcatccttccaggcccaacccaagcacaacctatgtgtgtatgacgggacttgcctggtcacttaaacacaccctagtccttctcccctacatttcaatagcattttgcacctcttaccacttagctttaaatacactgtttcatgggttacattttatatcttctctctaattaatccaggaaattacaattgggactatctcttatatcttcaaatccccaaagtagttagtttcccgtgcccagtgggtacacaacctcaaagcatcctcatgtagctggccctacctgtcattcttatctctagccgtgttactttagagagggcttcttggatcatactttccagacagcacctcccagtctctttctagcctacaatgctgctttacttttttcaaagcatcctataaatatctgaaatgttattaagtactcatttgtctacctagagataactcctcttcccccagccccaccctgctagaacacaaagagataactcctcttcccccagccccaccctgctagaacacaagctctgtgagagcagtcgttgtcagggattgcatctccagtaactagaatggtgtgtggcacatagtaggcctcctggagatgttttgttaaatgatgttatttttcataggatagaagtagtaactcacctccttaaacttttttatgctggcaggagatgttgattgaatatcagttggcatgcatactacaccaatatccaggcaagtcattaaaaccctaggtcccagatacggcatccagcctgtgacctgccacaagtggtaacatcaggctaaatttaggccaccagggcaaaagtgccatgaatacatcagaatgtacatatatggctgggtgcagtgactcacgcctgtaatcccagcactttgggaggccaaggttggcggatcatgagctcaagaaatcgagaccatcctggccaatatggtgaaaccctgtctctactaaaaatacaaaaaaataactgggtatggtggcgcgaacctatagtcccagctactcgggaggctgaggcaggagaatcgcttgaatctgggaggcagatgtttcagtgagctgatagggctctgcactccagcctggcgacagagcgagactctgtctcaaaaaaacaaaacaaaacaaaaagaatgtacatacgtgaagcagctttgcgagtagaacaatttgcactcctggtcagttggacaacagctgtttgctaagaattctgactttctgtgctcttgcctgcaactttcccacctctgagacagcctccagcttgatactgtattggctgttaatgctcatttataattaagctgagaacacacatacacatagataaagcataggggaaagtccagtgtgttagcatacaaagccattccgaggacccagaacagtccttgtttaggaagggtggtcctgacatcagaaatgataggattttcctggctgacaaaaaggaacagacccataccaatctggggattagaggcccaagggagaaagaacccttccatctgactttcctgattattaatccatttctcatggattagcaagacaataaactgtaggaaagccagtgtaggcattaagacccaaagctgttaatagaacaagggcagagagtagaatggattgttacctatgctgacattcctgggagagactgggtgagcccactgctgctatgaagatgttcacaagccttccacgaaatagggctctgagccccagcctccccaaggggactgtagttcattattgtcatcattatgtcatgcatcatcatgcatttccctgtctacaacatgcactaagaaagctcacagatgcacaaggctattatctataagaatacaaaacattgctataaaccaataacaatacaggcagcattcagctttcctcacagcatttaataatagtaagaataagaggtaactttactgagtcatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcgccatggccacaggaattatgttcataccacctcccaccatggctttcccacagcaagtgctcacctactcttatgaggagccaatatattcagagattgaaaaatctgaatattgcttatgttctgatcagaggtctagctgcttcaatctatgctcagaatttcactcatcaaaaataattaggaccagggacagtattatcccactgtccaactagggaaaccccattcctagcaaatgtggtttggggcagaagcgggcaacatcagatgcacagtccctcactcaccaggatgactttctctatctccttgggtgcacaccagtgaaacatcccagtagagtcgtacttcttcacattggagtccatgttgtcaatctgatcattgccaggaattaacaaggggtcatgcctgggaagaaaaggacaggaaaacctaagtggaaaatgtgataaattataaatggaaagtgccccctgaattacatctcagaggatgtgaaagatgcagaggaagtggttgtcactgaaggccattcttctgcttacagaatccatcctttgagagacaactgccccaaaccaccaccccacttctggaagtgcaggtgacctttgtcagggagcatttctgcctttcccccgctcctcttttcctaaatggtcttcctaacattttgtggattcagcctccctttttaaggctacctcactcctcttcctctcattttaccagctattcgatctccccagcgtgcacacacacacacacacacacacatacacacacacagacagacacaccaaagggttgctatgagcctcggcaatgaagaggaaggaataggaatagagcctcatgctgactgactggcatgaggatggaaagccaattactcgctccttctgactacaacttctgacgtgatgctcttcgcagtaaaagctttaacaggctgcactttaaatattttagcaatttgcccaatcagattttgctctccctggctgaagcctttaaagattcagcagcatgtcacttcagagcagactgactaccaaatgcccacatctggaatacatgatttcaatactaaacaacaccctctctccttgccttgacaactgtatatgcactaaccatccaatgatgctccccaccaccttcacctcccaactgctgcatatcttagatgagagcctcaagctcagatgcatcttaataaacttgtttcaaattctcagggcaacattcgccctctattgccttgtctattggtggaaaaggaagatgcttccataaaggcctcccgtctagtgggttggcagagcctcactgacaaccttaagaactgcaatggaatcaggcagttctaacaagcttatagcacaataaataagctcctgcaccttgaatcatagtcaatgtccatgcttttatctctgatagtgattcagcacctcgggtttgggaagtcattgttccttcctgcaaaactggccatataattaggacattgtcccagctatacttaaccactcttgaaatggagctatcttttctgagtaatattgtcaacacaagacagaaaatatacatcgggtcacattccataaattgtaaagtgattttaccttttgaaattctatatttcaacatcagagggtgacttttttcttttttctttttttttttttttagacagagtctcgctctgcagaggctgacttttatttactttttactatttgtccttctgaaatgtctccgatacttcccacttatatgtcaagagtacagagtgggacagcaatctcttccatggcccaaaaacctaggattaagcttttgaataactaccacgaccctccaatatgctccccactcccacataaggtgagaaaactttctcactgcctttatttatgcctgagaatttgcttttagactacaccaaatgacaaatactatgtgaagccaacttgcaaagttatcttcaacgaacatgctagactactataggaatatctgtcatatctgatcttaaaagaagaacaatcccactccgagtagcatctcagtgtctggattgttgagaggtcttgaggtatgtaaaccaccaggccatcttccaaatactgaacttagtcaaagatgttaagataaaaaggctgataagaactatttacagatcagggtgagagcacattttgagggatgtttttgtccttgaagagtctttaacagttgcatagatatctattaatattatctggaataggtaggtagacaaaagccatcatggagaagaggtttgagaaaatgaacaaaattaactctttccagcccatgaagaacatatttcagttgcaagaggatattagcagacttgccctgaagatatagagccaggttcaaattctcttgccctgtttactggttggagagaaagtattacctcaggatgacctgagacctgcccctagtgcatttaggatttaaaagatactcagaactatgttcccataatatcagcaagcaagcaaatgaaacagcaagctgacaaaaaacacttttagaaaatgtgtgccttggggaagaggagatacattttggtttggtatacttgattctttctgggaaggagtcagacgttgttaacagtggcctacaactttcatccagaaaagcaaataagcaagcctgatgatcgatcgcccttcaataaaaagaaaaaagacagctaatgtcaagcttcattaactggggtagtggtttccagaaaccaggcataatttcacactggagctcaagccatggtttgcaatggaacatccagaggcatccaggaagtcttagaggtatgccacactacactctactccccacacatctctcatcctggcctggaccatttaaatataaacaatccaggatttcccccaagagactgacctgaggaacatcaaaaacctcccggaacaaagacattaccctctctgaccagcatggtacctggaattctaactttggtttattgaatcagtaaagcaaccaattgaatcagtaaagcaatcaataagaatcccctattctgagcatggaatggaggctacagtaatgattaagataaagtccctagtcaaagagaggtccacaagatagcaggaaaaaaatatatatacaccaatagttcaatagttacagtaccttgtggcaagtgttacagcaaagtacaaggtgatacaagaataccaagaaaaaagctgttcatatcctggtatttgggtagcattaaggaaggttttgcaaagaaagtagcatttgggccgggcgtggtggctcaggcctgtaatcccagcactttgggaggccaaggtgggcggatcatgaggtcaggagatcgtgtccatcctggctaacacggtgaaaccccatctctattaaaaatacaaaaaaattagccaggcatggtggtgggtgcctgtagtcccagctactctactcgggaggctgaggcaggagaatggggtgaacccaggaggtggagcttgcagtgagccgagatcacgccactacattccagcctgggcaacagagcgagactctgtctcaaaaaaaaaaaaaaaaaaaaaaaaattagcatttgatctgaaccatgagaaatgaagaggaatctcagcatgttgcagtgttgatccactaatagccagtaggacccacccagagaattgaggcccaaatgaaaagggccaaataatggcacctaaaaccatggctgaagatgccccataccataccacctaacctaaggtacagaagactcagaccaggccttccagctgtctccagatgtgcaatgacagtcaagttgaagatggattaaactgattgagtatgactgattgacagcagactaagaatgatccatgagattaagagagaacaaaaatcatggttccaaaacaggaagattgttataaaaattgaaagtaattcaaaaatgaaatgagttgttgcccaagacagtgggttttctatcattgagccattccacaagagcaagggatacagtgagcatatgcatataaaggttgggcgagcctagaagatcctgaaggtttgaagcactgtgctgtcactggagaaagacacagctagaagaattttgaaagtactggaccattgttggatatcagaaggctggagagccctgagtaggtaaagaaaggttgctagagtgaagatgagaggtaagcagcgtgggagagggattaatttatggctccagtaagggccagcactgttacacactcactggatttcacagtctgggagtaagctgggaacacaattcgttccagcaacaatagagtctgtaactgtttctggccagacagtataaatttctttactatggctgttgctgtagtaatttcaagtgccttaggctggcctgtgctgcagagagatctctggaacaggtggagagtgtacagtcagttgtccacagggactaaatcaaagtttctaaagcttctattgctagaagaaagtccaagcatttgccattgagcacaccaatcaacactgctgtgatccagggagacccagaggaattgggccgtttgttgtatggaaaggaggatcatgagaaatctccctgaacaagggatcccaacatcttcagtttgcaaggtgatagagacccacttccaaagcctctcccacaactcctcaaagaccagttagttgaaatcaaggaccaggattagatattgtctttcacatcataatgacattacctaagtcttccactcacaaagtaattttcaatttccctaaaaggcaccataattaattcaaggctcacttgtcacttgcgacttagccaatgtacatgccctattttagggtaatagaaactctatgatgtgagatatatctgctgtttcatttttatgggctgaactgtgttctcccccaaatttttatgtgaagtcttaaccgccggtacctcagaatgtgactgtattttgaaatatggtctttaaagaagtaattaagttaaaattaggtcattggggtgagttctgatccaataggactggtgtccttacaagaagaggaaatttgggccaacttttccacaggagggaaaatcatgtgaagacagagggaaaagacagagatctgcaagccaagaagagaggcctgaaacagatccttccctcagtacccttgggaggaaccaaccctcccagactttcatctcagacttctagccaccagaactgtgagaagctctgttgtttaagacactgggtctgtgatacttgattacagcattcctagaaaattaacacaatagcccaccttgaagaaaaacaggcacaatatatcagatatcccttagctgaaggcccccggctgcccttcttgaatcttaagtttttcttgtccatttaagggggggaaaaaagcatcccgccattatttcaggaatacatagacatatatatgtaatacccagtatctcctctaaaggttttcggccaatatccttcccctctccaaccaccttctctaccccaccaccaacatacaggcatgttagatctgctctgccagagtggtaacttctctccgtctttaacttagacatgcatttgaggatcaatgccaatgaaagcccagcttaaagcaaagaggaagcctgaacactagccagctaatttgagcagtctgacttatagagtccatctccaaatggagtgttcaggggttgataccactaagggcaggaaaccacctatttccttagtgacagtataccatagtggttaagcgccctggctccagagccaaaatgtctgtcttcaaggcttggctcacctattacttgctaagttgtacattgccttagtttcttcatctgtaaaatgggaatgttaatcattagcattattcaatggattccatttgaggattacatgagtaaagatatttcatgccctgaatacagcatctgacctagagcatgtcctcaagaagtgttaactagtcttatggttatcatcctttatactttgcttaggacccactcatgtattactagctctgattatggtgaaaggaggcaggaaagggagagcagttcaataataaagatatagagctactgctattatttctactactgctactattaatactactactattgctgctactagtgctattaccattgttgttactatgatgaatagctgccatgagtccaacacttccaaatgttggtgcactaaaacttttacctacattttatgatttgctactcacaagaacacctgtaggtaatttctgttattatcgggctctgtgtatacatgggaaacaaaatagataagtaacatgctcaggtggcacagccagtgagaggagaggcaaagccttaacaaaaaggtctacttggctgaaggccagtgctgcagggtgcccacctcataccctcccactttaaggaggcagccatatcttgttcattctccatcaaaacaccccaagttgcagtgttctaagcagccaagaaagggaaaccagcatcgcaggcatttacaaaatgcaccacttatgtgaatgattagcagaaattcaccccataacccttgcatctcagctcaccctccagtgtccacagctagaaattcagtgtgcctaaagtctaataaggaacacaggcatggccaagtatggtggctcatgcctgtaatctcagcattttggagggctgaggtgggcagatcacctgagctcaggagtttgagaccggcctaggcaacatggtaaaaccccatctctacaaaaaatataaaaattagccaggcagatggtgcacgcctgcagtcccaggtactcaggaggctgaggcacgagaattacttgaacccaggaggttgaggctgccagtgagccgagatcacactactgcactccagcccagcaacagggccagaccctgtctaaaaaaaaaagaagaagaacataggcatacctcatgttattcaactttgctgtattgcactttgcagatattatggttttgttttttttttttttttttttttttttttacaaattgaaggtttatttttccattgctagagcacaggcagagtagatttcacataattcttaatgcctatgggattttcagaatgttaaatgagctttgacttcaacttaaagtcaccagctgcattagttccaacaagaatcagcctgtcctttgaagctttgaagtcaggcatttacatctgtttacagcatgatctactgaatattttaatcctgctgttgagacctactgctcagagaaaaagatttctttcaagatgttactgctcactgataacgcacccaattattcaagagctctgatggagatgtataagatgaatgttgtttccatacctgctagaacaactaccattctgtagcccatggatcaaggggtaattttgactttcaagacttattacttaagaaatatatttaataagctatcactgccatagtgattcctttgatgaatctgggcaaaataaattgaaaaacttctgaaaaagaatcgccattctagatgctaataagaacattcgtgattcatgggaggaggtgaaaatatcaacaggagtttggaagaagtgaattccaaccctcatggatgactttgagggctttaagacttcagtggaggaagtaacagcagatgtggtggaaaaagtaagagaaatagaattagaagtggagcctgaacatgtgactgaattgctgcaaactcatgatcaaacttgaacatatgaggagttgcttcttacgggttagcaaagaaagtggtctcttgagatggaagctactcctagtgaagattctgtgagcattgttgaaatgacaacaaaggatttagaatagtacataaacttagttgatgaagcagcagcagagtatgaaaggattgactccaattttgaaagaagttctactctgggtaaaatgctatccaacagcatcacatgctacagagaaatcttttgtcaaaggaagagtcagtcgatgcagcaatcttcattgttgtcttattttaagaaattgtcgcagccaccacaatcttcagctaccaccccccgatcagacagcagccaccaacactgaggcaagaccctctaccagaaagaagattaaaactcactgatgactcagatgattactagcatttttaggagtaaattattttaatgaaggtatgtacacacttaatagactacagaagagtgtaaacctaacttttatatgcactagaaaaaaaatgtgtgttacttgctttattgcgatattcactttgttgtggtggtctggaactgagcctgcaatatctctgaggtgtgcctgcaaaagatctttgttttgaggattcgcagagcaagaaatgccacttggcatcaattaatctcaggaagtgaactaaatgccctgctacaacaggaacagaaaaagctcgccttgaagacaacagcctaaagcaaaaccacaaatcccttttctagcaaacctgctgtgaggaagctgatatcatattttaaagtgcacaatttcccttacaggcaaagacagcaaatcccagttccttcggtggcactgggttcaacgctggacttcagaaatttacatgaaagtacaaaaaaccagccaaacacacaaaaatgttatgaaaaaggaaagttacaaaatggctagaaaattgcattcttttctctgcttgattttcgagacctcatgtcttatcacacgataaggccttttctgtcattatgagcatcccatccaaattaagggcatcctacagtggtctccctgggagatgagaggcttgattaaaaggaggtgaatttctcatccctccacagaccttttatccgagctgcaaatactgactttattgagcatctattatgtaaggcaccatgatggggctaacaagacatttctcagacttcacagtttggctcaagtgttcctcataaagccatcatcctgaacagccagagagactgaagttattttcccttcctgggaacttctagagatgctccttcggcaataataatttccatgtctgttttatccattagatggtgaactatttaggggcagggatctattttgctcttccatgtatttccagaatccagcagaggatgcaatcaaactaactaaaggaactgatgaatcatctctagtccccaaacactcttcaagcagtcaacagagactcagcaaacctttcgtggagatccaaaacgtgtgcagtgagaacccatttacctctgatatcttgcaacaatttgtttttgaacaatcagggttcttgcatcatttttcatttacagggactgcgtatgaattaggacacagagcatttgctataaaaagggcattgtgatgtgaaggacaaccctaaattatgtctctaaccagtcaaggctgcctgaagttcgcctggagccagctgctgtaactaatcagcagggaggactcatgtcagtggtcagacagatgttcttaattaagcaactatttggttctccagtgcaaagtctgaacacttcttagagatgggcccccatcacttcaagctcctctcactgttctgattcttcaaaagagtggttctcaaactgtggcccagaccagccgcatcagcatcacctggaagtttaacagaaatgcaaatttccaatccccaggccagatctgctgaattagactgtgtagggctgtggaccagcaagctatatcttaacaaagccctccaggtgattccgacacctgctaaagtataagaaccaccactataaagttttgcccagatggagaatctatatggcttcagtaaatcctacccaagttagcaattgtcaacaacacacagattataaggctgtagttctattcagcaaagccaggactacagctagacaagagggtgcctagggtgcaaaattgaaggaggcgcctcacattctgggtgcctactctgattctctgtgactctgtggaactcgaggcattgtgtcaacacttgattcttgatggggatttactgactagatgctgcactaatgactctctcttgctgacttctcttcccatgagctaatcagcaaataaatttaaacaagcaaattaaatactagtcctcgcaaagtgcaatacttacaattcagtgttctacccttctttaacaacatggtatctagtcactaagaccttgagcacaatgttcaagaatatcaggccacacgggtctgtctgagcctgtatcagacacagaaggctggattaggccttaggtggtctcctcaaaaggaatcatagttgggtgttcagcaccataaatggttccaactggatctgcctcattcttgggtgccttggctcctgggtgattactatttcctgatacttcctgaggctttgcagagcaaatcctggctcctgccttaacacatccttcaacagggcttccactcttctgataatgatcatcacccccgagacaccactgcccaccaccctctccccatctcccacttgacggccatccctggagccacactgacaaaactctcaggccaggctgtagccaccctggcagaactagggtccttttcaatttctctgcatctatctacttgcattattttccctgctgccacctaagatgttatctagtgttaggcagccagcattctcagaagaaggaaatggttgcctttatgtttgggagacagcctgggagaaccaacacgttcatcagtcctacaggaggttgtacaagatgctcttgacacaagagggcaaggtcatgaccatctgctgagcatgaacttgtccagggacctgtgtggtccacccaagcctcagtaccatgacaccaactacttttttcttctccagtcctgggggaggcctgtcatatgctatcagtttgtgcattaagagatgaatttacttagctaagctgtccctgccttccttctttcttttgcccagtggaaggaattgtgagggtgacttggctcagtccattttgccattttctattactaaaatctttcatgctagcaggctctgatgtgagaagtcctaacaaaatgaccccacgaaaggtttgagtcaaaagagaggtgatgagacttaacaagtagatgagtttatttcacttaatgaccaggagatgcccaagaggataatctgttttcctcaaatcatattttgcctcccattcaggaaactaatgtctaatattttctgggtctcctgacatgaaactctcctcaaaatgttcaatttcttttttctgggtgttgtcaattatccttgccagcccagctgggtgctatctgtgtaaactgtccacctgatacatcctatgtaaatcctaactttcactgaagttttcattgaaagtttatagggttggtaaggcccccaaattaagaactcttgacctagctatttagagacaaagtctgtgctccccaggactttacaaatgaggaaagatgtagctatccttacaaggcaccaccccactaagtagggagaattgggccacgggtgcttgatgattttagaggaaaactaggatgattttagaggaaaactctaggtctcaggactgatgtcaggaattacgtgtgtccttgggaaaactatgtatcccagtcctggtctactattctacagcagaccctgaatggcttagcacacaaacggccttggcagaggctggggttgagtgggccttctatttcacacctctgtgcttatgtagtgtgtgtctcagaaatctcctgatggaggactcccaacccttctctctgctgccaccagtgattcccccaaaacacaagttaggttaccgcctcctcgaaaaccttcaggggttccctaatgcctatgacaagcaaaaccttcatgactgggtgccagaatactcttacattctccactccatctaggccactccaaagacccctggctatagccacacccaggcatttactgtggtctgagcactgtccctatgtcttccatcatcctaattagggaaaacttacctagatttaccagactttacatttctgtacctcaacatactcacctgtaaaatgggggcaagagtaataactacttatagagttgtagttaggactcagtgagttacaggcatccagtctcggtaaacctagacaagtaatattattagttgagcattctcctcatggtatggaactaggttcaataagacctcctcctaaaccaggctcagcctcccaaaccagaggtaatgacagctctttctattctcacagcccatgctagtggaacccccagcttgttcttacccaattctgtgtttttatgtgcttgtcttctcctctgctaaactataagcattttgaaggcagggatctaatctaatctattagactgtgtggaagttctttaagggatctaaagtcatttgggtgctagactttagattccttaaagaacttccatgacaacttgcacacagtaggctctcgctaaatatttgctggatgggagctaatctgagaaaaagattaaaagcaggcagccgaagtgcacagactttttggattccatgtgaggattcagtgtgagaacccaggtgtttactccataccacctacccattggagaaatctcatcaaccaaaaagcatttgtacgtgcaactatgtggaggtggctctggaataaactgaatgtgattgtaaccagggatcctgaatggagatttcaggaatccattaacctgcttcaactgtggtaaaaggggatcaagtgtactttttattttttcctagaaagacttcctagagagttttcattgaaggttcatagggttggtaaggcccccaaattaagaactcttgacttagctatttagagacaaactttgtgcccccctaggactttacaaatgaggaaagacgtggctatccttacaaggcaccaccccactaagtagggagaattgggcaacgggtgcttggtaattttagaggaaaactacgggaggctccttcaataattccacagtaagagaccgggaaggaagggaaataacaggcagagagagccggggacttggaagcctccatggctcacacctcctctgcgggtgtggagccaaatttatccatcattacacgtgtgtcctcagcctggggcccagacactcgccattcagctctatctggacatgagggttgttttctgttgaggtgactcaaaaacatactacctcaggatccagatatacaaaacaaggctgttcacctaatgatcgtgcagagttaagtgacacttaaacactagggtaagcctgatacaagaacaaagggaaggaaaagaccattagtgcagagtccccgttgcatctcctgctggcagatgatttggaaggagccttcacgcaggagtctgttttatttgcagaagccacagtggtaaattacagcccatcctagcccattctgggttctccagttcctcttggagctattcctgtcactgcccataggccactaaaacctgcccgcattcagaatgattgattctgctcaaactgcaagtcacaaactcatgtcgaaaaatccacttcaaataagtcattagcttcctttatggatttttcaggtcatgaggaataggacctgaaagtcccatttactggagagtagaaagcaggtgtcggaagaggcgggggcaactggaaaagccacagggagctgggagagcccttgttttctgccaatcaacaaagggggtttagcaaaaatggacccatgacttcattgccagtgccagatattcaaatgtaaaacaaagggccctgaggtctttctgtaaactggaagtcaagggatatggagagagggctcaggaggggtccatctttgctcccaggtcagatggagaatgtggagcacctgggacatagaaagacgtggtaagggaggagtgtctaagactttctcacttgtcatgggatggcccattccagctgggctgcgaagggagaccatggtgggctggtgggataagacatcccagcgacaggaactgaggccttagcagcagcccaaaggcaaccaacatgagaagcccgagttctgtagcttggcaagtttccactcaccacctgacccacgtttagcaattttgatgtaccatgaaacagacagctccagcccaggatgactgcctccctcagcccctctccagcaacgaatgaaagcaagatccactttgaaaattctcccccatcatgcaaactgacacaggcatgcttttcaaaaacccacagccaatctgttgatcattacttatttacaaaggccttcgggcagaaagtcctgtaaaaaccatacttgatacgatatacactagctttttctgcttgtggaaaaaaagtccccccaaggctacctcaaaccatcactttctattgcacataaaatgtagcgtgtaacactaaagtatttaatatatatggtataatatatctacaggaaaggcatttgtgtagaagtatgttaccctggatttggtaatttgatgttttgctgaaggctacgacttaaaaaagcctccacctcatacagaagacctgtcatcttggtacccaagagccaacagaataaagaagtacccttaagcagcaaaactttgacacagctttgaagcatatgaaaacagtataactcctcagaattattattactcaagatcaaagaaatgagccatactttacatagcaaacagggacagggaatttggctccaaaggtttcagatttttcagacttctctttatttatttatttgcttctctaaatttaggtgaaggaaagtggctgggcttttctctactttaaatgggaataactattagaattagataaggtgattacctaaaggtgagtaaataggaaatgaatgctagcatgacactggcatcataaaaacgaaaagcttggcagttggcacattttattcctcctcataaactgtaaacaagcatgcaaatcagccaaacccaaggaaggctgggtgaagtggaaggcagagaacttttaaggaaacatttaacaggaatagatggtgatatggaaaaggagttgggcagggtgagtcttccacggaaaacctgtgtcctcaaccacatgaagaaagactgcccttgcctattttccagaaaggtggatgtggagggccaggaacatgcaaatgttattgaatatggggagtggaaatcaccactattctatttcaaaaatcaaagccggtggccatgaaaagacaaaactaatgtcaagatggcaggcatttccagagcagaaaccacatagggtgagcagtgcaaatctgaaatcactcctgtttcatttgggtggtagagagtcaggatgtcggaggaaaaaaatgctgggattggcagatgaattgaagacaaaaaggggagataaaagacagataggccaagaagaagaaactgcagaacgctgttgaaatttgacttcacttgctatttaccagaggaagccatagtcaagaaagaagtgagggagaaagagagagaaggaggaagggagggagggagggggaagaagggaaggaaggaaggagggaaggaaggaaggaaggaaggaaggaagggaggaaaggagggaacatgtacatgcatgctgtatttcataattaatattgcttttagcctgagcagaactggattacttttgaactttgctttggcaagtccacagattattagactttttcttatcagtcaaaatcaattaacagaaatttgatttcaatcgacaggataaaaggaaggtaatcttcaggttcatttttgattgtgatgatacatctcacatatggccttaagtacagaaaacagtcctcggagggactccagcagaaagagactgccgcaggcaaactaaccacacgagtttctctgattggttaccgccatcattagtgccactgctgtttaggaactacacacagacaggacatggtgacagctaagactttaaagcctatgtatttttcaaacagcttttcaaactgtttttcatgacagaattttttcagctctatcattaactgctgacaagctgacagaataaatactccagcctttaagaagccatctaacgatctcgctcccctcccccaccccgggcttgctggggaggggagactctgggcctggcagggtgaggagagggcgaggggaggaagagaagggctaagagggaaaccgtgggcaaccagcccctctccttacctcatcagcttaggcgaggtgttgggtgagttccgcatgcctccattccgttgctttttttttggtgatagtgttgacggctgctcatcttcaactggaaatacaggcagctcatgagattatgaacagtttgagggcagactgtgcaatacaggcaaaatatcaaaggacacacactcaaggctcagtcactcactaggaattcatggctgtcttttaggacccaatgacaaagaccaaatgtgttagtcaaagaggccggcttagagaaggtgaaggcaacacctctttacactccagcctttgaacatacactttaaacagactaaaacagtttgtaaacaccctgccataagaaaaaaaaaaaaaaaaaagaaatcatgatttatctgtataccaaaaaaaatacttatcattattcttagagttaattttggttactttgctttgcccagtaatagactgcgttttgttgtaaccaaaatcagaaataaagttgtatttgaaatgtcagcataactgccagcctgctgcttctccagatgaaccaacttagctggttcctaacccctgcataccagagaaagagcgttgaaaagaggcaaggattcaaggccttgacagccaatgtttcaatcagatcggggcacattggtgcatgctggctcaataatccccagcccaactcagctcttatccctccaactgccaggagggagggcttgtggggctgtgccaacggggtcctttttcaacccatgaagacaggagcaccggggctggtgaggttggaggagagccccggaatgaaggaggaggttgccattgaatgaaatctctgatgatgcagcagcggggcagggatggagggcagcacaggggattggaaaccaaaagctgttttccaaatgtctaaaccacacagattgctaagcaatgtgaagcttcacttagaaacaccacagcacactctactgctcttgcccaaagacacccactaataagctttgcagatgtattagcctgcatcatgcttctttttaagagaactgcttgataattagcagatgcaaacccagcctgtcacccaggggcatcagcggcaaaattctagtcctcctctccccacccccacaattcaggctaaagctgtaatatcaagaaggaaaaataagatctttggattcttatagttgactgcaacacagactaggaggaaagcaccctgaaactcagaatgcacagcagttaccttaaagctaagaagagaaatattagcagtgatgacatcaaaagagacttgatatatgttaatggtgtaggagtcttagatgggggagaaagtgccatgtcagctacttggtattatccaggaagacccatattagagcatgcattatatggtacttccctgaaaacgctaaataaatttagtaggttatgatacatgcttccaaagctattttaataatccaactaccctccaaacctgcttcaaagtattacacattttacactctcctattctgctgtcagtttgggcttgtctaaaccctggctgatgcaggaaaagggaatgactgtggtgtaaggtgagagtgagaccagaagagatgaaggcaagaaagcacctgcaaacacccacagccgaccccctgtaccacctgcttcctctgacacccaccagggcccaagctcaggccgagactgtatcagtcatttagagctccaggcagagactatgtggctgggatgatatcgcatcttatcagaaatgagtatccaaagcaaatcacacagagactaaacagcacttaaaagattaaaggaaataaatacaagccacataaatggtattgaaaaaatcacttagagttgatatgcatctctcggcaagcaaacaggcactctgagcttgacctgaattcatcttcctttcacaggataggggaccaggcatctgaggcaataatggggtagaaaggcagcgagggtgtgtgggtgtgtgtgtgtgtgtgtgtgtgtaggtatgctttcgcactttccccatcttagaatgaagtagaaagtcttgcactaactagacgtataagacaaggtcatcttttaatatgggccacttgcaattggtgtattgtgttcagggtgacctagactggttgtgtagcatgctggagcaaataacacgtgtgtgtttgtgtgagtgcatgtgagtcactctagtcggggtgcaagttctgtttttctcatcttaaggttataattcagttagacttcttaaggttataatcccacatccaaaggtttttatctaacctagtctaccacggctagcatttttcaaggtcaccagatgctaccatggttgtgtccagttacacaatgaatctagatgagttaagacctgaacagaagtcatcctccctagcatgcctgtgggattattttgctgagcattggcttccctttttgcattgggcctataacaaataatcctctttggttaagtggccattatctttacaccttgttgctacactgatcttcagatgggagagttgcaagttaatacctgttagccagctcaagggagacacctcattctggtagtaaagttatgcctcttctatgcaaagaaactatttattttcattgcaactcagaaagatcatccatcgtaatcatactgcatttaaagtgggatttgttctccaaaatgaaacttgtgtttaaaggtttcctcctgcactcacagcctaaaaatgcagatctgttccctgaagagatgggggaaaatgtctccagcttaaatatatgaacgctgtgtaatggagaccattacatatggcttaggtccctcaagagaagcagtgataacttctttctcataagtaggatataaaccatatttaattatcagcctttatatggatcctatcaatttctgcataaagaaagcagatctaggaaaacttttagttaagctataaaatataattttcatttcatggcttctgtgactacatgagaggaataaaaatggaattaaaagggagacttaaatttactcactttcatgaaagacaaacgtgttgaagtagtgggccactacctcatgacgatgcaaatttacaagctcttatttaacctacattttggctaattacaatacacctccatctatggcattttcacttgccttcatgctgcggaagccacatgaagatatgatcctttaaagaaacctgacttctttagaacacaaacaagttcaggaatctaacgtggaattttataggagctgaactccatccagtctccaagtactcataaaattcaagggcttgtttttgcacatccctaagtataacacttaatgtgctgttgtaacttcccagcgctcccttgtctaataggcactgaatctaacagttttacagtttgggaagactcagtgctagaaaaatgtcaggcaagtctaatgaggcttcagatcccctggtttgcgctagagtttaatttaaagttacaatgatgttttaacatgtttgcttatacttgactaaagaggattcgttatttcaatgacataacctccagacaatgttctgagaattgatttaagatgtggtggtaattccaacagccttaatgcagagttgaacatctgtaacaacattttactcgacttttcatcagcattctgttttcaagcaaaagcaacgtcttccagaaacactggccagaactctgggcttacttcaaaatgattacatatttcactagatttttaaaaaaagaaatatcttcctttatcagccgcgccagactgcaaacactgtgtcagggtttaccaagcctctttatggtccttggagtgaaatggggcaatgattgcaactcccagccttccctaattcagtctaatgcctgcattagatggacctgatgctcagctctagcctggggcacattccctctgccctgtttccccagtgagatttaaggggatgatgccctttaagatttaaaggtgagtttattggctggagttaaaaaacagttcaaagcaaataaactcagaaacgtaataaaaggcaaacaactcataaacatgagtcaaccgctatctccattatgttattaatcaccacatctggagaaacccacatctgtacacacttagcaggtcattagtaatgtcatattcacactggagtcactcagaataagagtcatgcaaagtggtttgaacacaaaggcatctagctaacagggcttccgactgaagtcttgcacaagctgccagtttgggggtgaggtcgttttaattattattaatcgttttttacggttttcccttttggtattttgctgcccaacaagctaagtgcaagctgaaatccacagtagtgcatcgctcttcttcaactgagctcagcatggtaaagtagaatgttgagggctgcagggtagttattaaaaatgggaatgggtcccagtcttccttcacctggctcggtcacaagccgagaattgggagtctccttcttgaactcaaatggatctttggaatagcgtgatctagctgcaaccttgactgccaaacaataaggagaaaagaaaatggaaattaatccatagtgaaatttcttttagaaaagttccaaacaattttaacattgaatagctttgaatcaaactggaagtttctccctcacagctgaattgccatttttttccctttcttttaccctgatgacttcctgcaattctttttgccgtcttattgtcatctgtatcagtagggataatacttctggaaattcagaagacaatcttcttggtataatttccaaaaatatactgagttccccgtcaccccacaacatgtacagacaccgaaaactcagtttagcagcaggatcagacccattctttcctgaagtctgctaaaacaaattctactgaataatcattatattccgagtcatcaatccttggtgataaacttttgctgtctgtctcgaactgccggcttggtcagcccccttagttgtggtatcagtgcctaacattaaatgccgtgagtttgccactcctcagaaagacagatccacggcatttccttcggccgtcagcgacaccagtgaaaagtgggtgtttcaaatgttgttttactaaaatgaagggtatggagtgatggtaaaattcctggaattttacaacagtcgtgttgcaaaatgtaattcaccatgaacaaaactcccaagctgacctaagctctctctgatatgactgtttaagactttcaccagaaagtttgtgcaagttaactctcaaagtcttacggcatggccacaagagcgcagtctctggattggaggatggaatggtgcctggctgtttctcacacgaaccagacgggtaagagggtgtggttgtttccttaagcgatgatgggaaaacaaccacaaaaataataatacatgccagctgaacaacccatactgtgaatttggtagtatgattcctgtaaaggagcacttgactgctgtttcgggatggatcccgtggtggggaatgccatgtgtccatcgacgaggctgagctattaagcacagctaggatcaggcaagccaggcaatggagccaagttctacgcccagagagtagtgggcagtatcagggtgcaggggagttaaagtgggtgatgtccttggaatgagagtttcttgcctgacaaccttgaatagcacatatcactaagaagtttgataagcactgcagtattcttcataaaaatcaactataaatctattttttgaaagatcgtggctaatattttctttttctgagacaaggggtctttgttgcccaggctggtgtgcagtggtgttatcttagttcactgcaacctctgacatcacggctaacattaatccacagattaggaaaagaagaaagatgctgccccttaaaagcaaccccaacgatcataatatctcaaacatatacacctctctaaaatcaaacaaccacattatcatatacattattctggcaggataatttcacaacttctagctaggaaataggaaacacatttacttggaaaacctaatgggtatcagtttttaaaaaatctatcgttatgcagaataagaatttcaaaaaatgtctaagtgacctgtactgccctaggacaggcatagggagtgcccaccccatggtaggctgccagggcagggaagggaggcttgttggagcttttgcatttctggcttttgtggagctaataggaaaatggggagggagactttaaggaacaataggttatgtagaagttaatcacagggtgtatttctggctctattcactgcctaggaaacctgaattgtgtaagtttgagtccatcaacacagagtaatgaaagaattcagctcctccataggagagagaaaaaaaatactatataaatatatgaacagaatccacatgacatggaatgcagtgttctctacaaaatactgcgggcctaatggatcctctagaatccaattgggtaaattagatgtgcccatgctacccatgccataggccctcaaccccaatctcaaactatgttctgtatgcatcctgagaggaactcagcatgtaccaaagccccccatatctagaatcgcagctcatatatcttcgctgtagacttgacctgttagaatcattgcccaacactccgccctgttcagtattcagtagaaaatccttttggaattttctggttgcctttagcccttttctttttccctggaatagactctctattacctcaagggcaaagaaaagtctcaagcaaagatcactaggtattagtttcttagagatgagacacagagatgaacgatggaattctaagaggaaatgcacaattgaaaagaaaaattcgagaacttccctgaatttttgctatggggtttggagaatgggaaggtactaggagatgggagataatttttactttacatccaactgggagggctggggaatgtatagaagtccaatacaaacagcccctcccaactttcctttccttctctccctactccctactcctgacaccaaaagccaactttcggctttgtggcaaaagttaaacctgactcctttaggttgccctagcacttgcagtccgcgtttgtgagggacaacttttagagtagggatgaaacctgccacatcctgggcaccaacagctgcttctttctcatctttctcaagttcaggggtcagcaaactgtagcctgccacctgtttttgtacatcacatgagctaagagtgtgtttacatttttaagtcattggggaaacaaaatctaagaataataatatttggtaacccactaaaaagatatgaaatttggtggctataaataaaattttatcagaccatagccacagttgttggtttaccagccatccctggctgcttccatctctaacgacaaagttgaggacttgccatagagaccatatgggttgcaaagactaagatattaactcgctgacctttgacagagaaagtttgctgacccctgcagtagtttaatcttctcacatttcccttgctttccagtctccacaaagaacaatgttcttcccaacctgccaagacagccaaataacaaaagaaatacccgtggagcccacctgaagtgcacagatctggggacattgggaggaacagaggtagcttagtgactctactgtccctaccacccaacctgctattagccctgctggtccgctcgtgtttgaggtcatgagtcaggtgagtttcacattttccaactcaagctaagttagattcatccacccagtactttggaaagcaaggcgaaccacatctaccgtgagcaattcctcgaagctgtcagcgtgtgctgccagtccaccctgcgagagccccgtacaagacaacagattaaccattagactagatatgttgaaaatatacagcttcaacctttccccagctagctcagagcgatatatagatgattatttcaaccgtcagctgccgcatagatttaaacctctgcacaataactcctggattcatctgccccttgtcaaacttgcacagctttagttggaggatacatggtgtggcagtttcactgtgaatccagaatgatccagacggctgctgtctctttgttaacaggaagccaaactgatgagtttgtaatgcatttcttatcaaaggtagtttcagaaaagaaaatgtgccccatcagtttggctagaatttcacatacacaagattataggcttaatcagaatatctctgttattttcttgaggaaatagataattccacatccattccattaaatcattttatgccaatgaattatgtatttatgaatttataattatccttgatttttcttccccttttgcagtctacttaataaaatcatcagctggagcttacaaagcaatagtgcttaatagatacaagcatgctaatatattttttaagtgaatgctgatctttctgagctgtgtgtctaaaatcatcattgtgaataaaagaattgtaatttccaacccatacatttaacaaagacaaagtggactgtaatggaatttatggagcctgtaaaggaactctttttctaagacggtttataatcaaatagatttggatttactgtaggtcaaatcaggtcccccgatgtgtatcaagaaaaaaatgcctgtaagataccaaacactgctcctggcaccctggaagggctcacacccatggctacagctgctagtttcctggtgtcctcattgtttccacccctagtgaattcagtacttaaatgtcagctttgaaatcaatatttatactgtcttcacttaaaattatgacattctgttcatcctggattttttaaattttgattattttgaaaatattttattttgatagtttgaaaatattgcatgaaactatcatttatcttgattcctgaggttttgggtctcctcttaaatttggtgcccagggcaaaagcttctctcacctcgcccaatttccagccctgaacaccatttctcaaaggtgtttgaggtactggttctgccaccccacagaactggacaaggcaaatctaacacaagacttatttcttttgatcacttcatgctgtttgcatgagattgttaaggaaggcccttgcaacaaacacttcctcgtggatttacaaattgtcaggcatcccaaggagtggagaaaagatcatgctgcctcaggaatctgagatttgccacctgcccagagtgagaaacagaaaagagagctggggtcaggtctctcgtggactttatttcacatcccacatcaaatcctcctggttaacacaatgttgatttacatttccactttggggtgaaagtttttatttgcttacatattttgacaccaatgttactttctttttctttccccccacccccaaacaggttcaaatagccatgactggcagaagatgtcaatcacatttcatttccattttcactttgctgtttacattctttaaattaatgcttgccccaatgattgtgatatttaaagaccagcctagaatctaattgtgtatatgtgaaactgttttctaaaccataagatgttatataaatacaaaccactattattattaacattattactattggctcatccggaaataccatatcttccattgagccaatggtgtcaagagccccctagaattctaatatatattccagatgggtgcactgataatttctttcaaactcagataaaggtaaaatgcatgggtttttagtgcaagccaggtgcccgacgaagaatattctgccagaacactttagaaatacagtatgcttttaaccttgggaggtaaggaccagtgtggattatgactttacactaaacacagcatttagtatatttcttaagggcataatcaccttctatagatgttcttgaactataaaatctttatctgtatgctatcataatttatcctcggacacatcctgtgcaatattttataatgctagtgtatggtgggcctttctggtcaatgcattggagaacaaggtgtggagtgcaacagaagggctggaagcggcttggggatgctctggcctcaccctcttttgcgtcatagctgcactcatacgcagaccctgacccaggacccaggtcggctgacttctaattcagatcatttgctgccagaattctgcctgtgagtgagaacagcatgaggatatgagcttcttgagtcagtccacctgcccaagtcccagctctgaccctctttagagctctgatctcagaccagttactccatacctcaatgtcctacgatctactgtgatccctactggaccaaggacaccaaatttcggagatgctttgggattatgtgacataaccagggggctgcaggctgacagcctgaggaccaactactgtccccagtgtgctgagcttggcaccaccctgctgatacacaggatttcacatgtgggacaatctttaagtctgaagattgtccatacaaatatggatttctaacttctaattaaaaatcttgtagaggactgagtcttcattccaaaagggtgccattctcctggggcaggagcttatcagctgctcaaatgccccactgctgcctactgtacccccatatatagggcagacaccccatgtttgcatttctggccctggaaccagtgacactcaagtgtaccatccccgaaataaagattttaaggcatgggatatccctccacaaatgcctactcacattgagtgggtagagaggttaagagttaaccacacaggtcttaaagccacattgttgggtctgaacctaggtatttggcaaattatctaacttcagttttctcaccaataaaatgagaattagagtacctatctaataggttgttgtgagaattgactgaaaatgtgaaaagcacttaaaagaattcctggtgagctctttctaaatgctacccatgattattgccttggctttgaagagtcagagcaatgagagttctctgctgctgggtccttctccacaccagtctgccacatttggacatggtgtaattcacatgggtccatactctctctccttccccaagcaattgagccgctaaccaacacttagaatggggtgagcattcccacccccacctgacccctagccttgcatctcattcaactgtcacctttgtcccttgtttcatatggccccaatgaagtgctcaagtcaaataattaggttttgccaaatgtcataaaaacaagaaaagccagaaaacgtttaaacggacctcaattggagaaggctggaaccattcagggcaagaacaaatgaaagacagatggggacagaggaaccccactgtttcctctaaattacaggaaattcacgccgtctgattgtgagggcctcttttctttcccttgaatttctgctgggaggtcatgggattgatcggcgtgtgcagacacatgggagacagaagaaggggcagaggcatggcggggtagagaggcagtgactccttcaccaggctctcccaccatgtcttcctttcacctgactacttgaccacccttgaagggacagcctaggctgcctcctccagggggccttcccagatgattatgacaagatcaattctctcctttctttaaaaaatcccctggcacttctgatctcatgccttgcattattataatttgtgttcaattctaatgtgttctactcccccagctaggcttataagctcctctgttggagttcacatatcactgagtctctcacaatgctgggccctgaaaagttcccaataaatagctccgagcagctacagaggcgatgttgcaaaggggagaagcacagcttagtgatcaggagccccggggttctaggcctgccttggatcaactgtgtggccttggcaagacacttccctttcctggggggatgagcattagttaagtatgagacccttctggctctgatttgtaatgactctgagtttaatgtcgggcatacctttttcttgttcttttctttaaaatctttttaaagatgcacaataagagagaaccacaagcctagccagagaaattagataattgcattaaatacgaatatacgaactcataagttacataaatgcaacagtacaaaagatgttgcatgagaatgtcaagggagggctacatgaaatgtcttagacaataagttaagtcctagagagagaattgttcaggaaaaaaaaaaaaaaagaaaggaagaaaaagaagacgacttgaaacaagaataggatgaatagagaggtcccgtatatccccagatggagcacagggcctggcactcagggggcacttgacccatgatgctgaacagactaaggagtggcagtagagggtgggaagggcatgccaggtggaggacacagtttgaaccaaggcaaggtggttggaaaatactaaactgtataaactgtaagaaagtcaatttggctagagcaggaaaatgtgtttgagggcacagttggaggtataaagggcagagagtgtaagcgtttacattccaaatgatagaatttgcacaatatttagtaataatctgaagcctctgggaaagctatttttcttctgatttaaatactgaagttcaaagaggatagtgggtgggctttgcatcttgcaaaagtctatcagaaactgcctagctcgctcagcccactttcctttccaaggtaagaaacacacattcatgcatggaaataaagcagggaggcccttggcaactgtccagttccattgaagttctcatttttcttttttttctggagagcttattcaacaggaaaataaagttatctaatgcctcagaaaggggtcccgtgaaactcacaaggcctattcctcacagcccagccaggtaaatttaccctgatttcaggatggctatttcttgtcttcaactactccagctgatcccatcccctctacagagaactggaaggaaacccgtcagggtttgacttttacatgaaaactgactgcaatccatattttcaaaaaatcattttcaacaaaaccagtgctttaaaatagattcactgagaagaaaatgtttccccaatcctctcctccttgattttgttgaatcaataacatttcaagatgttctctgtgaaaatcacatgggtgagttaaataagaacatacattacattatctagatcctcaacttgcagcccttagcgcagtatgcctgagaaaagtttaaaaactcaaaagagagaaatcctattcaaagagtaaaatactgcctatgcttccaaagttctttacggcctgataggtagaaatttaataatgaagggctgggaatggtggctcacatttgtaatcccagcactttgggaggctgaggcaggtggatatcttgaggtcagttcaagatcagcctggccaatatggcaaaaccccgtctctaaaaatacaaaaattagctgggcatggtggcatatgcctgtagtcccagctacttggtaggctgaggcaggagaatcacttgaacctgggaggcagaggttgcagtgagctaagatcgcacaactgcactccagcctggatgacacagtgagacactgtttaaaaaaaaaaaaaaaggaagaaaatttaataatgaaaaacataaacaaataagtgagtcatcctgagacatatttcaattctccccttctgtaacctcaataaattcattttctcccacataagctaatgtttgcactaaatattctgtacaaaggaataccgcagaccataaaaaaaacagtaaaaagatatagctgtgtcttttttaaaaaacggttgaaaaattgggtatgtgtggacaaaataatttttaaaaatagttttgcttgcacatttgatttctctcttcatttatgatgccctagttgatgagctgatcaacttttctgtgaaaagtcttcctaaaaaacagaacaaaacttaacagaaactctgatcctgtttgtcaaaatgtagttctggccccgagagaaaggcaatattctttggatgacttggattctaaagcaactcttttattagtattattatttactttttttttttgagacggagtctcgctctgtcacccaggctcccaggctggaatgcagtggtgcaatcttggctcactgcaacctctacctcccagttcaagcaactctagtgtctcagcctccaaagtagctgagattataggcacctgactaatgtttgtatttttagtagagacggggtttcaccgtgttggccaggctggtctcaaactcctaacctcaagtgatctgcccgcctcagcctcccaaagttctggggttacagacgtgagccactgcacccagcctggattctagagtaactcttgatgaaagaacatcatactaaggtgatttttatataaaacattaattcagtatatcaatcagtcactttaataaaaatgcccctcattatcctgaggtgaatagaagcctatgggattaatttgtgtaaatagatattagattaaaatgggaacttgccacataacaataatcagatagcataggcaatccaatctcagtgctgaatccagtattgtgtgtgtagttaccttttaaaaacagtaacatgtatttaacttggacttgcttcaagtaagcactgcatcaggcaagttggatttcaaataaaccttagcaattgaggggcattgtcgtactggaagtatatctcttcaaacaacagcaacaacagttttagatatttattttagagaaataaaggagacaatctgcaagagaaaaggcagaaagtgaggaggaggagagtacctagaatccaggtagagggtttatttctagaaaagcagcgccacctgctggtggacctgcatgtcaggcccttctgcggcttgcaggccatctgtcttgcaatctatgcataaatacacagcagtatttctcagctgctgttatacgtaagaattgtattaccagtaggcagatttctaacacactggttgtagtttaataatcctatattacctgaagtatgggttatataaaaacctagaatgttaattgttgacaaaccaattctaatatgtaaagcactgtaagtcacccagtaaatacacaagtaaatcaaaagggatagctctttttgctctaacaacgtgttattaaaagccacaacttaatcacttacataaaaataatgttcatgaatttcgatgtactaagaaatcaggaaaatgcattataatcttactaacagagcttttccttcacttacaatttagaggaaactattttgcagaaaatatttttccctttctttaaaaaatgtacctaaaccaacatgccatttaggaaatttgctcctataacaaaacctagttacaaacaactaagattacatctataaaatgttatatttttaaaatagcaatagagaagttgtggaaaatatgtcactgatacagtgagcagagaaacactacctgtcatttttcaggaaaagatcacacaaacgcgatagcaaaggaacacaataaaaagcagaaacaggaatgtgataggtgactctgattgcatctgcaaaggaaactgtgaaataaattaacacccaagtacccaagaaaggcacattgtggcttcactggaagtgatcattatgcaacagagaaggttggtgattttgtaagaacagaaataaagtgtagcctgtgaaatctagtggtgataactaatgaccatactacttacaactctgatttgatctctaacataaaaaaataaaataaaaaagtactctaaagaatagatgtatgcaatagggattgtgtttctcacttgaaacaaataaacctcaaatgggatcaaagggccccggtaaatgaaaaatgacagttcctatgttgccctgatttgatctcaagcaaaactaccatgctgataacatagcaggggatgtgaggaaggcagtggagttcttggattgctatgaaaaggaggcgagtgtgtagcccattcagctgatgggaagcccattctaattccaaaaagttattgagatttaatctctaacaacaacaacaacaacaaaataactcatgcggcaaccaaaagggtatcctttaaaaacacacatacacaattttgttatttccaatacattctgtagaatctctttacattcaattcttccatctgtctaagctgggtaaggcacatgtgtgaagagaaccaaatgtcacaatgcttgctttgagaacgaagtgtctccagttatccagacagggagcttgactaggagggtctcaggcataggccatgggcatcccatctcccatctcagctggctaccactcactctggagagacagggtttccaggagcaattctggacagatgcaaagggtgaaggggaatctggtggggttcagggctgtcaagattcgagttgggggcttaccctgcctagatataactcctagtgttagcttgtgtattagtccagtgagataaggtctaggccattggctagggtctgaacaattaaaggtgcacaccctgccttaaatatccaaatttatttgggataaattcaaatcaataaggaaacataggtggatgaacagaagcaatgggtttgccatggcttcctaccccgactcaaatacccaatgacatatggaaggagaaaacatcagcacccccagatccactacagagcccaccatgtgctgtcagcagaaacaacggaacaaatgtgttaccttcagaagaagcagtgatcaatttgagatcaatctattcaagagttgtccagcagtcaaaggaattggctgttggctgttcagaaacaaaggttctgttcaagaaggtataaaggaacaagaaggaagaaaggaagatctctagccttgagacttttttttttttttttgcctctggttcagcttctcatgaaagacctttttccttgagatacatgcttaataaactatggaaacatattgtcaacagagtttacatgttaatcagccatttattgaattcacactgtgtgtcttggttactgtgtgcaatatgctaagaattcaaagaccaattttgacttctacaaaaacctcaacataaaaactgtctaatggggtttacatgaaatgttacaggcttacagaaaagagattcactttttctaatttggtttccgggtgggctagttaagaaggcttcacagagatggcagtacttgagctgtaccttcacagcagaggttggccaactttttccctaaaaggccagatagtaaatattttgagctttctgggccataccctttttgttacaattactcagctttgcagttgtagcctgaaagcagccatggacactgagcaaatgaatgggagtgactatgttacaaggaaactttacttactacaatggatggcaggccagactgggcccatgggacagtgtgctgacccctgctctgaaggatgggtaagttttaatctgctagaagcagagaggaaaagaatcacagtctcaggaaaaggttccagaaatgtgtaaagtaatgagaataagacgcttctagagaattgttagatgatggatgcttatgtggagaacggaactagggaaactggttgaggccaaactgcaaaggctttgaatgccattttaatagcagaaagttggaaattatcctcttaaaaaacaaggaaccatcaaaaggtctctctctttaaaatgggataacatgacaaagtctgtgctttagaatactaaagttggtggtggtttggtggcaagaggaactaattgaaaggttgaagggcaacaatggcagactagctgaagaagaaatgagcatgtgagcttggcagtgccactggcaatggtgagaaaaggttcgaaatgtaatctggaggccaaatcagaggacttggccatcggtaggaggaaagagagagtgttacagggtaaaactcagaatttcaaatgtgcatattgatactcattccactcatccctagacctatccacacatcaggtctgctgaaagaaagggatagtggtaaggcatgggtgaaaaacttgggcccagtcttggccttgctccaagcactcatctaattaattacaaaatcaacaagaaacagagcccagctactcataaagcaaggtaggaaaggtgatgatgtgaagtctcaacaccaactggacctcaaagatatggccagacatggtggtgcacgcctgtagtcttggctacttgggaggctgaggtgagaggattgcttgaacctaaaagttcaaggctgcagtgaactatgatcacaccactgcactccagcctgggtgacagaaggaggtcccatctcaaaaaacaacaataacaacagaaaaagatgagttgagatcaagaccatcatcaaaaaagaaattttgatggaatttgaaaggacaggaatgtcttctttccccatctgttctcctctttttgtgttccaactttccctccctctcccaaaaacacattgaatttgctgacgatctccagacctattttagggatggacaagccataaagaaggggtttcagggggatgaggaatgatgagacctgaagtcacagttttctaatgatcccaggacctaaggattctaacagctgggctaaaatctaagacacacatttattttcatccatcaaatctgtactattccaactaggaagcctcttttgcctggagatggtgtccccgtttggccctatatgcttcctgctacacgatttcattcctggagacctggcaataacaaaacaaggtgtaacaaatatgatgaggaggctctttggggaggtcaacagttagcattcattgtgggagggcagggccatttgtagagacactgcatatgaactggtctgggatagcttcagtagctgacaatgttctgattactaataacccccaaatcactggagcatagataataccaggaccccgggttagggagagggcctttttctgtgctttccttgaggaaaataaaagacaccttggaagaaaacaagctgacaataaagtagaaacctgtaagaatcttctgggctctttcggtgtgtccctgtgcgcccagttcctgccctagaagctgcgaactcacagacagaagactaacactgatatactacgaggtttctacacacataattgttcctcacaggacctaccacgatgttgggtaatagacatcagcattttagaaggatttataacagtaaggattgaagcaaaaaggacttttagcctttctcaatcagaagaaggaagataatcagagtctcagagtttaaaggaaacttagaaatatgaccttccaatttcctcattttacacacaaattttgcaaggcctactggatagtcaagatggaaatcaatgttctggggagatatagctgtctcttggtatttttgttggcttatttctgttgggacaattattccatgacctagaaattaaacaaattgactccatttaacttttatagtctgttatactaagctgttcaactctcagccactatctgtgggcttctctgcctgtagctgatatgacctcttataaggctagcttgatgacagtcagtcatttgaaaaaaaaaaaagcactagttatggttaaagtggcttatcattattatttccatcaatactatgggagatggcaagcttctgatctagcagtccactcatccgctatgtgatcttggtcaagttcatctctgtttctttgttaatttcatatgttaatgaaggatgataaaaataataattcaacatataccaggcaatctttatatatattcactcactgaattcgtgcaaccactctgtgagataggtccttattatctccagtttatagatgaggaagctaaaaaatagtgaagttctggaacttactcaaagtcacatggtagtaggacatgatgtctatgctggggatgcctagatgaaatgagatgatgttggtgccttgagaagcacaaagactcaaacacacataagacattactcttattatagccatgagcatctacttggtgaacatgtcaaagcatgacttcaccaggacttacttccaaagtttccagaaaattcacagatctcacccttgtatctgcctgctctgacgtttcctagaatttcaggctgtaattgccaacaagatctctcagttcactgcacagtgaggggaatggcatcagaatcccctaacatagagaggaggaaatacaggagatgtctgcctgtttcccatcttcatcttaatagaagatgtttgtgaaggagcagtgtttccagcaaccagccccttgcaaatttcacattcatgccctaacttccagaccctgtgacatgacctgagccccttcctccctgtcttcattcctagcatagttgcagcttttattttcacctagcatctctcttctctgcaggtcattgtgcatcccttctcagtaacatctgtttagggctttggttttgaagcatccctgctggatatgttctctcagttggatacgttacaggccatatgtggaaatttactcatctgcactgaagaaatggccagatcagccttgacaaaatgcagagagcatttcagaaccattcaaaggtaagggaatgcttggtgcagcctgagagagctttgagaacaatcaggaaaactcttccttggcttgagcagaacaaacagaataatggctcctaataggtaatagctatgagacattcagcttttggatacctccacgcgggaggaatcatttgggtgctgctgttgcattcaagctgcctacctcgagtcagagtcaaattaccctgaccgccataaaaggcctcgaatgttgctctacatttgggcaggttgatgtgcccacctgcagatgctgacacctctctagctacaacagactcctttcctcacatgagccctgcccaatgcattggttttatgctgccctgactcacaccaaaataatcaggtttgctgaaattaataaaactgaatgtgaatgtcacaagtccttgattttccagagcaaatgctctatatgtggtagtaaccctgccactcctcattggaagcattggtggatttttgcctatgtggttttttctggtactttgtttccagatcttctttcccataatttatccttcacaaagaatatcaattgcacctgccatttgatcattttctagttccttcagtcatgtccttgttctttcttactacatttttccctcttactcttcttgtacatcccagttttttatgtttacatatatatactatatagtaagttgctgcttagaaagttttgggaagcttcatggatctagggcgatctggcttctagcacatcaccaattcctttaagggttgggaagcccttcatttattcattcttttactcatgaaatatttactgaactggaatccttcaggccatttcctattcaagtactcttgccaatataggaagcccagccaaggatgtcagcatgctacatttttgaccttggagggagggaaggcagcccctgggtcctttcttgactgagtgtgatccaacaggctccagcccagaaagctgacattggccaaaatgaagatcattttaatgcaagcagtcagctcccttcccagaagatagcccatgctctatggtgtgcagatgcccatctatgcactgtcgatacagctggtgcagtgccagctctagggctggagtctttctcacttcatttataagtctctcagtgcagtcgatcatccctaatgcagatctgcctcaaaagattccattttctatttgcatagggttttctctgcagctctaggaacatttggtgggactcatcttgcggtattgaaggggctagaatgaaaactttcagatttactagaaaaggctgggggagttttttcttgctgtttcccttgaatatgagagattagctccccctgaggatgaccaaatgagatggtctgagaagaaaggccacttttgttagtcctgctcatctgagctggacatcaaaagaatgtctcctcagaataaaaatctgtgggcatgtgtagcaatctccctccaaagcaggcactatctagctatttacagaaaggcctttgcaattccctctgagatttcaaatgcaagggtctgacaatgctggatttagctctgtccatttagattccctttgggaaaaaggtcagctggggaagcagaacccctgtaagcagatgtggcgatggagggtcccctgactatccaggtaattcaacaagctggtttgggagaaagccccagagagagaaggacaacacacagctggttggcttggtgcattttgccacattgcacttccagaagttggcattctcagcatgcacagcctaccaccatgagggaacccaggactcaagtgcttttccatgcagttttaatgaccccctgaggtcaatggtgtacacaaatgccacaatcacggatgctgacataagtaaggacacagacaaaggtcttatgcacaaagcagtaaaaccgaaaagaaaattgtgcatgatacttagaaatgccacatgacttctttaggactctgtgtggcagtacttcacaggaaatgtgttttgtatttccactcgagaaggttaagtgtttgaaaactacagtggattttcagtgaatgggatgtgaagcactttattattttccccccatcgatgtaaggagacatgctgacttcctgagaaaggaggagaaaagtctccttgccatatacagggatttaaagaataattcccatgagctctaactgaagctaccacctgcagctggaagcaagagcctcagcgctggccagctgtccccactggtggctcccacttgctttgtgtctgctgctcagcctgagccaatacttcacaccagcaggtgagagctgcctgcctgtcaccttcaacacactcaagatgtaagatatatttgaactggggaagatgatgaggaataaggaagaaataatggttaggaaaaggaaacagaagcagtagatccccaaggccagtggtagtggatgcagccgagtgggtctcctagtcctgggtcaggggtcaggaaatcttcctccaataagaaggaaactctagcaaacccagctaggaatcacaatggctgccaggtcagctggggagaattaggctcatggaattcagctgctccagagccactaattaaactgtcttttaaagactgtaacttcttggatttgcatctgggcaatgtgcttcacctgcagggtcctgcagactatagatcaagtcttccttctgaaggcttctcagaacagctggggcccgcccacaacaggctcccctctgtttgtctcctccccgagaggggggcttccagctcccctctagtcagtcccttcctcccctgcagccacagcagccctcccaaaacaaagcctctgttaggtcacttccctgatcaaacaccaatatgatagtgtcgcactgtctaaagactttctatcatattacagactaagaacaaaacccttggcctggcccctgccaggaatggggccccattttacccttcaggggggtcaattccctgcatgctaagtaagtcttaaactctagccaaattgggtggccagctgctgtgcaggaggcccccccaggactctctacattatctcgaggtttcattaccagaatcctcacttttttctcctcccttggagattaagtgacttatccatcatattcaactgcaagagtaactgagcaactcaaccgactccacactctgtggagccacacggcctgtgttgaaatcccagctccaccagtcactggctatgagacccttggcaagtcatgagactgtgacatgaggctatgagacccttggccagactcactggctatgagacccttgtgccttagttgccttatctgtaaatggggcacattgcagatgtctcaggttatagttgcctcaactgcaaacagcagttaccacataataagggttaaattaattaatatttgtggtaatagggggagtagtgcctgtaatgcagcaaatgctatataagtgttaaatttaacaacagcaacaacacatacacacatcctccctgtgtactcagagttgcttgcacacagtaagagtagagactacactaattctagtcgtaacatgaatccaagttaaccaactagccatttcttagtaatgctgtgtcaacaagtctcactcccttggtgatgcagtatacacagaatatagatctctttggggagtgaccccatgctcagataagactaaaacatgatgctagcctcaaaagagaaacataatttttcagcaaatgttggtagtatgcctccctctgtctctcctcaccaatgagcatgacctgcttatgattactaggtccactccattctggtttccatttttggctgctctgtgcttgcagcttctaggcttcactgggagtcaaagatcccaaatgttaagatcgttttgaagagcatgctggcaaatgtcctaaatgtgctgggccagatgacaagcatccatctccgatgaaggaagtatccaactgaaatgatgggcaccatatgagaaggagaatcccaaggcatgatggaaaccacaggtgctgcagacccactgtccgtttctgtctggatggggaaggaaggcaggatgcagtgaagcctgtgccactgccccacaagcctctctcgagtgacttcacaccattattggtctgatactaatttgagacaatacccaatcacatcacaacaaattagccacagacacgtgatagcaatcaactcagggggcgatcctgaatgcgggctgggggattctccagctccgtgagccgcacgctcccacagatgtttctaaaagcgtcttcccagaggcccatttagagagaaattaaatgcaacttcgacttaattaacgttttaaatgataatgaatacaatgtagattcataggaggcatttacattgtgttgtaaaattgataaaaatttaataactctttgttaataagttatgtctccccagacccataaagcctaaggcgctgcaaactccacactgggtctaatcgaggctcctggtgcaggtggaggaaagaggcagagacggacttgacatttgctccaagcctgctctaattcaaacctctgcttgttcatcagtactttatttcatacagtaaaggtcaggatttgggctcaaggcagagccttgacaagaaagctcaagtggaaggcgggctggccctggcatctgtcgcctgagatagtggaggaggatggaagatgaggagctaactggccacatctgccctccaccatggaggtaagaggaagcattcactgcctggtggtagaagctgtcaggatgagtatcctgagaaccggccactgtcctgaaataaaaaagcaaacataatttctatgtcaccttgcataagggcctcttctgggcttacatgaggcatgccaacatcttttctagtttgtccttaaagagccgagtcatttattacagcatggtgtccctgggaagaaaggtgtcccatgatggggtatacacaaaggaccctgtcagcttccctcattctgacctttctccttcttgtttcccaatcctgtttcaaagaatttcttttgagaagttggctgccttttgcctactgttcccgtctcctttcatctacctgcagtacatcttcatagtgtattcatcttcaggaattcaaccatactctttttttggaaggtggtgaaagcacaacaaggtccccaaatacaagccagtgactttacctgacactcaactgaaacaaccagctatttattctggagaagaacccagtgtgttgggagctcttgacagatgagcgatgtaaaggatccttctcaaaggcaattttgcccaagcatgatttctgccttacaatgctgatttaagaagctgcccactgcacagagtgagctaaggcccacagtaaggcatatttccagtcaacctatggctcagcgtggctatcacaaaatcaagcaagaggcagtggcttctgtagcctcacctgctaccaataagagtgtcttaagaagccccttccaggcccatcactaggtcttagtcacaggggatgacccagtggctgcctaggccgatctgccactctgtttttacttcctgcaatgaagtacaaagggtcaaatcaagacgcatgggccagggtaactaaagagccaggggacaacccaaaggctctggtagtgtttggtgtgcacatgtgtgatggatattgacacagagagagagagagagcgcactcacatcagcacggcaagcatgggaagatgggagaaaatggagactcagacgaacaggctttaaaactaatacatgaaaaactatgatcacatcgattcgtgcttattatccttggctctcctttttctgtctttttctcactggtagtggtggtggaaagaggggagtaattgattttagggcccagaagtaaaataagcaaatagaatttaggtttggggaatttgaggaagtcacctaaaactgcacataaaaggaatgagataattataggctgttgatttttaaatgtagcttattaaattaactctcctttaacaggcgttggagactgtcaggatagggtgtgtcctattatagacattttcctagagctgtttccaccccctgcccttgtatctgattttatgtacttcaaaatgccattagttcacttaagtgactttagttctattgacaatgttaattctctgtctgcacaaaccaaaggctactcaggataagctgatttttgtttattatctgacaagactcgatattacactaaactgattttggtacgtctcccttcaacctaatcatattggacttctctcagcttaaccatcggagttgaatgccttcttgtattatatttatacccaaaataaaagtcatgtgtaatttaaaattagctacagtagtttgcaaaaggctgcatgtaattgtgcaggtttaaacaattagtaaattgaaaggttggtgtgagcaatcacacatgtactttagctaaagctggttccaagtgcaagtctaaaggtctgcttctcttctaccacaggattaatttgtttgtgccagagttactgatgctttgtgactagaatcatgtcaggcaggtctcagcaggtctgaatcagtatggccctacgttgccactgcatcataattttaattgtccctttctattacatttagcaatcagatagcaggcaagactgaaataacaagaataaacttctaaagagagagaaaggtccattttacaaaattatagtgggaagaaatcgtactgattggaatctacttctatatttatgtgcatgtgtatgttgctagacattcattttttacatttaatagtactagaacacagctacttgtgaaaaagccgaggcccataccatcctgatgtcttttgagagagctgggactcttgcccaggaccatctgaagtggaaacaaaaccaagatgatcataaaatgacactctatgcactgattctagcctaccatattgaacatttcagtcttgccagaaataaaatccttttgtgatgaatccttatcggtcacaatttgccttacttttctgacaccttttattttgatttttgtctttcctaaactagtccttcccctctgaagttcttttggtcaacacagtctggccttccatctcctcctgagttcaacagaagacaactatcataatagcacatgactcaaccgatccacagtaatgggccacacctccatagaggggtgcaccgagcaggcagcccctgttgttagaaggcaggttttcagaactgtgtgagcacttttaatatattaccattcctctgggaaccagctacttctcttcccacttcacaaaacacataatgggactttgtgtttcaatttaacatcccttgaaaacggaaatttttccccttataagaaaaaaaatagagtaaagagggaaacgaaaggaaagagagaaatgaattaggcagtctccaaagcacactggctcaactgggaaactgcgaccaaagcaagctccataatagtataatgacctttaatgagtgtcttgggaaacaatacagccctagcataaaagacaaagggcaaaactcatcatggctctgctgacactaattcaaaatgattttcagaacaactaaagaatgtaagagaagtaatctgatccgcccatctgacctcactttgattcaagggcccttctcctgccatttctaattgtcaaaccctctacatttcacatctgttcatatttaatgaaaagcccactctcaccactgctcttgagtcaacttgctctgtcaaatgggcaccacccaactccaccaccagcgagggatgcctggggattgctattggagcactgccagtggaatttcacatagagacagacatttttataattggagaagaagggcttatgcaggcccaaaaaggggctcaaattggaatggatttttctaacttattattaatggtcaaaggtgagtggtctcacacagggatggatgaaatctgcttttgtttgatggagtgatgacggcaggacgactgatgaaacggagaaggcaaatcgccccctgagctgtcaataccagttaaggcttcaacacgcagcccaaagctccacgtgttccctggtgggggctgattttggaggcaagggagggacaacatgccactcacagaatgtttcttagagaatgggacaatcccaccccaaggttttcttctccctggtctccatcaatggttggattaaattgcacagctgagaaatccctctaattaagatttctcttggatataatggaaattacacacactgggcaccatggggtctacatgggggacacagagtgtgctgtgattggtattgttggccagtgccaagacatgaccaaggggccctagctcagagccagagtggctcctttcttttctccactgagtctaggctaaggttttagagcctcatgattatttgagaacagaagttgtgcattaggcagaagagtaacccgggggcttgtggttactttcaccaccatcagtcaaagagatgtgaccaattcatgccacctcaggccctcctctgctcttcctccccagcacctatctttgaacttggtgtcttgctgcacatcgtagacagacaagttctctgtgcagctgtgccctagcttatctctgtaatggcatgcaaactacagataactcttcaggggaaaataaagtgataaggattcatatggtagcatctaaggattgtaacagaaatctttccaagattttaggcccatatggcagtccacactccctctcaatgcaacctccattaggtattactttgaagtgaatcctgtcccttggcactgctctggagcagcaggaaatcgtgaatcagagagaatgactctctggtcctagatcaaagttttccaaatgcctctaatatggctcgatgcacaaatcatgctttgcacttgaactttgggcccaaacataagcacctggcatggcacacagtgaagtcccggttccctgagccctagaggcctcatggatcccggctacacagccgcactctgctgggaccagcctcaacaccagcacaggggagtcaagccagttcattttccatgggaataaatgcttaagagctcagtgatcttcttcctcctgtcgtcagtgtacacctacccctgctaggaaagtgtagctcaaccagctctgagcacttggaaggtgagaggacagggagcaagaggttagcaatatatgtgttggctgctttaaagaggaagggaggaagtgcagaaacgagaaccatctcctaccttctatgctaccaaaacatgaaaacaaagttatagttatacttcaagtaaagtcctccagtggaaccacagccttttctgcacttggaccaagacccacagtcccagggtctcaaactggagctttcaggaacttcacttatgaaccgtatcaggaaaacagcaaagtccatggggaagcaaggataagggaggtctcaggaaactggcacatctcagccttgccagctaccagctgcatagccttgacaggttctttaacatctctgagcttgtggatgacaaagaagactgacatcagaggcctgtgctatggactcagggatatcacagaggtttctgacttaaattttttgttggcatttggaatcacaattgctgcaagataccttagttaaacaggggctatactattggaaaaataaaagatattaatggaacagtccttcaaaatagtcatcattctgagaaaaagctctgtaatccactagcccagtgcaggctgacagacatagaaaactcgtttccagaacaaaagacaaaatctggcactggaggaatgaggcacaggttagagagacatagtaaaaagaaaatatatatatatatatatatatatatatatatatatatatatatccatctgcatcaaaactctgttgtattttggaaactatctaagaaactatctaagctcactaaaagcaattcaatgctagagctggcttgttctcgctacaccctttccttcctccctttgatacaattcaatttacagccatttcaaaaatattaacatgtacacttctgcatatctctgtattaatacagtaggtgatatgctgtcactttaatttccatttatatttatttaaaggagagagaggaaagatatcaccagactgtaatatcacagtcctgcatgctgttacgagaagcgtaagttaagaaaatcagaagggaggccttcctaggcacgtacacagagacataggcagctggggcaacatgtcagcacacaggagttcacactgggaagaagacatcagcccgactgactcagaaccacagggcacagcacaagacagggatgataccacagacagcacaaacatggaactacgtgtgttgaggttaaacttacaggcacggaaactggtggagcaatcattaacagagacagaagaaagtgggaaggctctctcaagggtgtccacgttaccacgcacacggcctgacatgcatgagcagtcacgctcagaacgtccgcaatcaaaacaacatgcccgtctcattctcttgtagatggacatcttggctataaccgtgtggttggatgggaggagaggaagagcggcaattaatggcaaggtcacacacagcaaggcagctggaagggagctgaagggatttaacacaggtcttagttcactttaacagtcttgacccagaaaaaaatgcagagtgattgttggtaacagtttggttgtacatcaaaaaagcagcgaaaatataaattgcctttatcgtctcccaaggctgttgcacatgatttttctcccctaggtaaagcggtgaccacaggaaaagggcatggctgaatacactcgggttctcaaatgggaagaagagcaaattatcgacagcaaaaaacgtaaccaacacttttcccctgatatgattaatacaggaggacaaaatatacacactgccaatcaatgaaattagctgcttatttggtataataaatggtttttgcaagatgcaaaaatatctaatatgtaggctttctaatttccatccatttctgggcattaggcagaggctgggacaagctttcatcaaattagatgtgaaacgattacgtgttaatacagtatctaaggatgcctttgctgaacttcccgagagtgagtttatatgatggctacaggaatttaaatttactcttgacagaacaaatatccaaatctgtccatataagaaatgcagctactcaagactaacgctgcagatttgacattaaaggcagttcacaaataagaaatcaccaaaagcatatgagatgttgctctattggaatgcatttagctactcatgggtgtattttctgcttaaagctgagaggatctgaaaatcgcatctgcctttctctccccaccaaatagaaattcaggaagcaatcaggctattggttaatcatattatttcttttttccttatacagaaaatattcgccaaaatcgattaaaactgacaaaacatgaaatagaagaataggttccacgtgaaatatcttaatgcaatttgcatgcagcattgatagctcttctaaagctggtatggtaggttctgcactgcctggggatccaaactgagtggtaacctataaaagttgttggaagtcagcatcgtagtttccaatgcccttcacctttgcctttcaagccaatttatatttcagtacaagagaaggtttttgtacctcattttgatgctacaacaggcaaacatgtttgcttatcacttatcatgaactggcctgcttctctcacgaggtgggagaagaattcacatttattctaagcattactgccaaatggtaaacctaaactgaggaggtgttattccctgcacccacaccttccattttgaaagtcatttcccccactctttctttttctttgtagagaatggttgcactcttattttaaaatatggcttgtggttttgccctctttgaatgttacagtcaccaggaagaggggtttaaatctctcaaatgggtcaagtcctgttctaagacctttatgacttgccatacagtatatttgtcaagcaagggtaacgttatgattgtgaagaacaggcactgggggagatgaatgagagatctcttcagcagcaactccattcttgtaaacttggctcacatttttagtgacgtgttcttttagtgtcctagctagtctgttgttcagatcatcatgcagccccagccctgttcaatggtggtatatcattcctttgagctttagcttttaccaaaaaaaaataaaaaataaaaaagttccactatagcatttgaatcagaggaatttagaaggcatggtgtgaatgcccagacatcccaaacaaacagcaacggctgaagtcaagaaagggaaaaaagtcttcaattaaagacatgaacataaatttatcttaaatgcatccggatctggcatacaatctgcagacattcccttgttttctctttcttatttcttttactggaaatattgatttgttatttacacagaagagggaaacaaggatgatttttttgcttcaccgtagataaatcattttgaaaaacaatttttttaatcaaatgctgtagcagaagagaagcccatcaaactctggaatgctatgcttctcattagcaacggtccctggttttcatttccatactgccattttgggtttatgtacaataatagaatctgacacatttgtggagaaagaaagttcttataaatataccgtctttaaggataaggggagggatgatggggatgaaataacttttgaaactatttgttcagaggcaaacagatcagaatgggtgatgtaaacctcctccttgatatgagttcaggaggaaacacagtgacaaaccagtggctctcagggactgtttgcaactgttattgttagccgttctggcgaccatgcattgttctaaaatttcttattgttagcatgcaggaacaggctgaaactggtaatcgaagcagcaaaaaaccatgtgctataagaagattaactgttaattataagcagtcacattccaaagcagcatatgcataaaaaagaaaacatgctattacttgtcattccttcccaatcatttttacactcacaccaaatgcaaaatagaaatctcaaaagacaaacaagtgccaccacacacacacacacacacacacacacacacacacacacaaaatcagcaagaacgatcaatgagaggctcaaagacaagacagaaacagttaaaaactattgagccccacatgttgacaaaccttcatgaatcagaatgtctagatcaaggtgccaccaactgggaaggtggctctttttcgctactgctggcatagtccatttccattgactccctgtcaggtatcttcacctagagacttctgggtccactttcttaaaaggtaagacctcccatctggtggagcgattcatcaggcttgaaggatatgagtactggccaggaagagctctcctctgggccattatacaaatcatgaacaaactctttaactaaaagctgatgaggagttgtctccctggtggtagatgttccagaagaattgaacactctctgtgtaaaattatactcttaagttgtaaaattaaattatatcaaagttaagtcatggacctcctaatttggaaattaccacccctcatctctctcaactctctctggcttcctaacccttcaattttgttacagtgaatcatggatattcagaaccactggtgttttgtttccatttctcagtgactgtttccttttctagagctgatttaggttagaaggttaattttagatatgaagagttccactttaaattcccaaggttaggtctcaaagtgcaactttgaaaatttcaggatttatttcaaacagaagtaagtttcttatctactccctggccacacaaagcatcctctctcctttggtgtttgctaattttctttcttacgtagtcacccattgttcccttcccaaatcccaattctcagacaaggttttccccaggatgtcaatggtaatacaaagtagatctatgaggacatctagtggatcaatgtggaagagcagctagttcatgggcagttggaactagcctttctccaaaaggagcagaaagaggaccctgctgtctctgagaattgaaatatatgcagtgtcatttcaattcaatggcttctcatgatccacagcagatgattaggggtaggggcagtgaaagggtgagaggtcctaggagatgagcctagggtctgcagccacagctggcacaggaggactatttcagtggcagctgactgcgtctcctttttaaagccctgctgcagcttcctgagactgggagcagacaagagtgtgtctctggcaagtgtgaacaccaaagctacttgtcattccatcttagggctcttgaaacttcatgctcaattaactgccccgataggccaacttaactctaggaaagcagaaatacaaggctctagggactcagtttaccctctggttcacatcataaggttcttgttattggaccagggccatggattctatgaggttatgtggttgctaagaatttgaccctgagtctcaccttcctccgaagacctaggtcctggcagtttcacaatttgagaaaaagcttttatgtgcttttcttcaccacagtgaagtggatattcaaccaacatttccatcataacttcatagtactatttacagagacaaaatagaagtatttccctaatggacatcatcaaaactatttgtttactcttgagtgtttaaaacaaaaaggcttctcagaagtgttcttggacaacttttcctctattctcaaaggccatgatcatgagaccagaaacctgttggaaagtggctggtgaagatgcagctcagttactgctctttccttgagtcaaatggataatcagctgtcaaactcaggttctctgctggctggcctttctgagccaagcctggaatggaaggaagaattggattccatcctatcctcagcaccatctgccacctgcatcagcaaccaaattgtcagccaatttccaatgcagaatcttaatttccagggtggattggaagaggcaggaaaaagcagtactggactgaggggcccaggtggagttttccaactgctggggaaaatgttttagatttcaaatggagcaaattcaagggaagactgggatggaagaaaaaaaacatctgccattcaatcaatagatacttttcaggtcacagcctcacttttaaaatcagtcaaatgaaggagggattatttccaagcaagaaacatggagctactcttcatgggctctgcagcaactaacgttactaataaaaatatccacggaagaaaaagtccaccaggatttaaggtgaggcctttgatgtggcactgggaatcagagaatattctttcaagtcctataaatgagaaatgatgtcttcacttagcaaaattcctcccattaccttctggagtaagaagaaaggtcttccaggtggttttccaaaaacagaggagaaagaaaaagctagttaatgtcagcagcacagagcacactgagctagttgattctgcccctaatgactgtattgtggctgaggaaggcagaagtatttggcactagagttgttggttgattgacaccacattttctctccaattctgaaggaccattcaatttagtatgcagctctgcaggtatgaaagtgggccatgccctcaagccatgtttaaagggttctgtcgatgaagaaagccacagagtcgattttggcaagactgtgcattgaattgaagaaggtcatcattgtgttttgtttttaaagtgagcaatctataccctccaaacactgatgactaaccaaaatcagatgatcaacttgcctcttttgctgcaaaggaatgaggggactgaatttgaaacatcttctccaaattccagagccattggactgaactgttccacagattgggtctccttttcagtagagccttacaaacatgaataaagacccaaagctcaatgctggccttaaaagctcctcctcaatggccacatcttgttgagtaaaagggcatcctattccttgagtaagttagaggttcagacacttgtattgacttgttcagacttatacattgctcattgctgaaatggaatgttctcctccagtcagcttttctgccttaaacaggtaaagggatcttccaagatgtctgactaacattcataaagcaactgggtgtgtcctactgagtactgactaaaagaaaaactttgttgtaaagcaagggaacttcatagactgcagataataattaccactgtgcaaatacttgtctccagtaagacaattgagatacttacagtcccaaagttgagtaaccaattaattatctagcaagcacttctcatacagagaagcatgtactgcaataaatacatcactctatggaatatctctactcttatatgtaaaaatatgaatttttacatataagaatgtacatatactctgatacatcatggtacatattgtgtgtgtgtatatatatatatatatatatatgtatcacaacatgggaatatatatgtggcatatgtgtttcctttaggagaggaatccaagctcaataacaaaggagaccaagtataatttatcaaaggcaagcatgacaattaccccagctgatgaagcatctggagttatagtggtaattacttcagcctaatcagtgtcccttaaaagtcctgagacaaggccttcaagagaaacacactgttgtcaaggtcttattttcaaatagaaaaataagacagtgcccgaagctggccagagcccggggactggggtggatggatggagagcaggctccctggggactctctggctccaggctactctgtagactgcattgggggatgaaggagttggggcatgatgtcactgctacatgcaacataaataccaaaagtaaaagggaaactaaaactgtacagaaaattaaaagagtatctcttctagagaaagacagggggaactggactccgggctgctgggaacccgttttactcacaatatatcactaccagtgtgcagttaaaatagagtaggggccgtattccaaggcagcaaagagaaaaaaaataaatcaaagatatgtcaatgatttgaagtcaaagaaaattccttcaaacacatcaaactagacattacttgtccactaggagtccacactttggcaaacttttagagtctgggggaagaaatgtaaatcattagacaaggtttgttatatagaaaaagaaaatgagtaaatagtagaccctgagaacttgctcctcggccagacagctgaatttgactcttttccttgatagagagctatgaagaaatggaaagaaatgcaaacgttaaactatactatcacaggatttccagaaatggaatgtccgcacctgatatttctccggatgagatgacgtgaaatgttgaaggttactgaatgaaagtgaatgaggagctaggggtggaagtgaaaggggaaggctgggttggggaaggagggttaggaagctatgggtaagggccagtgactgtcatgagctctgccctcatgggatctaccattccagggtgaattattaatacctggactaacacgtttggacagatgagtatgtgggtcagctgtcttctccaacttagagagggaaccaagcaatgtctgttcgaaggcatgggggtccccccagtgtgttactaataatcctagtttcttctaattaaagtttctttgcaactaaaacatcttctccaatttcctcacttgcctgacctacatggggaggtttatttttaataattcattttattctaaccaccccctcacctcacacacacatctgcatcctgccctctgttctatggccttttaattagtaggagcaatattcagacaattctgattgttacatagccaaaggcctttgtgagatgaagaagctgaggttgggggaggaggcacagggatgtacagagaaggaagcgaggcccttgttacactggcttggctttgtagaggcaggccttttgcagcaattggtgcagtgcataatgggagattatatacctcactagctccaccaactttaaaggaaatgaagagaagaaaattatttcaaacaattatgggcctctctctccaggatgaagctaaagcctgctgctgtttacctgtctggaaccaaggtggaaaaataccctagaggccaaatccttatttcttatttctagggacaatttagtctgctgtgttccactatggcgtcctatgagggacattccaatgtcagagcaagagtcagagaagttctcacttcatccttccacttccactccttcctcccgagaatgctctccatccagacaccagggacatcttttaaactaagaactaatgatgacatttcctcacttaaaatcttccaaaggcttcctaatataggactaaaacccacacttcttaccacgtcccctgtctccgtctctaatctcatctcatactaccctttccccagtgccactggcctttcttccatccttcaaacaccacaaacttattcctgcctcctgaccttgacctttgctcgtctccctatctggattgggtcttggcctcaacatcacccctgactgaggccttcctgaccttccaagctataaagtagcaccactgcaggattcctcaaccctcaggcagtctcttctctcttcttagcactggctatctctgaatttatttatttacatcatcatggtttgtctccattcaccagagtaaaggattcaggagggcagggactttaccttgttgaccactccatccctgaaaccaaaaatagcagctcatccaaagaagatactcaaaaatatgtgaacggctaatcaatatgtgaatcacagtcttgctatttccttgatactctgtgggatgagggtctggcaaatatcctgtcaggggttattggcctcacctttcctccctttcccaacccctcactacaagcgtttctttacagaagtgttcacctcttgtatttgttgttctctcttatttccctcaaccctcagactgctgtgctccttctgattgaaatgattcaggagatgtctggtcaactcatccgtgctgctgtgtccacaaccaactaagcatggctgggatggactgcctggtgaagaaggtctttggattcatggggtctgtgggggttgaatggggagtgaggttcattctaggccttgttctctcttagatgctcttctcggtaggttgtcagaatcggggaattcttgtcccaagaaattagaggctcttgttttgagatatcaataaatactcatctcgataagagtctgggggaaggggaccagctgtattaagtcagtggaaacagggggaggaaacccatggtcctaagctgccccaccctgaggggatttctgcagaaacttctctagaccaagagtgcaccccaagggaattttccccatgggttgaggaacttctttaccctccagcagagtgatatttatagatgactggttctacattttctgtaccccactctaggagtacaatgaaaaaggtccttccttcagtggcatactttaggaatggtgctcttctgtctggcttctgcttgtgaacaaggattttatggggtactctttcataattgttcttactcatcagacccaagactgcccacattgcctttcccttctgcaaaaaaatgttagagcacccagagaatcaatagaggccttcaggtgtgcccaaatccctgtatgttggctgtgtgactgtcagcaatctcatcctctcaaacttggaagcttagtttcctctttttgtaaaatgggattaataacacccctgccaattacatggggttagggtgagaatcaaagcaatgattataaggagcttttaaaagactaactcaccataggaaggatggcatcattttttgtttgtttttcaagggttgagaacaatttctattaggcaatacagcataattactgcaaaaggcacaaccttctcaaagcaaagaccacttaagtcatggtatctcaggagctcacaattccacgttctggactcactatatctttctcaagaggccccagtggcaaactgctttagaagggacttgagacagaatatgccagaaacaactgagcccagtctagtctaccccaaagagcgatgatgcttgaggtcgacctttggacgatggcaactgaagccctttggcagtggaaagttcttttcttgggggcagtctgaaggtatcacagttgccaactctggcctgtggtattaaaactagcaggaattccaaatggaaagagtcaactcccattttggagaccaagtcctcagatttagtttctctctcaaccctatatactcagggacccccaatccactggaaatcacgatacaaaaacactttgtgctctgtggctttagttctcctccttattatacatcatacttgtctctgttagactggacacatctactgaggcacctctagagtaaagaagcagggactaggcacaggtttcattcctaggtgttgatggtggtgatttttcatcctctgctctaacaaagcaaggacaggtatttatttcatatttctttaaactgctgggtgaaacataaacatactcaagaaaactctcgatgtttagtgtttctctaataagaaaagggaaggaaaaggaatttggggaataggaatgagaaagggaggggacagggagagaaacactacttacgccgtttgcagccacatttttttattcttttgggatctgtgatgtcatcatgacaggccttgcagtaaaaaaatgccctggagaaagagaatggaaaaactgacacgtttcataatccacccaaatgaaatgagtaccacatttcctccacggtggtgccaaattaatgaaacacgccagcattaatttcctttaatcttttgaaaggtttagacatttgcagacggaaatgtttgttgcaagaccatttatttcaaacacaggattctgtgatttgagttagtgctccttttcataaacttccatttacaaagaaactgggaaaaaagttgctgatgtgacacactgtgtctgctcattcgtctttcatttttgagaacagcctttgatgctactcgtggggacatgtgggcaatgagccctgggcccttggtggggaagttaaatacaacaccaaaattcccacagtctggtcaaatatatatttgagggggcagaagtatgtcgtttctcagtcaaataaaaatatcaagcttgtcactctgaaagcaccttttctgggcagccaaagggagacagagttgaggaggtctgcagagagggaaaaacgaaagccacgagtcagtgggttcctctgtcaaaccccctctggagtttcacagcttattttactccaaagctgactggaccaattcccatgctatccagccctgagaacatgcactaaatgatggttttcttctcactatggagcaaagctcagctgaccactggaagggggtgagtagagcttattgaagcaataggtaggtagaaggagaatgagatgaagcactcaaaaagaaaatcccctaatctgacttgaatgtccataggtgattccacagtgcattagctgtgtcaaagatattctggataagaaaaataagatcattcaagcactatttgaaatcacagtgcctagaacagcacaagaggcctgtgccctttcagtactggggaggtgataaaattcactggaacaaccctacaaccttctggatccaagaactaacaaaatccctggcttgttgcctttaccactcccaacaggaaactgaatgccagctatgaacatggccttttcttgaccagggctgcagaaataaacacaattcttgaccatttgattcttaggttcctttttatgttttcacaggacttgatttataattggcactcattggaaaccaatgttaagacttttggatccacacgaggtcttggagatcctgcagcctaaatctctgggactcagtgtcctcatctgtaaactgaggaggttgtcgtggactgcccagtcattccatgctgggattcagccagccccaggacttctgaatccaagtccaatgcttgctctatcctagcaaattctccactctttctttaaatgccagctgtcatctatgtctcaaaaaaattaaaaaaaaaataaaaagaaatcctagctgactgttgaccctgagtggcaatgtggctaagaacccaatcaatctgccttggcacaggaagaacaggaaagtagaaagcatccaagttggggaaagtaactctgcgtccacttcctttggccattttccctccccctttgttgctcttaacacataatgataataacggtaacaatcatatagctaacatctatagagaacagactacatgtcaggtgtggttctaagtattttataagcattaaacatatttgatcctcaaacaaccctttgaaggaggtatgattattatttctattttacagataaggaaactgaagcacagagaagttaagtgacctgcccaaggccacacagctaaaagtaccaaagctgagattgaattcacatagcctggcaccagagcccaaggtctatactaaagagatgatgacatgataataagcctgaatagacttgtgaaaagataaagtttgattacttcatgaactaaagttggattcttttttaatttaatttttatttttaattgacaaataataattgtattatatgtgtggtatgcaacacattgaaatacatatacaatgtggaatagttgaatcaagctaattaacatatacattatacagataaagaaactgaagcacaccttttgtggtacgaacacttaaaatctactgtcttggctgggtgtggcggctgacgcctgtaatccaacactttgggaggctgatgtggatagatcacgaggccaggagtttgagaccagcctggccaacatggtgaaaccctgtctctactaaaaataaaaaaattagccagtcatggtggcatgcacctgtaatcccagctccttgggaggctgaggcaggagaatcgcttgaatccaggaggtggaggttgcagtgagccgagattgtgccactgcactccagcctgggagcctgggcaatagagcaagacattgtctcaaaaaaaaaaaaaaaaaaatctgtctttgcaattttctggtatataattcatttttaactatagtcaccacattgaacaatagatttcttgaacttattccacctgtctaactgaaatttcatgttttagatggacatctccccaatccctcccaaccccagcccctgttaaccaccattccactttctgcttctatgagtttaacttttgtaggttccacatgtaaataagaacatgcgatgtttgcctggcttatttcactaagcataatgtcctccaaggctaggcaattaaggttaataagtgaaatgaggcaagggtcgggggtgtccatggtgatctggagcaggcagagtatctaagctcagctgacctctgccaagtggcatttctttgcaagaatcattctcttccccacccatctttgcctctgtcatgctcacctcgcaaagcccctcccttactgcacacctgcacctgagcaacggagtttcgctgggaaagaaaacatgctgacctcactttaaacccacaaccatggatttcaggggccttttccactctttgggatctaccccattctcctgttgcttgctttctcacactccaaaacagctctctctcctctcctctccacttgctccagctcaccgtacccctcccacaagcagccttcagctggtgatcttgcttcacccatcatcagaccagctttgtgtcctgcaaggctggcctgtatggtctccttgtcctctggtttcctggcctgcgtgtccagtggaaggagtcagcaggagactagggtgaggggggatgaggtcaccaccttgaccccccgggtgccctcctgtacaggtctatgaaatggcacacgacagcctctctctccagctcctgatagccctccttccccttgaccccacagatctagggtgaaggtggcttcccctttcttgctagctctgcagtgcttggccatcccttgttggttttcctttactatttgcccataactttacagtctcttcataaaactctcctcctttttcccatttaagtttgtcatctgtttcttgccaggacaagaaacagcacccacatttacatattcatctccaattcacacttatccccagaactccagactctaagatccaaccgccttatgatatcactgtgtgtatgtttagtacacatctcctacctaacatagcccagatagaatgcttaacttcctactacccaaaacttgctccttctctagtatccctcatcttggttaagatcaacacaatctaagccctgactctagccttcatccttcattcctcttttttcctcacttctgcccaattcattggggggttctgcacactctcccaaatacagtctgaatgggaacccacctctctccacctccactcaggggtcagtccaagctgccatcatctctcacctaaactatgcaataggcgctgagtctctcacctcttctcctgccccattcctctcattctctacaatgcaggaagaatgaccttttcaaaatatacatcagatcagcttaaagccatcaatgacttccattttataacagatccaacctttctataaagtgctttaggagccagcctctgcctctctctaacctcatctcataccactctccccaaatctattccctagccgcactttccttcttggggtccctatccacaatgaacttcttcccagcccatctcttcttcctatctgatccctgcctgatggattatttcccttcatctcaatctctgctcaaataccaacccctctgagaagctttcacttatacccaacccaaatcagtgacccagttgcattaattcttttaccactaattattttttaaaaaactgtaattctttcctgcctagaatatgagccccacgagagttgggacttctccccattgttcatttttcaccactgtttccctggtgccttgtatagagccttctaaatgtaaacgacttatacacatttgatgggcgaatgaatgagtgagtttgagactgcttcccggtattgttgggtctgccaatttttcaggagaaatgagtaataaggatttttatataaaagctcgtaacttttttcaccttggcaactcatttgtattttaaaattgtgactcaaaaggatcatatgtgcaagccaaactgagtcactgagccaccgttttgtgactcctatattaaagtctatgttccaacgttattttaaaaggaaaatatttggtggcaaggaggaaagagcaagtacccaaatgcccatcctcaagtgaccttcttaagactgcagtgggatggtttcactcctcatttactaaaacactgcatctgaaggtttctacaagctagaattcattaacttcttttgttgcttttttgcagtggagggtgcaaactcgatacgagatcatcataatctacttttccatttttacaaagcttgtttagtttcattcaaatctccaatgtcctttctgtggttttttgcagtcttcatctatttgagatcccctaactgacagcatttgctttgacacatcacatgccatggaaaattacagcctggtgttgtagctgattgtgtcagcatgtatttgtgaataccataaagcactgaaatgagacatattgcactccctaatataggaggtaatttgttttttggacggcctgatatttgtgacattcattagtgagagatgcaataggaaatagaattacacaaatgggagtttcatgttatatttgctatctgggaggtatacgtgatatatggttctcctgtgctccccagcctcctgtacttggtgctgagatgctgtttcaagcttttgtgtctcacagtctggacaagggcacaagcttcttctccaggagacctgattggagcacagggagagggaaggttcagtcccattaatcctaatttcccttctcaggtgtacccagttctcaggatactcttgaacaaccgggagattctgtgaactgagtagggaggtatttttcccccacaactcaatcatggcaatctttccccaatttgcagaaataaatttaagttattagagcactcagtttaagaattctttttccttccaacagcccatgttttctttttcccaaaagcttctgtagccagtatggcttagtttgctagagtggatggggaggaagaggaccctaagtatccacggtcacatgtcatcgttctgtgctcagcgtatcaggcttaacctaggcaaataattaagagtgcaagctccaacttcctggctttattcctcactagcagtatggctttgggcaagttagttagccaagttgtgcctcagtttcctcatatgtaaagtgggaaagagtaatgctacctatctcatggggttgcgtgagagtttaacaagttttagatacagagaacctagtacctagaatagtgctggggtgtaataaaccctcctctgtaagaatgtggtagtattattaaatttggtagaaagagagtggattttagaaaaggaaagaccagttccactctgggctccaccacttacttatgtgcctcatggccttggacaaatcacttatctcgattttacagatgaggaaaccaaagctctgagtgtttgagaagacttaccttccagggttattttgaagagcagcaataaagaatgtagcacacctagaacaggcctggctttgactaggaactcattcaatgaagacaataggcttatataactaatgatagaccttcacaattaataatgtacttaaaatattttatgcaatattactgttgagctgaatgacctgtctgaacatttgcatcacattttctgctagtaaatttctccaagttcataagatagaatcaaatacaataatattccatgttgtgctgcaaagggccctgtgaattcctaggctgcttaaacaggtttaaggatacgaataaaaatgtcatgaaacatgtaggccagtgaaatcctgtgctgcacttacagtggcttaacaattgaagctgacaacttcagccacttacctaggaggccacaaatagaaatagagccagtttcatattccatctgaaattaatcccaaccttttgaaattctatttggcagggagagtagtagaaaactgataattctcaagtaaatttcccagataatattaagtaaagagcactagataaggagccagttgtcttgttatgttgttctgaatcatcaggaatcaggatgacctcgagcagtcattcagctctctgagcccccattttctccctcacaaaataaatgagcaggtaactaggcttcctagttctaaaattttattattctcattcaaagatgtggaattcactacatgaactggagtccgtggaagtttttcttacaccagttgatggccatagacatgttaaggagttttggggttatggaagcctgcctacttccgtgggtcaaggtgtctacagccgggccagaaagaaagccagttgaaaataaactcttaccttttaacttctttggcatcacttgcgatgaaaaatcctaaagtaccttcttggatcttaagatggtttccaggattaattaatatactgctcagtgaacaaaaacaaacagagaagatacatttgtgaggtcatgttctgaataaaaccttgaaggctacaccatactgttgtgtttatagggggcccactagtctaaagctttccccaaagattttgtccagagtccaatgtccactgccccatacatttagttggataatgccatcattaagcactactgcttacttcccaggctggcatgctcccagttgaggaaatcaaagcaaatcaaggtattagggcctgggtttatataatggagcagtctagctgccatcatgggcacatgatttgaagcaaagtccatcagaataaattccttttgaaactgctattggtggtcaacacggaagcattattggcctgatgaagctattgctacaacaattttccattaaatgacagagcattaatgggacccctatagatatacataaacatcatgtacacacaccacatattaccgcagggaatggtacaagacacccgtaaccaatgcggaagcaagctgaacgtcttcatgacattgataaggacatggaaattgattccatgtacagcctttataggaagaattggatttacccaaacagtttttttttttaagtcagcagttggatatacttaacaattccagtctgctgtttataaaaacgtacagggtgtttgaataagatgtgtgtctagcatgtcctaattgaggcaaattgagaaaacaaatgcaaacctccccttaaaaaaacttgccctgcagagaagtgggaacctaaatatacattgtcctatttcaaagtggcataaatagattagcggaccaagttgtgtttggactgacagaagagataaatgtatcctaatctaataaatggatgaaacaaacaagtttaattttctgcagatcaaaagcagaatacaagattgtctgatgcagagactgagaaaagacttcaggcttaatggatactgaattcagggattctgaataaaacaacagatacaacagaggtattccttgttctgaaaagatgttgcttaataaggtaatagatatttggaatcagtctaaaggaagttctcagctgccccaaacaatcaaaatatagaggatggtaattaacacataatcttttttcctactgataaaccattccagagaagtgttgtggtcatgaagtgatacgtctgtagtcatacaggaaggacccaggtgaacctttgttcacctggttgggagacctccgagcagatcattattgcaaaataattttttgtggtcacaagaacatctaccattacttataacaatacctgacaggaggaaactgtacttgtgtcatgactattattaacactcaataataccaaaaggctatgaagatttaactgttctgccctacaaccacaggcagcagtgagattcctcccaaatcagacagcagcagtccacactaatagcacggcctgcactgagcagcggctctccataagcacctcctaatgacccctccgccaactcttcacatgggtataacaagccctctgacttcatgcaatcacgagggtgaagtgttagagctcatacagtttagatgaatttatctttcaaagccaattcagtatgatgttttagaaaggcaggattataaattttgcacatttttttaacctcctttcctgcaaggcagtttttacatgccctggctctgcaatcagaatttgggtccaaattccaacactaccacttaatagctgtttgactttgggccagttactaaatatccctagaactcaactttcttacctacaagaggtggataatggtaacaataatctttagagaattaagagagatgatgtatagaaggctcaatgcatgtgggttattgttcctttttttaattcttgcaaaaaaaaatccaaagtgtatttcattttcaacaaagttatcacagattttctctagctgaccccatggaatataatacagtcttcttatcaaaataccttgcccattaatgagatgaaattatagggtaaagaactgtacgctacagaataatgtataaggacatacacaaaaaattccatgcactggctttgcaaatgcaggtaagcctcacacttctcatctgtaaaatgggtcctggctttgcaaatgcaggtaagcctcacacttctcatctgtaaaatgggtgaataatcgctagcttacaatgcctctaagagagttaaagtatgtactatgtgctacatgactgacacatagaaggtcttaaattcttagttgctactctcagtgagctaggtgattataaaactgagaggtaaaaaaatcctcacagcaccatcaccctccactttgtccctgctgctaataaatgacccaggaggtgccctattggcattgaaagacttttccactgactgcaaggaaatccaaagcattttatccctgcacaatatctggtgatgggctaatttagactgacttttgtctgcacagtgaagtatcctgtgttccttaaatctatggctgattgtgtaaggaatcgaaagcatctctaattacctcacagatcatgtggattccaggatgccctcttattccctgtgaacaggggtgagggggtttaaatcatccccatgtgaggtgtaaggcagaaccatttgcagatactaagctaaggctaaggcagccttctgggtgggaatctaaagaatggatccagtccttgaaataatgaaagaaagaaatctagatacataaagatgctcttggcgctgaagcaccagaaactacattactggtttttgtttttgtttttaatattttcgacattaagtcttctatacacattccaaatctagaaagtttaaataaaatgctaatccccgtcttcttcaaaatataaaaagacaaggattctggatagtgataaccttctcccccttttgcctactatctttagaattcgttattgaccttctaataggaacacataaatttttccaaggatctctgatctctttaggagagtatccaatgttaagtttgttttgttctactgactgccaaaagtctctctctctgtgcgccactctgaatcagttctctagctccaactttatataattcactagtttatcagagataaacttcaacatgtgtcatgtgaagaatcaggaaaatctctaagagaaaaagcccatatatccattaacagaattccaacaaggacatgttggcagaggtggactttccctcatttcaaggaacatataaattatcctttcttctttgaccttactggtttcaacagaaaacatccagtgacagctggaagcacggggctggtgtggtcccttgctgtctctgtttcttttgctctcagactagttttaagtctcgacttattctttgtttactcacctcctacatggagcaaatacgtattttctgtaaggaacccacagttgagtagaggggtacaaaacatgatcacattctatttacctttgagtttcctggagtagcaggcttagagccttgcacgcaacaggcacatttcaactatttgttgaatgaataaaaaaaataagtttttaaagcctcagttccataagttttcctttttttcacaaataagtggaaaggaggtcacagttttctttcaaagaacaagctacaattctcatcagtcaggccgattaaaggagtgaccacacctctgctagggctaggggattggccaatgatctagcaatctctcagatgtgttaagtatgaatatgtaaatatcccaatatgtaaacagcctgccacttgcaaagttggggcaattgatttcaacattgaaagcaaaacttcaaagagaaatatgggttcctagacataaaacacatctacgtgcaattggctagcggggctcagtcccgcagggaaatgcctctatcaggtccctccatgagaggagcaccgcgtctcaagttgtatcacatttcattgggtatctctcgctaaacactggtcaggttggaagactgcagcttgatggaggaaagtaatgcattcctttctccaccacttgtgcataactgggggacatctagttttgtcttcaatcattgtaaactttacttgtttcctgtttctgaagacaacctatgattcgtaattcaagtgaaacagatattgtttaaggaaacttctatccattatgggtaaatatgatacatatatatttctctcctctccctttcatttttggtaggtgtaatgtaccattcctcaggcaatttttaaaaaatagcatgacttatatgagaacatactttgtgcttgataacgtagtaattatatttgtgtctagcaagctaatgggacttcattaactaaagcaagcaaataagaaccatttagggtttccattcatgctatgcccagatgaatcatgccattgagaagaggcttctttgatcacacaagttcatatacaatgactctcagttggaactttgtttgaaccaatccgtgtcccctctcagagagtatgactgcatttgtagtttacaggctatgtgcaggcacagttcagagaaaccccacatctcaaatcttatcacctttctggaacttttcattttttctgggctttcaaatacatgctgctgctggagtcccacacaactagacacacacacttttactttaggataccattggagacacagttgtgtatttcatatgtcaatatacttaagcccagttcacttacacacagacagcatgataaagattgctcccagttggtcagactcaaatgactgccactgtggtccaccagagatactggtgaggacttactcagcctgcatccatctcagtaactttagaaatggcattttcaaatatatttcgtacatacaaaaaaatattagccatatgggatggggaacagagaggtgatctagaaaggataatgctggatatttggttctgggagcaagccaaatcattttctggtatacttaggacaagtcatgcctacatcacaacatgccttcaccacaagataaaaggactcaaaggccaaaagccaacagcagaggtgcaaccactgtggacctttaagatgcaaagtgttgcagtaacttcttgcagttggatcatatcaataataccaaactgacaggaagccacctctatttatacacatgtactcaaaaaaacaacagaagaatcagattttggaaaaagatacagacaaatacacacgcacagacacacacacacacacaattacaaacacaaacacatgacagtgattacaatcacagagaaaagtaacttgaaaagatgaacaagtaggcatctcaacagtatgttttcaacaatattgtcttagataacacattattgaaaagctatcctggaactattaacccaaaagtttttttttaaatgccattgatgatgatttagtcatgcttcatgcaatgtaaaacagcagcaaaacagggtgaaatcacatggtgaaaattgagaaacttcatattaagaaatatgcccaaacacactaggaaaaaaaagccatgagtctgtctcaataaacagtactaactctgtaaatcaagtgtgataatctggcaatttaatagcagtgttctaagactatactgagcactgcccaagaaataaaatattcaaaatgttatcaccaaaataaatgtaaggaaaaatagaagtgtaagggcttggtctctgttttgtggataaaaggacaggaattctgctctatagacaagaaactcgacacagggaggaggaggtcactgggaatgtggaagtggtatgtagacaaaatggcactagagtgcaatggacatcaagacacgtcaggacaatacagaaacagacacaaagggctggagagaagcatcctcctgttcaactttaatagtatttgttcccattattggtgccatgactgaaaacaggagtgtgcctttcctttcttaggtttcctgcaaagaagttagtgcgtcatccaaaagaaccaacaaatcaaacaggaacagaaataggctacttccaatttatgtactctagttggagaggggtgtgtgtgtatatatatatatatatatatatatatatatatatatatacacacacacatatataatatagatacaccagacaagggaatgagattatatatacatatatataatctctctcttcttgaattcttggcaaatggttagtcctgtggttaggagtgaagatagagggtggaggttggaagaaaagttaacgaagagtgcataccgctttcggcttctgcaaaacgacaagaaaagaatttaaaatcaaacaatttgataataaatcgactgacaccagaaggaaagaaggaataaaacctttgtttcaaatcacttgaaggatgcatgtgaaaacaaggttttttggcaaagcatgaaaacagtatcatggggtgaaaccaacaacaaaggcagttaaacacaggttaaagaaggtgggaaggagaaacaggtcctttgaattttcacacccagtcagttagaaaatgtgagagggaaagaagtgggacatgtttaaataaagaaaaacattaaaattattatctcagggaagattttaaaaaatgtgtgttttcacgtggatattgtgtttgataagtcctgtgttttctcagaggcatgatccacattccctcaaacacacctttttccacaagaaccaatgtgcttccacactgagaccaagccacatttgagaattaaagctggcaactgcacaaagaaagcccaaacaaagccaaacaagtcctttttgcccttttctgaagaaaaaaaaaatatatatatatatatatatactaaaaactatatctacaaatatggctttgttgaaaacatctcagaattgtgactcaattgaagggcctatccaagaaaagtttcatcttcagggagtgctctgagttagttttcttagaatagtgacattgagttcacaatgaaccattaacagcctttcgctctttttctctccttggaaccaaaaggcaacaagtgaaagacaactgctcaaggttcagggtgcaatctcctgcagtcagattattccagaatggtcgaaaaacactatgcagcatcagcatcacccacatcatgacatttttttttgaaagatgcacaaaagtaaatagagaacactgagttacacaaagatttgcgatttcgcaacacggggaatatcatttgcaaaaatccaggatacatacagttcccctacacaggtacaagtgagtattggcaaaaacatgggtaaacagtaaccccagaaaattccacctcatctgctgaacaactaataatcaggactgtcagtttttgcaaacaatattcttcactttgccaacatgaaaaagaaaatatttatctatctacatatttgttaactgctacagccatgttctacatatggccaccaaatctaccatttttttcttccttttggttgatttgggttttcaaaatagcttaacatttgatcagattgactttgtgagcaatctgatctggtagttaaggtaacagaaaacattggattgatctgtttacaatccagtgttttcttttcttttgttttgtcttgtcatagacacagactatacacttgaaagtctggctgtattgggttattcacccagataaggaaaactccttaaatgatgataaaaggaaacgtctagtcttcccctgtactctgctcagttattaaggtgtttgttggaggggatctgcactctacatttgggcatctgcaggatcaaaaatatgaactatagaggaatagactgtgggtgtcatttcagagaacaaaagcttgagcatttctcaatgagctctctttcttccaaaactattgacaagaactggggagcaaaaaaatcatctctattttatctgtaaggtgtacagtactccatcagcaaaatttcttgttagcacgatgcttcccacctccagtgtgaactcacatattgactgggatgttatctatttcaaccagacccagtccctcatcagtctgatttgcacataattaagtgtaaaataaataaataaagagagctcctgcctctgagctccactctcctggctcatttacatgaagctgatattctgccacctggattttggttgcaccgggagaagcacatatggtacacaataggctgcttgtaatttggctatcaagagagttggtgtctcccctcacagctctaccccaaggctgctgtaaaggaggccagagtccacctgcttttttgctcacagcagtaaaaaggggttttaagttctggtttaatacttagaaggtgaaaagtccaggtcggcatgatcaggtggagatattttgaggactcatccctcttccctggagaaacactctctgaatgcccagcagggctttgggtgccaggctggtctggcatagaagctgcagtgtctgatggggcatgcctcgaaatgtgctctagggtcagagaggttttacatctggttccatgcagataaataatgcacaagaaagcagaagtgaaccgaccgttctcagaacgcactctcaccatcaaaagtgtcagctggctgctgggtcaccgcaaacttaccggctctctcggttggcagacttgtactcaatggctatcattaggagcttgagcttcacaaaacacagcctgcaatgagatggagaagcctcccaatcagttcttctgaatgaccagagccacataacacacactattacgatctttcggtctcctaatgcagtcattaccgaggggatcctcattccaccggcactgtgccaaagggagggggtggaagcaacacctccccatcttccctattaaacctgatttcttgcaagtgataaggtgctggatgctcaaagtgcaaattgcactcaggtctggctgtctagacacagagcccaagcaggaatttgtgcctggggatttactctgggccagattcattagttactcggtcgggtagtaaaatgttaactacagggggagggaaagatttggaccagctggacctgttatttggattccgtttcggtcttttgtacaaatggctcatattgttgttccgagcagacccctgtgtgcttgcaatgatggtaataatacttggcctctgtgtaagtgcccagcacatgacgatggcattgtcactcctggctccatccaagctgtctcacctcatctgcttggtgctctcgactgcagagcagactgctttgaggctggcttgttcctgtttccatcccttcccttgtgcgttccccactctcgatcccttcttctctcttcccaacccatcctcacaggccacgtcaactctaatcttgcaagcagtgggtcttctccagctactgctaccctgtgattttctattctcaaaactctcccagcaccttgtctgtaaccaaatcactgagcctttagtcaattttacactggctgtggtcgctccctattgtttcatgtgtctgaactttgtctccttaaccagagcaacttccttaagagtcctggacttgtttggaattctccatagtgcatagtgaatagacccaccgatacagagaagctaaacaaacaaatggtttccacttactgggtttcaagtctaagaaaataacaaaaggtgcagtaaaatgtttatgcttaaagattttcagagtaagtgttatttatatggagtagaaaaatagaaaacaacctaaatgtccaataataaggccataaagtacagtgcaatatggtactagcattctaaatggcttttcaaagaatatttcaagatataagatcaataaataatatcatataaaaagacatgaacatgtaaatagaacaaatatataaaaatacatgaatatgtaaatggcacaatacagttagatgaacctatacacttacatacttacagaataaaagctcacataaacaaaataattacatacatgatgtatgacaagtgtctacaattagcattaccattttgaataatagaatattgattaactgatagactgaacaatgagttgatgcttatttatttagctccagcattgtaagggggataagatactgggtcacagtgtggggaaggcttccttgtgggtcaatttaatcccctcaatatccctaagaggaagctattaccccaattattcagacttctattgatagctccattttacacgtgatgaaaccaaggatcagaaagtccatgtaacatgcctaaggtctctagctaatacctggcaggataccctacatcttgatctccagtgaagcctattttgtattgggagagacagacaataagaaaatatacaagtgaataaacaataaattcctagatgatgacaagttctatgttgaaaataaaacaacctaagaatataaagagtaactcagaaggggtatatcatctgtgatggttcaggaggaccattctgaggatgcagggagcacaacagcatgatgagaagatatggggaaagagctttctaggaagtagaaacagcaagcacagaggccctgaggcagggaagagctctgagtgtttgaggatcagcaataaattcagtaagactgcagctgagtgagcaaagtcaagcgtgacagtgattaggtcaggaaatgaggggggagcaagatcatgaggtctttgctttccagagcaaggagtctacagcttattataagtggaattgggggattttagttggtttaaaagagaaaagtgacataatcagatgtgctggatagggggatgtgttgctttcaaggaaagtgctgctgaaggcctcatgctctccagggagtgaaaccaattgctcattcctacatgtgaggttgtggtccacagcactgccttcagcagacagtcagatgtcaaaggaccacttctatccaggcatatctgggatctcctggtgatttgcaggttttctgattcctgccagcagaatctaatgacctgggctttgtgctgattatgcagcttgctgaaacaccaacacacatatccaactacagctggaaaatgccatccttaatttatgtcccaaagagcactgctaacatgcaccctttatgggactgttacttctggagcttaaattgtttttttaaaaaataagatagcttatgcaatgtttattgaaccaaattaccaaattaagtaaccactttctaatgtaaatagtagctaaatacaaaaacatcagggagaaggctgatcttaaacttagtatggatcgtgcaaaggttaatttgctaatatcctatgagcaatgaccagtccactttgggactctggtagttcatgggatcaaagatcttcattgcttttataaacctaatcccgctggtaagaagggaagtaacagttcgtagtaatggtgaattatgtcttcctagctactacagtaccatctaccaactggatataaaaagaaaagagtttcctctacaagaaagtcctaaggtctatgtggccttgtattcattccttaaccttataggggatggacccgcagatctgagtcctcttccagttttaaatccataacttcaaaacattcaaatccatacccaagctgattctacaatgccttatagaagccccttttaaaaagtcctttgacccaaaacaagctgtggcccactggccaaaggaaaggagagggatagaatgatgtgaacagagagaacataggcaagccgtgccacaacacagattttcagactcaagcccttcaagattggctgatcttgcccttcctatgcagataacaaactgagcccaaacagaggagagcaactaggtcaaggtcaattgacttttatgtaaaaagccaaaagtggaaatcgagtctttgacgcaatgtgctgcacagatgcttctcatcagaagagaggaaatgaagtggcagtcacaagcccaacaggcagacacattctgtttggtaagtacagtgttttttaaaaaactgtaaatagatgccaacaagtgaattcacatagaaactggcttttcagctttccttgcaaaatcagatagggccacattggcaccacattccacatgctaaaagggagtgcagctgtgaagcacttatccctctggatgggatgtttgttctccaatgtgccacagttcccaccactctctattgtctcagatggcctcactcttcattctttcttgctaactgcctgaaccctataggtatctaagtttttaatccctactataataggtatcctctagatattgcaaaatacaaatcaagtataatacaccatgatttacactggaagcaagagctatggctccctctgtgagtgttcaaatcacacgtttctgttagatcctgccacagagagttggccaatgtcacaatcctgggcttaaggactgcatcctgttgcagagatgcagcctctgttggaggtgtccattggggaagagcagagcaaggtgaatgaacaggggagctggtgtggtaatcacttgtttgcttatctctcccctctagactgagtttttcctgtacaggatgcatgctttgcctcactggcattttgcaaagttcaaagagtaagccttcagtaaagtctggataaataaatgcatgtatgaatggggagtagaatctcatgactggctggagggatggagaaaagataaagtggcaaactaggaaagtctatgcagagaaagcttggaagtgagtatagaatcatgaaacaagctgcttcttagcttgtcttatttgttagaagcagacagatgggaaaggaaggatacagaaggaaataaaagtagtgatatgctctgggaatctaatttttgccttcaatccacaatgccaagatgcaagtccaattctaagatacaacaatttgtccttgggaccttctagagaccctcttatacccttatgtaccccttacactcccaagaatatatatactttcagtatacccagaactgatgttctctggttaaacatttacttgcatcactcaacaccattttttggtaaagaagaatgagcattagccatctaatccttattctaattctgcctttactcaacttacagtgtttcaacatatacagaattggtgtgaaatcaggaagcagggtgaggtgaggtaaggggaaaaaaggaagtaagaaagccttcacaatgtgataaatgggataaaatcagccataagctagcaataatttaattattggtttctaaaataaaatgccccagtatgtccaacgcaggaagttgttgctggttgcaaaaataattacaggggaatagaaatgacttcttttttcaagaaaaaaaatgccacttgtcacaaaaaggtcttaagccagcaatctgcaataaaactgttataataacaagttagattgctttcttgataattattaggtaaaggtctaccaaatttgacaacgacattatacaaagcccaaccccccttttttttttttactgccaacatcatctgttaactacagtagtttcaacccagatgttcctgaacaaaggctcttaagaattagagtccaactgtttctgcctacccagagggaaatacattgttcctgccattaaatcagccccctttactggaaacattacttgctggtgttaattaaacatggaaacctgtcatagagtttgcaccttcaggaagaaaatacaaagaggaggtttggggctgttgaagaggactcaccccacaagtcaggtgagggaggatgaaagaagcaactgtcatcattccccctgaacccaaccccacccaaagcaccagcccctcttcagctatccagagggcccctgggaatgtcaggttggcacatgcaattgaagtagatacggatacaaacactgcacattgggaaacaaggtcttctggatcgaggggctggaatggaaaagattcacattcaggagctttaatttaaaatgacagccgctagaaatcgaaatatccaggtaaagaaactttgaaacatccggatttccaagactcagcaccaagaaaagagaagtgatttaaaatgttcatggaaatgttaagactctttttctctatgaagctttgataggagtggagtgggaaggtttcagaatatccccaccctctctcccactctcttattctctccttctctctctctctttcacacacacacacaaacacactcacacacacacaatctccactagcacacctaagacactagaatttataaatacattacttgatacagacaattaacttttgcctaaagtgtgaacaactgcatttttagagagccttgctattattattaatgagaaacataatatgaaagaaaaaaccatgtgtttgctacaagaacccagtgttgagtcaaagcccaagcgtccaccccatttccaacaggactccttccctgacccttctgtagagaattctggacccaccactgcctcagtagcctgttattgaggatttcaatagactttagggtcaacggtttattcactagctcatagaaggtcacctcttgggtctctgtagtagaaataaccaccaatactgtattcacatctctattcatatatgttcaaccctaattacaatactccccaatcaagtggatgaatagagccagttctgtgaggggaaaatattttttaaaaaatgagatctgccaggtgcggtggctcacgcctgtaatcccagcactttgggaggccaaggtgggtggatcgcctgagctcaggagttcaagaccacccagggcaacatggtgaaaccccgtatctactaaaaatacaaaaaaattaaccggttgtggtggcacacgtctctagtcccagctacttgggaggctgaggcaggagaatctcttgagccccagaggacaaggttgccgtgagctaagatcacaccactgcactcgagcttgggctacagagtgagactccatctcaaaaaaaaaaaaaaaaaaagagagagatctgagcctctccataaattcacttaaaatgctcatttttgcagccaggctaaagaaatctatcatataacaattgggtctgcctggtttctgctccatgttcaaatttggatgtctttctccaaaaactaatgatttcacagaactgaagttaaactagctacagttttcactgggcaagaggcccagctttcgccgggcggtcttaaattttaaatttccccaagcggcttctttttaaagatctgtctgtgcaaaataacacaggttgagagcatgattttctgaatttaggaggggagcactgaatgcagggaggtagaggagggaaaagagaatccccctgcactcttaaaccagcacagtagcatccatacttgcccctgggcttggggacagaactcctgcccttcagcacagctgaggaagatctgattggagttccccaagttccccaggcattaaatactccacatcaaacctgaattttaactgctccatcagctgcagagggacagagagagacacataccatattttaaatacatcttttgtcctaatcccctctgagctgtaaaacctgatacaattaagcttttatattttgcaaatgatgaatgactgactaataggttcccggtgagattcagaacctagaacacagtgttcttgaggcagcccaactgctgaacccatggtttcctgcagctcctccttgtccagcccctcccctcccctctgccctccctgggggtaggggagtgcaccctcgctttcgcaagtgctcaccaaaaacactgttatcagtttcccccaaaaaaatcacaagtcaaaataaatctgatgcatctctttgtctcatctaaagaggaaagcaatttgctgtaactggaaaatctcggagacctaggtgttgagagagctccctatggtaccaggtggcgcagcctccagattccctaccacttagaatgtcctcttccttctttatcccccatctgaatcaaaactcccgacaagacacagctcaaatgtcatctcttccaggaagaacccccatgtccccccagcctacagggagatgtccctataactctcagcatctctattccagctgtgtgcatctaccacagcacttatcagtgggtgtctagatctctctgacgatgggtactatttcccttagccagacagtaaactctggaggcagccaccctagggaaactgaatattttacttggcatttgttggcatttgtaagtattgctattaatcttttcatgcacatatatttgatcaaatctagtagcagtttcctctagaagtggcaccaagcttggcacaatggtgcacatatcccaattcattaaatatctgattaatcggtgattaaccgataagagaatttcctaaaggttaaaagtaaatataacttggatacacatatagctcgcaatgtgtttctttctttctaagtgcttctattatattcaatgagaaagataaaggtagaaggaaaaggagaggagggagaggggaaaagacattaacccgtactgacagataagtcatagcactcctatttcagagaaggagattggagtaagcatctgtgatggttaatattgagtgtcaacttgattggactgaaggatacaaagtattgttcctgggtgtatctgtgagggtgttaccaaaggagattaacatttgagtctgtggactgggagaagtagatccaccctcactctggatgggcacaatctaatcagcggccagcatggctaggataatgcaggcagaagaaagtggaaggactagacttgtgaagtcttccagccttcatctttctcctgcgctggatgcttcctgcccttgaacatcacactccaagttcctcagcttttggactcttggacttacaccagtgatttgccaggggctcttgggcctttggccacagactgaaggctacactgagaatctcttggcttgaaattgatagagatagctttcggggtggcaggaccttctgcccccactgcctcttttgctctccttcctgttctcttgggaaacaatctcaaatttcacccctacatcctgctcccatatcttttcatagaatgactcccctagcttctgagaaaactccaagctctcccaatcccaccctgcaagggagcattttgccagcctagagaaaaagcacatttatttctttccatgctttaagatgttattggctgcatattgttttagcgcagcgcataattacagaaactgctctgaaaatctgtatattttatctgtgctttatgatacccagaatattccccaattctttttcttcttcgtgaaccagcttaaaatatattttggcatcctttatgtcattttgaaattgaatagccaattcttactgtaatgaaaatacttatgtgccagcccagtgatatacaacactacactctaattacggctgtgctttaattaacctgaattgaagagtgttatcattaaactgctggtaactttgagttatggcttttctttaatttaaagtagaaaacacagataattaagcctccagataatcaaatgcttgaggagagcttcaatgttttgggatgttcctaaatctcattaaatgtccttcttttattgatcatttctacctctgctgtatcattgtattaaacgaataatagcactaagttgtacacattctcactcacatcagaagtggaatatatatatattccagaaactttactgagcaaatactaaattatctgacaacaatttgtctccttcttgggacatgttctaaatacaaaaatcaatcaaagggaatattcacagagccactagtgccagctcttgagctggctgaaggccagtgaagttccacaccacccagtgggtcagggttggcaaactcacacaaccacagggccaggcctgggatttatgtgcaaatctggcctggtttaagatatcagggaggagtaactacatgactatactaacccctttgctacatcaaactggagccagttagcattctgaggaaatgcaggtcttgcattgtcacattagattttctaaagaatccagaaatctagtttttacgtgacatactactatttggaaatatcagcaactagttgatatctacgtgagtcaaacatacctagtgactatcccagttagagcctgtagggggagcagtcctgacccttcaagttacccataagaggaacggactcagttcccaagagcagagtaagagaagggtggaaaagcaagaagggcctgggggttggggagggagcactcttgttagatacaaacaccagttaggccagggaaaccctacagccaaggaagggggcttgacggagcccctgctgacaccctcaccaacataagactcccgcaggcgctggcagctctgctatgtgctcagaccaccaccacattagacagccaaggcttcaattgcctttttataaaactagcttctgttaaaaagcctgctttcccccggggctttgtatcctaggcagaccaagctccagggagggggagatcccctgggacagcctcagtgttccaggacccaatgcctctgaatgcttaactcctctcagtggcaggaagagaaatagctctcaaagaaaggcacacatgggagtcacaatagggcatccattttcagaaaataactccttccgaatcaattacctattcacttttccagtccatttagcattaaaactttcgcttagagacagggtgagaaatttcagtaaacagccaaaccattttggattgcttagggtctgggcccagggactgacagagtgcacctgctgtgttcagtgacaggaggctccaggtaaacacgaagccaccaagcgctccgcctccctccctcctgcatacagaaagaaaaccgtgatacagaggaggccaagggcacccaggactgtcccctcctttgtggtaaagcctgatcagttttgtttcgatgtcttcagacctctcttttggtttgtatgtaggcaggaagtgcaagcaaatggcttttcttcctcagcccagtgagctcccagatacccctgtttcttcccagtgagaagaatccttgtcaaatcctttgctaaggtgtcaggagaataggcttaatgtttcaccaacctcagggagtttgtgttttcagagggcacaaagaccccgttcatcttaaactcaacatctgagattttttattattattattttagagatacaatcactgctatccaggctggaatgcagttgcgtaatcaacctcctgggcagcctcaacctcctgggctcaagcaatccttctaccccagcctctagagtagctaggaccatacgtgtgtgccaccacactcggctaattttccttattttttgtagagataaagtctcactgtgttgcccaggctagtcttgaatgcctagcctcaagtgatcctctcacctcagcttctaaaagtggtgggattgcaaacatgaggattctaagtgaggaatctgaggcactgtcatgcctcacggcagacacctggagctcttgaggtcatcccccataggtgaccatctattctacctgcagtggccatggcgggtggctttgatccatcctgctgagccagtggaaagagaagctaagacttgttattattataacatggcagttgtctatgtgggggctcaaggcctccttctgtatatttggttccacatttcctcagcaaagggtgaaaacactttgaatggctttatttcagtagcttctctgttgtctctatgatcagacttgatgggaagacagattaaaattcctttcattgaggggctggcaagatttgttttgccctcttagaatcagacaggcaggggtttatgccactcttcataaatgtgtctacatcacagaaggcatgcaggataactgtagttcataagttagcataaatgatgaattcaagtccaagactctcaggcctgtcaagaaaagtggggccagtggaaattccccaggcagaggccatgtaatgacccaccctcctattcatcacatggggccgagcacacgggataccctcggcaattgtcaagtgctccaactgtacccagcagaggtgggaggcttccttgcaaggggcacattcaatatccctgaaagccaaagagcatccagttaaaggtcacttactcacaaacagtagggaaggacagacccacgaaggcactggagagatattctgtgtacatttcatttgagactccttccaagtagtatttctgccatgtgtcttcctcaatctaaaggaaaggaacacatgcggagagtttaaaatatgacggtgggctgtaaaagggaaacctgagttacactcttaggcaaacaaatgaatgcactggttagataatggtgaccttttcagcaatcaggaacacggcctctgcacccatataaagccttcaataaccctaaactcataaagtgtgtgccctctaaaacacttttttaacctgtgtgatttctttcctttttcttttttctttttctttttttttttttttttttttttgagacagggtcttactgttgcctgggctggagtgcagtgggtcatagctcactgaagccttggacacctgcactgaagcaatcctcctgcctcagcctctggagtagctgggactataggtgtgcatcaccacacctggcaatttttttttttttaagagacagagtcttgctatgttgcccaggcttgtcttgaactcccggcctcaagtgatcctcctgctgctgcctctcaaagtcctgggattacaggtgtgagccaccgtgcacagtctttaatctgtatgacttctaatggtgcggagacatgggcactcacccacattagtgggcaaggaaattgatacaactgttttgaagagcaattttgcaattattatcaaaatttgtaaaagtacacagtcttttacactacaattccatttgaagtattcatagcaaagaaacaggaaaacagaggtaaaaaaatatacaagaacatcctttctattcatgaaaaatgggaaataaccgtaaatggcacacatacaatggaatactaagaagcaattaaaaattataatgaaaatgtatacctgttcatacagaaattctgtaaaaaggcacattataaaatagtgtacataatctgatcctatttttttagatggcctatagttatctgaatgtttgtaaagccataaaaagaatttaggaagctttatatcaaaacactaacagttgttacctctgagtggtagaatgatactttttttcctctatagattcctgtattgtctgaaggcttttataataagcatgtatatattataatgaaacagtatatttctactttgcacaaaatgacagatttttctgaccccccaaggaatatcacaaaaggtaaaatgttagtttcagagatgtcttgctccaaatttcaaaaggagtatcacaaaagtaaaatgtagtttcagagaggtcttgctccaaatttcattaaaatatgcattttttctaagtagtcaagtttagctggttttcccagcaaccctcttcatgctaggcatctctgaaaggatttcacaatgtagtgaatcttcttttttgtttttttgagacagtcttgctctgtcacccaggctggagtacagtggtgggatctcagctcactgcaatctctgccccctgggttcaagagattctattgcctcagcctcctgagtagctggaattgcaggtgtgcaccaccatgcctggctaattctttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccctaattcttgtatttttggtagagacagggtttcaccatgttggccagactgatctcaaactcctgacctcaagtgatctgcctgcctcggcctcccaaaatgctcccaaaatacaggcatgagccactgctaccggcttacaatggagtcagtctttagaaactggtgaattacaaggagaacgttgagccgctatgggagcttagggatctcacaggcctccctgagggaaggagggcaagctgtgtgtctttggctgcagcctctcaggcttcccttccagtgggggcatgggtaagaggaagatgagaggaagccaccccgccaacaggaagtggctctttagaacggcttgtgcttatcttgtattaaaaggcatcttgctggcagccagtcagtcagttcactgggagaaatgcaacatgtggaccagaaggagagctaggaacagtgggcaagggcacacctaccatctacttggtgacactccagcatacaaaagccagaaaaaatttagaaataaactgaaggctccctggctctgtgctctttgtctgcttttagctcagtctgggcaattagattatgtaggttaacctcattagtttgagctgcttccagcctactcccacaggttagacattagctaggcagtgctgctgggtatgagcagtttatctacaaattggccttccccagagtggggtctttaaaaaaaaaagtcactcaaccaattctattgctaaatggtatgattttaaaaattaactgcaatgtgtttagctaagcctgaactttttaatttctccaaaccataagatctcaataatttttttcgaataaaagatatgcttgacttataagcaaaggtcactaactctaactaatttgaagaaagcctaatctgccttagtaaaaaaatgttggaatatagaatatttgggaaacagtattaacataatttgttttattaatgaataggatactatatgaggtatcactaattacaaatccccatactagagccttatgggcaaatagtattcctgaagtaaaataattcagcctattcttttcatatgtgttcttttataatgtgttgtttatggtctaatttaaatacaacaactgattatcaaaaataatgaaaatacaaacctttattattgatcattggtggtattcctcaattaatatggttttaacaaggttcttttagttttggtcagaattttcatgcctttatgtcctaatgaagctattctttataccaaattttattgtaggtgaatcactaaactttttaaataagaaggaacacattttttgtaggataacaatattattcatgtttgttttgaatttagcaaaaattgttttattgagtcattcattcagcaaatattgactgcatatatttttaatcttaggatctgttctagcttctgattaaatcaaaactggtatttacttccccatatttttctctttgctagagaaagcaccagatgtatctgactatgatatacctgaccacatatatctgacttttactgatttttccatatcttttttcctgcaagtttgcctctgtggctaatcaaaatgcttgaggactgaaagtcgtataactggaaaaaagtacagaatgttctagaaaacaaaatgcctcttccacatccttgtgtagacctgcggatagtctctacacactagacctagtagcatcgaatcaactgaataaatgctggagcatttaaatccgttgccattgccatctgtttaagatttccacatctttaacactatttccatatggatagtcaatatgtttttgaggtttctggtaaaggaatttcactttaaaaagagtctaaaattgctaattgaattacactgtcatattctcaagcaatgtatgtagttggtgggaatgtaaagtggcacagccactgtggaaaacagtatggtggttcctcaaaaaattaaacatagaattaccattggattcataattccacttctaggcatatatccaaaggaactggaagaaggatctcaaagagatatttgtacactcatgctcacagcagcattagtcataatatctaagaggtggaagcaccccaagtgtccatggacagatgactagataaacaaagtgtggtaatttacaatggaatattattcagtcttaaaaaagaagaaaactctgacacatgctacaacatggatgacccttgaaggcattacgctaattgaaataacccaatcaaaaaaggacaaccgtgttatgattccacttatatgaggtacctagagtcctcaaatgcatagaaacagaaagtaggaaggtggctgccaggggttgcagggagagggaatgaggagtcatcgtttaactgagacagtgtccgttttgcaagataaaaagagttccggaagtggatggtagtgatggtcacacagtcatgtgaatgttccactgaactacatgcttaaaaatgattaagatagtaaattttgtatgtgtattttatcacaattaaaaagatttttaaaacccttatgtataacataagagcaggagaatcagtaattataattaatactgagaccatttaatccttaagtcatgccagaacaaggacacgaataggccaatcacatcagacaagtcaggagtgagaacccagagtcattacatcatagtgcatcacaaactcagcaacagaacttcagtctttatacctacccaagggctgaaattatcaccttctatcaaggtaacttttctaagtctcgagtgtggtatctttgacttactttggaaaagcaaaaacaaaagtgtacatttctcatacaatgcattcttaggacagaaaaaaaaaacagtgtaaaatacattgaatttaaatccttagccacacctgtatcccagcactttggaagctgaggcaggaagtttgaggctagatatttgagaccagcctgggcaacacagcaagaccctgtctctacaaaaaattaaaaaatttgccaagtgtggtagcacacccctgtagtgccagctactcaggaggctgaggcaggaggatagcttgagcacaggagttcaaggctgcagtgagctatgactgcgccactgcactccagcatgggcaacagagagagatcctgtctctaaaataaataaataaaaccttgtgtttaatactaagaaaatgaaagtgaacaaagaaatctggaccaggtaaagggagttattgtcattatgaattccccttttatagatgataaaactgaggcacagagaggttaagaaacctgctgacagtcacaaagtgaatccgtggtacaaacaggattcagagttcacactcttaaccacccaccacaaagatagaggtgtagggaggttgtggtgttaggatttcggggaatggggaggatttgctgtgtacaagtaccaaagagggaaatatcaaaaccgaagcccatcaaggactcaaaagcccaaactctgtagcctatgactttacgagacgtctagcaaggagtaataatccattttggctctagctgaaagggcggttcaagcctcctctcagagcataaaagtatggtttctattatacaaaatggaaacttcctagcctacaacttctttcctaaaatagtacatgctgttccccacatttgtgttgtcaatgtatttttaactgtaatgtgaagacacacttctcagcagaaaaaaatgaaggaatgggaccaaaatgacttagggaaaggtgccagaattaatttgccagccattcagcaatcagtcaaaggcagagcatttcctgaggcagcaatttatcctttggctgtcacatcaaaccccagctgttttagaagagcgcctagcaaagatgagcagatgatgctctgtgggtccttattcatcaaatacacacgggatcatcagtgagaacaggggactgagccaatgaactagcttgcctacacctctcatttactgtcttatttatctactcttcattatctaatttttcatccagtctagttgaacctcccaagcaaatggtttcacaccaatccacgggcagacagctcccccatcaaatgtaccttccaactggaaacctcagccttggctccacgggaagtcacaccttcctgatcccaggttctgtgtgtgtcactaatggtgggttggtaatgatgccttttattttttatgcttcctctgattagagtgaaactgtgtttctctaatgctaacagcccagtgaatgtgaaaaattcaactctcctggctgggagtatgttacagccatcatgatttctgttcccagtaaaaagtctgaataactgtgttgattacagccaaataatcttgcaaaagtccacctctacccgtgaagtcatgtaaataattccaaagattgtcatatactagtccttatttaattgaaaacaggcaaattcttttaatccaaatatacattatattatgcacatcaaaaataaagcactaaaaggaaattataaaaaccaatgaccattatgttaatagctgcaataagaagagatgagtcgtaacatatacacactaacactgcccaaaacaggtagtagaaggttagtgtattcacaagaacttactacatttactatttttaaaaagtctatctgaattttcagtaaatattcttcctataaaggatccacagttttaaatcttagaagtgcttaataagaattagagacatttgaatgaatatttatatatatcaattatgcaatacattgtcactgtcctttataataagattgtctgaaacagaatgcagtcatatgaactgactggcatatcttagatgccattaaaacgtatttatcatgaccccacaccccccaagaaaaccccacaaaatgtgtcaagtccttgcctacaatactaaacatgaaatcagaattgatgggctctaagttgatgaatgtttgggctggttactaaaatggatggggggtcatttgtatccattcctcaacagcatgctctgtcaaggggaaaagtttaattgaatcttgcgttttctcatttcttgctgaaaagtacgatgttaaggccagcaaggtattaagaagacttcatcatgggacttgtcagattctctcctcctctatttccctctatgttccaatgtcaacaaacttgccccagtttttatcaaagggcatgtggttatctccttctctaccccttcttagcctcttcgttcttcagtataattgcaaatcctaaaagcaattcatagaataaacaaaatgaaatgtttgagtcttgttagctgaggtccaaatggtgccagcacagagaatgcctcactgcacagctttctggggtggagttaactagtgatcaagttgaagccaaaggaagaaagcagaagagaatagtgatttgcaccttttcagaatgtatttcttctctgtgccaaactgcatctcagcgctgaacttcttggatgtggactcagttcagctgcctttctgaaagttgcttggatttcagggactccataacaatttggcattccacaattatggcctctttcagagagcattttccagaatgtgtgactaggacaaaaagatctcagatttttccaaaggcttcaggacaatgtcaattaaaacaattttggggggatttgatggaatgccagaaaactggttgcttcagccatgaacaaataaataaacaactccaaatattaatttcggaatggacttgagccaaatctcttactcccagaccagtgggctgcagactatcaaatgagatttcttccatcaggcattatgaaaaagaatcaacccacacgaggtgttcagagggcgattaaaagactacaccacatgtaaaagtaccagaatacatggtattttccctcactccattatcccaaccaggtttatttctggaaagacagagtgccagaggaactgaaggtaaaggaagggtaaacagcaagagtgatatgagaactttttaaaataataattgagaaattattttttaaagtgttacatatgtggcaggaaactggtctttttttttttttttttaacacatagaaggttttgccaccctatcctcaattttctctccaatatagaaaaggtgtttacacttaagagccttttttaaagattggcctattcactctctgttcagagaggaatttggttttgcaaccttgctaatagtaaagaacatatttacatgtccttcaaataataaggattcttaaaaataccactgaaaataattcttatttgggtaaattgagcaggaagtaaatgttttcagtcagacgtctgccaaaccaaccccagaatagttcagcttcgtatgcagggttttcaggacagcccttcttaccccatctgaggtgagggaccagggtttagcttttatttctaatatccattcttttgcaaaatctaataaaaatgaattacaggccaggcactggctcacgcctgtaatcccagcaatttgagaggccaaggcaggaggatcgtttgagcccaggagtactagacctgtctggacaacatgatgagacaataaataaataaataaataaataagaattacaaaaaaatgaaaagacaaatccaatgcaaggtacaaatccaaaatttttatcatagattcacaatccatataaaattaatccatccaattgctttgaaagtttctaagcacttactctcatcttctgtacttaactcgtcacggatgagtatcaaacagctcacagtccccatctatggaccatggaccacacttggaattgtgctggtccacaacatggcaccactctgtcttaaaaatctgacttcccataatttcccctgcttcagaaaagcagaattgttctcaactaatacttcacagaaagaacttgacaaaacttaatagcaggtgttatctgaaacaaaggagaatggggaggggattctgtggtggcccctactagaatgtgggaaatgttgaaggcacagatttttacctgaatctccactgcctggaactgtgcgtggtacatagtcatagctcaataatagtttctgaatgaatgaaataaacttgggaagcacagaatttaacaaagccaacttgttttatttaattttattattttactttcagcacaatactccttagagtatttaacatgttaagaggaattgtaaatctccaagaggagaacatgacttttttgtttttttgagatggagtctcgctctgtcacccaggctggagtgcagtggtgcaatcttggctcactgcaagctccccctcgcgggttcatgccattctcccacctcagcctcctgactagctgggactacaagcgcctgccaccacgcccggttaattttgtttttgtatttttagtagagatggggtttcactgtgttagccaagatggtctcgatctcctgacctggagatccacccgcctcggcctcccaaagtgctgagattacagacgtgagccaccgcgcccggccagaacgtgatatttagtcacagaatcctttatttcaaggagcagcttaagaagatgggaaatgctaatctaaaaacttcctctcctgacttcccaccctgaaatctctgtttcccttgacgcttctatcacaaatatgtctctctatgacctttttcagttgtcaaaatccagtgcttcctgtaactttcaagtcataaactacctcctctctgaggcctttcctcatttcaccaatgtgctgtgctgtccctgccttaatgggaatagtaactgcacacatctctcaggaggccatgtgggctgaatgagatgatcagtacagaatgtctagaacagtacctggtacttagtaagtgctccatgtgtggtgattagcattaagtaccatcacagcatttgacttctctgacatctgaagagaactacaatgaggtggaattccatttccgtatcgactgtaagctccttaaaggaagagctgtcttactcagctctgtatcttctagaaggagcagcacagtactttgcaaataagaggtgctgggttaatatctgctgagttgaactaagcaagataaaactggagagagaggcctaaagaaacaagaacaatttttctaggcatctgatcataagtaagcatgaataacttcaataacttcatagcgtttagtgttggggcatgaaataaatcaattctgcttctgagcatggaaaaaatttctgcactgttaggatctaccagggagtatgtataactgggtcatttttacacttcccaaaaaacttcttactatgagcaatattttctgggaaatttttcattacagaacatcttgggcttcttagcaactgacttacggttttctaaattctaaatccgataacttggaggcttgaatttgaaagacaaaactctcaagaactgatatattgccaccaatctaactggagttattcctactagctagaagtcctgcctgcattcctctgggagaggaagccccgtccctccccatctcatgcctattctatcttccccatgtgactcagccctccttgtcttctccttgtcttcattttttggattccaaagtaaagtcaaacaacaattcaacaggaagtagactgagcccagggaaggtgatatttggcaagttcattattcctaaattctaaaattgaggccaaaacaacttgatcttttctaaaaaaaaaaaataaaaaaacaaaaaaacaaaaaaaaaactgggagaagaggaagggagttagaaagaacatttgaatccacataggaatggggagcttgcttttgataacacaaaaaactagagagttgcctgtgcctttgaaggatctttactattttagacagtttggtgagaatcccaccagccactgctgttagcaaatgacaaggtctcaccagtggatgtgtctgagggcttacttagtaaaagtcctttgaaatatggagtccagtgctatctatactttgatatgcacgtatgtcacccaagtgtcttggcaaaatccagtttctcatgccttagtcctgaggtggggtcaagtctatgagtctgcatttctaacaagctcgcagatgacactgatgcttcccctatagggcccacattttgagtagcaaggagctgttcccaaagacggtgaagaataaggggcaagtattctccatgatgccttgaggacaagagattcagaagaatcgattacagcctaaaggatttgaaccagagatgaaaaagaatgctttccatgaagtattgctagatattggagccagttacagagaaagcttttagacaattaagcacaagatgggtatccaagtgtttgggctgttgtgataattagcctaaacaatatttcaggggtccagatttatctacttagtctctctccattgattcagtgaccccagtaatagctgaatctccattggaatgtgggttgtgtagatacagaagcaatatcatgactatattgaattcaattaaaaataaagtttcagaaaatggccctgatttgcatccctaatttctattcaactttcccattttaggacacagtattgagtgtgaggacgaaaacgctcgccaacccagtcctgttttagtgacagcagattctgggtacttatgtctcctatcgccatacaatatggcctaataaagtcgcgccaaagagactagatttcatttcagagcaaagggttcagtcgtaaactttagctttctggctgaacagagccattccagccgcaagcataaattctgctagttttaggtatcagagtgattgggaagccaaatgggttatttgtgagcctggtagcaaaggcagaagcgccagctttattgtgtattcattgttatctggacaatctcttgtcagttagagaatattttcacaggaagttagaagcgatttcagaaattcccctctgcagtttctcagagtggatgttaggcctcatcaaaaagacatttggttcagagattgaaagtgggcagcctataaattgctgaggtatttagctgggcttagcagttttcctttgaggaggaaaccatgatcctgagtgctcactgagtacagcagggaagtgcctaagttcacgcagcctctggcttcaaaaaatcccagccttatcatgtgctcctgagccaaggagcataacctctccaagccttaattcccttcacctgcaaaatgagagcaacactagtacctacctcctagggaggcagctgaaatgaggtggtgcatgtaaagtgcttagcagggtgcctggcaaatagctaacatttgtggagtactttctatgcaacagatgagcatgtgttctaaccatactaagagatggcatttattgagtttgtaccttgtagacagtctatacatgtcagctgtcattataagtaatgagtgatagtgatagtgatgatgctgatgatgctgatgatagacaagatagctctactgctcagacaaaggaactatgccaattagatgtggggcctgtgattcatggcttcctattgcttagctgctgctagaaaaggctggaacatcagtgatcatacagtggttctctgaattgaagagaaacattaagcagcctgagtttgtccccaaaagacagcaatattctctggaggtcctctctgccacccatggactttcctaacggccagtaagttaactctgggtagatatgatgataagggagaagttgatattttgaggggacatgatggtctcccaaaatagaaaatggatcatgtgtgggtagcaccattaacatgatgcaggatcacccagcctggctttctgaaaggagccctgggcaaacaggaccctgatgaccagaatgacacttgcccacatctctcagttagtactccccacacactattcgtacctgtcgttctccttcctatcaaatggctttgctactcacttccagccttgcctccacgactgattttgaatggatacctagcatatccttggtccacaggatgagtgtgcaaaaaaaaaaaaagggtacttattcaaaatattctttttaaaaatacttgtccagcttgtatttggaggacagacagagcagtagatggggtgatagagagaggaatgatccctggtcagagtcttcagctactgaccctagtaattcaatcttgagcccaattttgcatactcagcaaaagaaaagttttgcagtcaagcagacccatgctttttagaaagcaagttataaaatatctgtcattacttgaacatgccatttgggaggaggagactcatccctcctagccgaaaaaccgtatcaaagtattcccccaaataccttattaaagtattcaaagtaatctcaaactttctgcctcctgagaagagttctgggaagcacacttttctatttcttgttgcatttctagaatgttttaccactcattgtagttcagcatccccagaaaactgacaggcaggccatcaccctgcagttggtataagatggaaagagggagaggacttgctatgatcctgtttgggcaaagagacccctccctgtccccatgctcacctgtcccatgagcaagttcaagtcaataatacatgtctatccactgaggtaactcattgcagcacacagctgttctccttgcagtcaacaccagtgcagagctctccctgggcaaagctgcacttgctggatgggttttcattaacatatgggaaagaatagtcagcaaatcttcactgttgcagaggactgggaaaaaccagacagatgcacctagttctcacctatccatgcagacaaaatcatctagccttagggagtggagggtgaattgccagagacgctgaaggggttgggaaaaccagtgtcatttaggttgatgaacaatgctgctgccctaaaaaatgtattcagtcagaaaattctgctgactccgtatctcaccacaaagagctccagggaccttccccgacatcagtcatttacaaaagtgttggcaacacaaaattgtaagcactgtaggtagggatgcctttatgccaccttagagggtggttttatatcaggattattcctctatcttctcccatcagtgatccagttctgacccagtctcaaatctcatcacaaatagaaagccaaacagcacctacctccatctcttaagaaagttgaaggagagaatttatagactgaggggtaggtgctttcatatacggataatctttcaaaaataccataagctcttccattttttttacagcaggtaaatagggagctaagagaggttcagtagccttccccaggtcttacagcaaatcgcgtcctaatcagagtcttataatccttgccctgtcccatcctgctgcccactgcacagccgcacaacccccctcacacttcacaaaccagggataacaggaagggtgagggctgtggtagcaattttggataatatagtggtccatgggtacttatagcagggaaatactatctgagatcttcagatgatcaaaattgaatcctagttagactggaatacccaatcccattctgaaggggaatcaaatattcctctttcagttgttcttgcctctctagcctatttaaggagaaagagaaaaaaaatactcaaccacagatagaaatgtccttctcattgccaaattttagccaaaacaagaaatcaacagaagcttcttaagaaactatacctatttgtcccagtctagaaaaaggagaaaggatagaatccatcaccctaaaaagcaatgccacaggtatgggggccaggaataaacagacttccacagccagactgacaacaaagagcttctgcacaccagcatcagtgggcacagagatatatgttacttctcagtgggcagagataccctatctacttacagggtatggaaaaaagagaggaagtgatgactcttattcatagatattaattagttacatccacttcccatcctccagtgtatacagagtacagccatcaagacaggacccctgtatttctccgaacatgaaaccctaatcactgggactgcatcactcgttaccatgaaatacatgtggcagttaatgataaaaaccacaaaaattacactcagttcaaacgttttattgcatgccattcttcaagatggcagatggctgcctaaattgatctcagtgtcatgttacaggtgcccctaagtttctctaaatcagccaaatgagtttgaagttgaaacggccacctcacattgttctaccaggagacgcacaggatgccactgtaatgcagtttgctgaattatagtattcataggctctgattaaaaaaaaaataggtgaactacctgaaacttgccccacagagaatgattattgaatatgctaaaaagccatgatgctgatgaccctgacttaaaggcaatattctccccattctggctgtacagggcaaacatagcatatggcggctaaagagatatctgagttactggttctgggtaagatggagttatcacagttcatcctgtctttcccactgaatgatgttctaagacctggacagaatgcatggagcagctatttgaagacattgagaataaacaatggcaggtagattgaagaagacccgaattagaaataccaccaaatcagcagtgaatttaccattgttctcttctggtatcctctagcctgacctcgaggcagccagaacctggaagggatcatcaagatgtggacaaaaaacctccaggagaagcctcatagtagaactaactaatgcgaggtaactcttagaaaaaatggaggaaatcactgtttttccctccctccctccctccatccattccttcctccctctcttccttcctctctttcttctttcctttcttcctttctttttctctcctcctgtgccccaacaccaagccatctagtagtggcagtagcagtggtgacaatgcaagccagaaaaagattaaaggagataggagaattttcctctctgcccaaaaaacctatggtcctgagagaatgaaaaccaaaccctattgctttttgtctctctctgcccttctaccagttggccccagatgtgaacacaatcacagaaagtatacagaaagccagataactaaagcctcagcagcccttccatcaaaagatcaaaaaggaagaccccagggaacctgaaaatattgcagagatcacatagaaagaggacatggggaagtagtcactaaattgtttataaactctggggctcacgctaagctgtgcatggatgaaactgaccctacacagcacatttagattctaagaactaaactacaatatagaccaccacccagtctgagggcaatattggacagatccaaatagcactgccaacgctttgaaaactcaactaacattgaagtcacaacccatagaagccccataagaacctgtagcctaaaatcaagccgatcaggccgggcgcagtgcctcgtgtctgtaattccagtatttgggaagccaaggcgagtggatcacctgaagccaagagttcaagaccagcctggccaacatggcaaaaccctgtttctactaaaaatacaaaaattagccaggcgtggtggtgggcacctgtaatcccagctacttgggaggctgaggcaggaaaattgcttgaacccagaaggcagaagttgtagtgagctgagattgcaccactgcactccagcttgggtgacagagtgagactccatctcaaataataataataataacaataataataataaagtaaaataaaataaagcaggtcattaccttccaaaataaaattatcaacattcttacaaaatttaaacaagaatcagagtttcataataaaaaaattaaaatatccaagacacaataaaaaattacttgccataagagtaaccaggaaaatctcaacttgcatggaaaaagacaatcagcagatgccaatgcctagatgacacagatgttggaataatctgacaaaaaccttaaagcaactactatttcccgataactaagaaagaacacatttgtaaagaagtaaaagacgggatgcataatttaaaaatcaaaattttaaaaatcaaatggaaatactacaattaaaaaatacaataactaaaacattcactgaatgggctcaacagcagagcaaagatgatggagggaagagtcaatgaacttgaagctaggtcaatataaattgtgcaatttgaacaacagagagaaaaaagtattgaaaagtttcacacagagcctcagggtcctctgatacatcagaaaaagatttagcatttgcatcataggaatcctagaaggaaagcagaaataatatggtgcaggaaaaaaaaatttttttgaggaaacaataagtgaaaacttctttaacttccccagagacaaacctagcagttgaagaatctcaatgaactccaacaggataaacccaaaagaataatgcctagacacattgtaagcaaacaacagaaaactaaagacaaagagaaaatctagaaggcaatcggagaaaaatgactcattacttataggtaaccacaattcaaatgactatggatttctcatcagaaacaatggaggcaagaagaaagtagaacaacacttttaaaatgttgaaccctgaattctatatccaccaaaatgtccctaagtaatgaaagtgaaataaagatattttcagatgacagaaaacagtgtttgttgccagagcatggctctgaaggaactgctaacataagttggacaaacagaacaggaatgatactaaaaggaaggaaacaaagagaaaacaacaacattaataaatattagaataatataatagactatacttctcttgaattctttaaaatagataaaagcaaaaattataacattgtctgatatagtttgcaacagctgtaatacataatacaactataacataaaatggggagggtaaagaaacctatagtttggtaagggttctacatttcacttaaagaggcaaatcatggaatccaagtagacttaaaaagttaagtatgtacattacaaacccatgagcaatcaattttttaaaaactatataaagaagtataagaaataccacagaccaaaaaaaattctgaaaatgttcaaaatgattcaaaagaagaaagaagagagttcaaagtttttgaaaaattagtctaattttcaaaactgaaacaggaaacaaacagaaagcaaataaaatattaggcctaaatccaaacatataaataataatattatagataaattgtctaatgcaaccaattaagaaagagagattcaaagaatcgatttttaaaaaatcacccgactataaactgtctataagaagatcacttaagttttaaagataggtttggttcaaacaaaaaagaggagaaaagatatacttttttccatgaaaacaccaatcaaaaaagaaagcttgagtggctatattaatatcagataaagtagacttcagaacaaagaaaattacaaggatatagggataatatataatgataaaaaggtcaattcaccaagaaaacgtaacaatctaaagtatatgcacttaacagactttcaaacacacacaaagcaaaacctgacggaactaaagtagacaaatccacagttataattggagacttcagcatccttctcgtagtaagatgcagaactagcagacaggaaatcagcaagggtatagaagaaatgaacaacaccattagccgactagtaataattgacatttatagaacactctgcccaacaatagcagaatatacattctttttaagctcacctggaacattcaccaagacagattacattctgggccataaaatgcaccttaacaaatttaaaagaattgaaatcatgccaagtaggttcttaaccataatggaatcagactacaaatcaataatagaaagataagaggaatatcttcaaatacttggaaattaggcaacacacttctaaataattcatggatcaaagaagtttcatgtgaaattagaaaatattgttaactgaacaaaaatgaaaacacaacatatcaaaatttgtggaatgcagctaaagcagggaccaggaagaaatatatagcacaaaatgtttacaccaaaaaagaagagtctcaaatccaaaatctaagcttcatcttaagaagaaactagagaagaggagcaaagtaaatctaaagcaagcagaaaggaaacaaacaaacaaaaaatacaggaaataataaaaccaaagccgattatttaacaaagatcagcaaactttatatctagtaagagtgacaaataagagagaagacacaaataacaaaatcaagaatgaaagagtggttatcactgcccacattaaaaggacaataatgggatactatgaataactctacatacataaattgaaaaactcagataaattagaccaatttttcaaaaactttgaattgtcacaactcacccaagattaactatttaacctgaatagtcctataaccattgaagacattgaatttgtatttaaaaactttcagaaaagaaaaaaatctaggcccaaacctagtagtatttcactgccaaatactactaaatatttaaagaaaaaaaaatcaccaattctacacaatttctcccagaaaacagaaggaagggaaagatttccaactcattttataaagccaacattacctgacactaaaatcaaagacagtctaagaaacgtacaaactaatatacaccaaaaaacaaacacacacaaattcttcataaaaatattaacaaaccaaatccaccaacatgtataagaaataatcacactaactagggtctctcccaggaatgtatggtggctggttcaatattgtataatcattcaatgtaatttaccatattaacagtctaaagaagaaaaactacatgatcctatacattgatgcaggaaagcatttagcaaaattcaacctccattcatgattgaaaaaaataaaactctcaccaaaatagaaatgggaaggaactccctcaacctcaaaagaaaggtatctacaaaacatctatagttcatatcatacttaatggtgaaagaaatgaatgttttcccttgaagacaggtgacaaagaaaagatgtctactcccactccctctattcaatattctgcaagaagtgctagccggtacaatatgattgccaggtacaaggtcaatacagaaacataatgtatatttctacataccaccaatgaacaattggaacccaatttttttaagatgtcatttataatagctccaaaaatgtaaaacttacatataaatctaacaaaacatgtacagaatcttgatgctgaaaactataaaacactgggtaaaacaagttaaagatgacctaaataaatgaagagaccaaattgatggactggaagatacgacatagtaaagatgtcagtgctcccccaaattggtctataggtttaatacaattccaatcaaaacacaggaggaattttttttaggtataggcaagctgattttaaagtatatatggaaagacaaggacactagaatagccaaagcaattttgaaaaagaatacatttggaggactcaaactttgtaatgcccattttaagcaacagaagattgttcctagaccttgaagctcaatggagtttgccatattggaatctgaagttgtttggttccggtacctcctttcatccttccatattctcccttttggaatggcactgtctatagccattatcctatggctgtcctgccattgcatttggggtgcagagtacttgttttctagtttcacagatccaaaaatggagaagaattttgtcccaggattgatcacacccaaagtctcacccataactgattagatgatgacattgggacatgtgagttgctgatcttcagctctgattttggacttgaattgttttgcagggttgagacttttggggatgggggaatgaggtgaatgtattttgcatgtgggatgaatgtagatttttgcagaagtgattaacgatcttgtgataggaaggttatctaagtgggctctaaatgtaatctctattgtctttttagaggaggtttggctaaagaagaagaaataggagatgtgacaatggaagcacaatgttggagtgatgcgatgacagggacaagagccaaggaatgtggtcagcctccagaagctagaaaatgcaaggaaacagattctcctctagagcccccagaaggaaccagccccgccaccatgttgactctaactccactgaaactcagtttccaagttttggcctccagaaaaggaaggaaaaaaacttgtgatatttacagcaactaggtttgtagtaatttattgcagtagccataggaaactaatacatagagtttcatttatcttgggtagatatctaggagtggtatttctgagtcatatggtaactcaatgtttaaccttttaagaaaaactccaaatatttcaacttaaaaacttctttccaggaaagaaagtttaagttaagaaaatgaaaacacaagctacagattaggggcaaatatttacaaattgtatatccaacgagatccaaaatatataaagaattcttaaacagtaaaaaacaaattcaaagaaacaactcaattaaaatggacccagcacttcaccaaaaagcatatacagatgacaaataaccactgggaaggtgttcaacatcagtagggaaatacacgtgaaaaccacaatgagataccacactgcccacctactagactgtttaaaataaaaagtattgacaatgccaagtgatgataaggatgcggagctacagaaactcctgcattgcttgctgatgggaatgataaatggtacagtccttctggaaaacactttggcagtttcttttaaagttaaatataaacttaccctataatccagcaatcctaattcgagatacttaccctagagaaattaaaacttatatccacacaaacttccatgtaaatgtttatatcgactgtattcatgatcgccccaactggaggaaaactaaatggtgtccaatggatgaatggataaacaaactggtacctgcatataagatgtcatactattcatcaacagaaaggatggaatactgatacatgcaacaacctggatggatgtcaagggaactatgctaaatgaaaaaagccaatctcaaaaggttacatgctccatgatgcctttacatgacagacttgaaaagacaaaactgtaatgacagagaatagatcagtggttgccagggcctaggagtgacaggagggtgtgactgtacagcatgagggaatttgggggtatggaaactatcctgtatcctgattgtggtggtggttgcatgactacacatacacaaaatcaactttactgtatgttaatttaaaaaataaaatgaaaaacacttctggaaaactataatcatttccaaatcttactggaatcatgtaccttcagcattttcctataatgcaaatggattactctgctaataaccttgaggacttatcaatccaaagccccaacacctccactcgaattgcttgagttacttgaatatttttgttatgatcagaaggtgtctgtaaacattaggattaactatatttttttctccaagatacttttctttcttcatcttattagcactacctaacccgtccggatctcactcccctttacagacacatttcacacatgggaagtctatcatactgcactgtaacctactgcttccttctttcaaatggttgagactaaactttatagctttcttacatgtccctcaacaaaccagtcatcatctcccttctgtactcagttgcgtcccttggcttgagcaatacatcctcccactacaaggcattatggtctagacaagacagcacttgcctgggtcttttccagactaagctaccaccaagggaatggggcagacatatgtatctcctaccttggaaaagagcttaatttttatagtttttcatggttgaggggaaacctaggataagctcattttacaaatgttgcaaagtggtttctattcttagaagctattgatttgaatataaaacaaagcagtgtttacattcaagacatttctcttggagaagcaatgtgtaacagtggggaaagcgctgagctgagaagccaatgatgttgtagcgttctggccctagctctaccattccccaaccagccatgcaaccagaagtcatcttccgatttcctcctcccaaagagctatggtgatgggtcctgtggcttactattctacaactgaagaaaggtcagagacattaggttctttgcatttggcatgttttccatatgtatctggtttccttgtgtatctggtcaaataaagaatttaagtgaaaatgtatatctcagccaggcacggtggctcatgctgtaatcccagcactttgggaggctgaggtgggcacatcacttgaggtcaggagtttgagaccagcctgggcaacatggtgaaaccccgtctctactaaaaatacaaaaattagccgggtgtggtggctcgtgcctgcagtcccagctacttgggagactgaggcagcagaatcacttgaacctgggggctgcagcggctgggttgctgggggagaggtgggcggaggttgcagtgagccgagactgcaccaccgcactccagcctgggtgagacagcgaaatctccgtctcaaaaaaaaaaggtatatcacgtaaactgaaaagtgctgtgcaaacgtaaagtattactataattccaaagttcttaacagaatacccacggtatcaaatcaatggtgcttccttgttttgcacccctagatgtgtagaatagttgcctcaaagttccaaattcctcatcattgttctggacacagattcacacttaaaatcaccttagggcaacgacaaccaatagacttaaggaaatctgatattttattccttatggcttacataggactttgcgattttcatgtaacaatcactaacagtggatggcactcaaaaaaccaaagtcaaaaatttggaagagtggggaggcagagtagacccagtctgtggatacccaggtggactcaggaatgcatgcaattaattaaaggccaattatctctgaaagagctcagactgatgcttggccagaggcttgttcaataagatggctcttatttcacatcagtgactatatcctgccagccgagaagggccagggtgagtgtcagcttctactggattttcgcattaagtcctgaccattgccgcttctcgggccccatcctcgctgggcaccggactctgtgtatatgttatgtaatctttctgtgctgcctttctctttgttcagtccatgccaagacccatataaaagaatccatatgtgattacagctataaaaccaagaggaaaatattagatgaaaatataacattttggggtttctaagtttgctttacctttaatgctaggcagacagtttacacaaatcattttgctgcaaagtaaagaataatgagttaaatgtgttccctgtcaccatcaatcatgtacatttgcttttgattcaccaaacatataagacacatgaaatgactttctaatcatgttgggggaaggagggagaagggaagaagatggggaaaggagtttcaacttcttttattttattcagaagatccgttgacattttctggcaatctatcttctaacatgctgtatgggcttctttttgctaataatgtttgccttgagaatttgtaaaggtctgagaacgctttaattcaatgttctagaaattaccagggccataggggaaatgaatccctgttaatagctcatggattacttctctctttattagaaatagttttcacagaagttactctactttcaggtgggcattagtgggcttggtcagactgagtggcactgcgggaggcagcatcctgcatggaagcctctgatctaatgggatctaagtagggtgaaaagcgggtacacagtgacgttgacccaaataggatactggggtttagcaaattcatttcaattcatgggtgtttattttgatttgtgaacttaaacaacacactgactggattttctggcagttgaagagctttataaccaaatctaaccagcctctgcacaatccttgtcaaggattaaagagctttgcatttcatgtttctacattgaatcaaagctctttaatttggcaagggaatcatatacagtagcaaagaaagaagttttctgcaccaaaatcacaccaaattacaagtccccgctggtcctggtcccacccagctgtctgtaatacaggctggtcaggctaggctgaggccaaccgatgcattcatttactccacaaacacgtattgagtagctattatgagtcaggcgctgttctaggcactgaggattcagcaagtagccccatcttcacagtgctcaccttgtcccagggaaaagaggcaataaacaccaaagagtgccacgggaaaaaacaaagccaagagagtaaataaggatgtggatgtatggtgtgtggagggggagggggtgcagattcctaaaatgcaattctgttttttccacatggaaacttcatcccccaatgaagctgagaagaacagctgtatacttcctagagaatatgaagtgggacatctactctctctagagaccctcacaagccccagagaacttgtatgagcttagttactttcttcctgattttcctgtatttgccagggaagttgttgaatcataaagtatccctttataagaaatataccatattcatagattggagaactcagtattgtggagatgtcaattctcccaagagaatccagaaacagacccgatcatgtagtatcacctgacttatttaaaaaaaaacagggggttctgggatatttgtaatgtactctttgttaatctaggtcctggttacatgagcactgagggtataagtatttaacaggttgtacatttattacatgcacacttttattatatttcaataaaaaattcatttttaatcccttttaaaaatgcagttctaatgccttagaggaaagactcaactgagaaattaatattaagcaaagacaacaagagttggacagaggggagccaagcagctgctcagggaaggaatatccagccagagggaacaagaagtaaaaatccctagaccagcccaagggagtgtggctaacataagaagcaggagaacactcaggacttaagccaatgaggttccagggacctgactgcttaggacctgcaggccattgtagggactttattcagatgagatgggaccccatggagagacttatgcagaagagtgacaggatctgattcatgcttgagaaggttgttctggatgctttgttgaagatagattggaggtggggtggtaagggcagagcagacagaccagttaggaggctggtgtaatattctaggagagacatgatggtggtttggagctagtagtaggagtgcaggtggtgagaagtgctccgattctgggaatattttgaaacttgaaccaagaggatttcctgctgtattgaatgtggtgtttgagggcaaataaataaatttttaaaaatgagtcaagggtgactccagagtttttagtttcagccatgggaaggatggcattgccaatagtaaaatgagcaaagaacaggtttgtggacaaagaaaaggaattcgattgtggaatggtaagtctgagaggagatggggtattcaaatgtaggtgttgagcagcagttgaatcggtgacgccgggttcaggggagaggttcttcatggaaatataaatatggaagtcatctatgtatctaaaagcaatgagaataattgagattatcaaggaagtgagtataattgtattgggagctgctctccactggtgaggaatatgtgcagaagtctgctgtcataatgccatctgtggttagggtgacattgtccatgggtaatagagtaagcaacatcttgcatctccctatctaatttccaccatgtgggtttactttgccagacaaactctctactctggtaccactagttgttctttcctaagtagagagccacctcaatcccagccttatcagttgcagccctggccccatttcagagctcttgtcaactccaaccctgccacgcaaggttgagttctgcttctggtatgcctccttcaacctggttagcagagcttacacccaccagacaataagaattgcttgctgtgatgattaatgttaacttgactgggtcacagtgtacccagatatttggctaaacattattctgggtgtgtctttgagggtggagggtgtttctgcatgagattaacatttgaatttgtggagtgagtaaagcagattgctcccccaacaaccctcaacccaacccatgtgggtgggcttcatctaacccactgaaggcctgaatagaataaaaaggaggagtaagggagaatttcctccctctgcctgatggtcagtcttaagctgggacatcagtctcctcctgccttcagatctagacttataccattgactttgctggttctcagattttcagactcagacagagactataccatcttctttcctgggtctccagtttatagagcttgggatttcccagccactataaccctgtgggccaattctttataatcaacatctctctctctctctctcacgcatgtgtgtgcacacacacacacagagacaccattgctctgtttctgtagagaaccctaatatacttactttgtcccagaagcacctacctaagtcatccccagcccttcagctccacttggtttagactccaattagtttcacctcctcaaaacagcagtgtgtgtcaatcccttcttgggagcctagttcattccttaccctgactcagcccagcctagggtaactgttatgatgcagtggcctctgcttttgcagagctgggcagacagaaaggtaaagaagatgcacagaatggagctatgcaaacatgtgcccatacatccaagtcagaacagaagctttctgaagcttaccagagcttcctagacctaaggatgctgatgggattagcgcactgtctggaacatggtaggtccccagggcatctctattgcatcaatagttcacatagaatgaactatagaaagctaagatttgtgctaagatgatggcactagctaaagttttcccttatcgtttctcacatttcctttcagtatactcaagggcaaacctggaaccagtttgcttgggtttgaacacctgagtttgtgaattccaaatcacacatccgcatgcaggttgttgaaattctcttaacccatagtgcctgccactgtaaaaggaggataataatagtgacaagtttgggtatggtcattgtgagaattaaatgtgatattgcagctaaagcacttaatacgggatttagcacatgggaatcagtattttttagctattattaaaagtccttgatttacatttttagctgctaaaccagactaattctatacatacatatgtacaagcacacatatacacataaacataacccagactaaaaatatttaaatgattcccttggctatggttagtgctaggacaaaaactttgtgtgtccagccatatccacttcagccaagatacaatctgaatagcatgcttctgatttctctagtgcattctcattcagaaacagaaaacatgacagagaagcgtgtattgttatcgatattaagtaacatttcacccgcaaattccaaatcttgcggcatagggaaaaaaaaacaacactagaaatacataacatattttcttcattctcaaaactgatttattcaacaaagaaataatcatggagagcatactgtgttccaggttttgtgtgtgtgtgtgtgtgtgtgtgtgtgtgtgtgtataaaatgatagattaacagacttcaaatagttggcaattctgagaactatttaaatgtgctacattggaagtcccaatgtacattgaaaaacaattttaagagttaatcaccctctaaacacacacacacacacacacacacacacacacacacacacacacacacaatttgtcatgtgcaaagacagctaatcctagtaagaatgatagcacaattcatgaagatggcaggccatgccccaacttgaaacctcatacgctgaagagaagctaagtatgcatagtaagactcaaaaacaaaaacaaaaacaaatcaatggatcttaaattacatccaagtgaggaagccaagtagagagtaagtgtggccacttattcagggctgaggcaatagcagataggctaagtaagttcattgcctgggtctttacagaagacagcagggagagtctcactagaacctgacaggctaggagtaggagatcagacagtggcaaatgaacagcatgttccagggctggctgatgatgtgaatgcagataagtcacaggcaccaggatgttcgtgcgaactccttaaaggaactcaagggttcaaataagatcctattgcacaaaatgcttaacctgtccttaacagcagctgctgagctggaggatccctggattgccagcttgagtctctttcctaaaggtattagatataaaattagcataagatttgttaaatcctagcactgcagaagctgtagagggcatgccttgaagtttaaatggagtaaattaaggacaaatagccagaaaaaaaatatttagcagtagttagcaaagttaagaaattcattacccccaaagatatgggggtatataaaatataaaaaagattcctaaaaagtttagatcaattcagagatatatccacataggagtgaggttttcagggacaaagacttagggtcctaaggttggtatctttgagagtggcattgatggagagataaagaagcattgctccatatttcttggtacctccaggctgggcctcttttgtaattcctgtatgccagtagtccctctttctttttctttcttttttggagacggggtcttctttctctgttgcccaggctggagtgcaatggcatgatcttggctcactgcgacctccgcctcctgggttcaagcaattccccggcttcagcttcttgagtagctgggactacaggcatgcgccaccaggcccagctaatttttgtatttttagtagaaaagggatttcaccatgttggccaggctggtctcgaactcctgacctcaggtgatccacctgccttggcctcccaaagtgcttatattacaggtgtgggccaacacacctggccagtaatccctctttcttttattaaacatatcacccccactttcagtcttggcattttggtctcatgcatgataaaatgcccagtggaagtggctcacacctatataatcccagcactttgggaggctgaggcaggaggattgcttgaacccaggagtttgagaccaacctagacaacacagggagactggtctctacaaaaaattaaaataaaattaaaaagcccagtggatagtcactgtgcttctgcctgtgccacatctttgctgttacagtcttgtttctcttattttaacaggggttctgccgcaccaaaaaacagacacgaccggcctaggggaagggagagggtgagctaacactttaccttggcttccagaaatgctaattgttcccaaaggatcaagtgctgccaaagcctcaccccttctttgtccatcctaataggcctgcttgtccccatggaaatattgatgaattctccgtcataggatacggaggtcattggagaaggaagcaatttctgtaaacaataatccatttgtaggtttacttttccacctaccccccacccccaacaaaagtaagtgagggctttgtgatccctggaatgggagataatacataaaacatgccaaggagggtgccattatggtgttcaccatgacctaaaggagacgaagatctgggatttggaggtaagtacacaaagatagcaatgtagaatggggagcatgtgaataaggcatctctattttagctgagaaaaatatatgaggggaaggcttgtgatttccaggtcatgtaccttagccaattccaacacaaagaccatctcagtgtcaaaaggtcatattcagagagctacttccaaacaggcgggaattggccttatacagaaataatgtggtaacataacccccagaggaaaatgtgttttcagttacaccagggccaggcccagcctttcccacaagctcttcctaaataggaacttggcaatgggattagctgagctggagcggacatccttggctttagaggtgaggcccatcagggtctggaggaaggttgggcagaggttttccctgctgctaatagcactgaagaatcagcatcacatccattttattaatttccttgacagacagctctagttaccatgcaggcaccacaaaatcaaaacatacgcatgtcaaggggccccatctgtggtggggccctgccaaagcccatgttacatcaacacgaggaagcagagcacagctccacacaccatgtgcttggtcccatgggccatgccctggaagaaaaccaccagagcttgattgaaagagccagagaagttctcgtggtgacagtcctttatcctgagtctgggcttttcatgttgaacataagatccctgggagacacgtggctacatctggcttcagggtctcgtctctaaacacagctacacagacctccctgccacctccattcagttccacccatgcaggatgagagcagcctggattaaagaagatacctaaaggaatgcaacatctttatttgtaagctggatctgagctcagagttctgctgagctgagacctttggctgcataatgagcataggaggattttttaaatcaaggtatcccttgctatcagtgttgctaaagtgattgaaggagctccaaagcaatttgttcctttatgtggagcaatgttaactatcagttggctacataatgccgatttggcaggtacgaaggataaggacttagaaaaactcctgctctaaataatatcactcataggtgcccaaggtgagcaccaatgcatctgtatcctcatgcttcccacccatccctcttattgcaacctaggccatttcctcaaaaccatcaaggaacttggcagtcaattaggtagccacatgacagcaaaaggcaggaggtctcatacctttgattgcagagcttccagcctcctttatggacctcgtgctgactcatgaactttctaaggatgtaatttcccaccttgccagctattaattctgctccttacatagtaagaggcaagatgtaagcccagatccagagctaactgcctcccatgccataacagaaaggctcaagctagacccgttttacacacgggtttgtcaccttgactgcctaatctaagaacagtctaaggatgaggactggagtgactgttatcccaggctccagaagcccccttgctagtggctgggcgatcaatgcaaggctctggaaacacaatcctaacctggcccaccctgggaggacagagtcggttttttttctctccttgcctgcactggtgcagcaggtatggccaccttggggactctggagtgtctgtccagccagctctgacaaggacatgaacacatccagaccgcctgtctctcggtgcaaagggcactgctgccgaggactcagtacattgtttcgctctccattcaaacaaccgcggcatgtcagtcctgctggcctccttgattgtgcagaaataaataaatgaattatgctgttggggtttgggcttcagcacaaacacatggtctgcatttatccacacagtgagaggtccaccagccacttgatataaaagagcaaaatgataattcttttctttaggcgctctgttgccatatggaatgtatataaatcatatttttgttttaacagcggaggctttgttgatagataaacatgtggtttatctaaaaaaagaggggattgtgctttgaacaatcatttaatggccgtggatgtgccaaataaaaataaaaacataattttgaaagaagttggcttcatgcccaaatccgtaacaaggaatttctccttaacccaagtggttagagcccgtcgatctgttttgagtttaagctgtgctctctactcaaccccacgacaaatggaatcccgagctaatgtgctctaataagacgagacgttacctttatgaatgacctcatggagaagaggttggcaagcatggtggagaggccttgagccaggcagctctgggctatgaagcccaacttcaactctgcgaggcagattgcgtcatcaccttctttccaattccagctcgggatgtttagcagatgggcctggggaaagaaaagcaggtatgagaccttgctctgttaaatgttcaattgtttaacatttcttctgggaaatgcagcattgcccaaccactcagggccatccagtcttgcccttcttttcccttgctgcggtctgatgtttgctgttttatgcaactcttctgctcatcacacttcagtctctctggactgttgcttctgcacccaccaagcccaagtcctcccctgggtttgtcatttagccaaatagagcccagagggaatttcctcttgtgacagacccaacagcctgggttactaggatgtctagctaaatcattaagttgagtcctctaatagaccgtaggagtgccaaatgcctgtatattttcagtttcttttttacctgcctttccaatactccagatcagtgactcccaggcatcaggagcgggcatcagaatcacctgtacagtttctgaaaacacagattgctggccccccaccagcatttctgattcagtagatctggggtaaggctggagaatttggcatttctcacaagttggaggtgacgctgacgctgttgatctaggggccacactttgagaaccactggcctaaaacatcaggtaaatcacagtgtcgacgtttccaatctcttgcaaatggactggtcctattcaacccttatgtcaggccctgagacaagaacccagaggcatgctcatccaattatttttaagtggcatgaagcagagagtcatagaaaatacattggatgaaagaatcaaagttcaaaaggttctccagagttggaaaaatcggcaaaagaccaaactaaaaagatttacaaggctttcatgtcaagtacagcatttaggctaaaaaaaatcaactatataaattcaaaatgagaagacctagcttggcagcaggcaggagagaaataaaagaaaacaaaacacacaaagctaaatttaagtgtgtgggtaactaaaacctcaaattttaggctagccatgtgacattacagagaaagccagtgtttactttttagaagtgctccccagatcaagggaaatgaacatttcattctgttgtgaattggtcagactagttccagagtacttgatccagttttcagtcagatttaaagagggaaaatgatcaactgaataacttccagagaaaagtgacaaagacaagaggaggtagcgtctggaaaagatcttttgaggaacagttaagacagccagtaatatttggcctgaagaaggctctcgtcctcacagagacaggatggttacatctgaatacttcaggtgctgctgtgtacaagattaggtttgtcctgctttgttctagaagccagaattaagactgactggtatatattccaagaaagcagatttttgtcttgttttataaatgaacttcctaaggatgtaatttgtctaccaaacggagaaggttaccttaaaaaatgaaaggtctttgtccctaagactcagtaagtatttctccaagttactatggaaagaacttttgctctgcactaggaggttgaatcagagagcccttctaagtctctgctagtgccaagattctatggctttgaagttattatttctctgcacatctcagcaaacacaaggagcaccaagggagcattcccttcactttcagaacaatatacaatagttgaactagaaggatggaagactccattgtgaaaacaaagagcaagtccaagggttccacactctgctttcaaaaatactattcttatgaaattccttcttgcaaaatccgcttctgtgacaatcttgtgcatcctaagccaaaagtgggtactccagggagagatgacagtgccctccctgatgagagcatggttaaatagtctcatggaggggccacagcaagtggtaattgctgtcaaactatcaaaggaccttccccacactgcagactcaattccaacaactagccctaccctttattccttcctctccctactctccagtggcttcagatggccactttcccttttacttcctgggcatcgtagagaacacattggtataactggagaaatactcacttgcagtaatatcatctgagaacctgagaggaatgaggagaaattcagtttaagtaatgaacaagtcaagcattgtgtgtgaaaggagatttttttggtccaagccctaaagagacagctctgaaccttcatggcaccttcaaacaaacaagcaaaacctttcagagaaagtctctcctatccgcatgtgctatctaaggtataaggctgaggcatttcatccttgggtcccccatggccctgtctggtttgagttctgtaggcatattttgagctttctttctcactgtccaccttgacacttggccatgtgattatatagaaaagttgagtttgttccttatctcagggttctgtgccctctttttttggatattatattttctccaacgcagggaaggagtgagggtgacctgctgaatgcttggagggaaatctctgtgcatgaaacaaagagaagagactgacccaggaacataaatcctttgtttctggaaacttcgtccttttccatttgaagtaaattgagtctgatgaaaaatgccagtgttagtgcccagaagtctggaggcaaatcctctctccctaacttggagaatataaagagcaggtctggcagacctggctgcccttcatttctgctacttcaccacccctccctcctctcatggagaaggaactggaaatacgctgtcctggaaaaccaggagagatggatttcagtcctagttccatctctcactacatacaattttgggaagccactatgaggaacaaagaaggccatgaaagaggaaacgatttaatacaattgcccaagtgtcagggtggacagtggaaaaaaaaagctcaaagaacttgcctctatctgcactgggctcatgggacttggcttccagagataaaggcctctttcactagagtctttgggaaaaataaaaaatccactgagaggtaaatcatcaggagtgatacttttccaagaagttataaaccaatctttccttgaagagctttgagccatttacactcaaatcagaagatgcagggccagcatttaaaagatggccagcatgaaagcgtttctctccaagaattctagtgatattaaaagatacactttggagagcatcagcccttctataatgcctactctcgggaaccacagtttggttcaatgggctgtggctccatttaaagagtcggtggcagtaagctcttctgtctccccgctcgctggctgcagagtggtggccatgatttgtgcccagcagagctgcgctgtctatacagagcttagatgccctgctctgaagttaccctgggatgctaaaatgcacagatggtccaacgagtactaaagaagataatggatgtcaaagctcttttaaaaccataaaatatgacacacatgtctacaattatgatgatgacaaactcagggccagttttacatggagagaaagtaggcagcttccctacatccctctaggccctagaatattactattactggatcataggggattgaaatgcttcatatttcaagcccgttgtccaattatgaaatcagctatctcttggaatatgttcatagtgacatgactttacaggcacataccaggtcctttcctgaaagcaaattgtaatgcatggagatctctaagcatctaggatgagtgcagcaaaaagtgccaagaaaggcagaaaaaaaatgttgaaagggaagaggaagaaaatgtattgaaagagtaggaaacatctcaggaaacacagcaaaactgtgaagcaaggtgaagaatgtccatttgcaattctacaaggaatgaaagacaaacaatgatgagtggacgttttcttctttctctagaagagagatatgaaagaacaacaacaacaaaatgccctgtgtcaaagtcactctattccctgtgtcctgactaatcatccaaggatctgtaagtgattctgcccaaccccaaaactcgaatagtttgggatggttctaaacaaaatgtgttttaagcaaataatcatgaattggttgatatcttcctcactgtttctgaataattacaacacagaggtttgccaaacacattcaggttgctatgatcatgtgattactgaccagggactgtctggatcccaggccggctgagctgctttgagttggacaataaccacagctaaaatcctccttaatttcttgaagatgctgcatcagcactcattggaaagagaaaaaaaaggaactgacaaccccttctaaacatacaacattaattttcctattcaatctaaattcagccaaaaatctaaacaacagcttaaagcactcccacactaaatgaaatttcagatcacaaatgaaagaaggagagctcgttgctgcaggagctgtcactagtcacagccttgctaataaaattcacctccacctacaagggctgccatcaaaaacttctccagcttgacacccgtacattaccaatatcctcactttatctcttcagtgtccttgggttttccagagacaaacaggcgaatgtgaccttgggtgcccaccaccaaatccgttggctggagaacaacacgttctgcaagggagccacctgccgagggctgggcagtggctggcagcagtcagccgttctggatggtgggccagtcactgacagcaggctccactcagtgacagcctctgatgggcctccacacagcaaaatgggccagcacttgccagcaattaagaaataacggcatggcactggtgcatttggcagaatggggtttttctctgcatcacctgactgcctatttcatagggaatatggcccataagagggggtacgctgttactcataacccagcagcgagttattctgtacagacaggacacctggctccaggtactgggcagcctccggtttctaggtttcattaaggacataactggtactgcatcaaatggagaaaggtgccaccttccctcccctaaagctgtttttttggaagtttattgactggctgagagaaggagcactgcctttgaatgagacactggactctggtttactgagaagtaatcacagggaaacagcatagactctgacttttgtcttctttctaatcaatcccccactgtaagctataacacaaggaaaattcctttctctttaatctctggatagcttactattttcctgattcaactctgcaaattctcatctcgactctgggaatgtgtcccacattacactcttacagagcgcattatgcactcactagttcacctggtctcagatagagaaatcctatcactcacttgcctggagcattctacaccttaactgctaaatccccgaggacacaaaatagggcttctccttcactgatattcctgtgggtgtcagggagagtgctaatcacacagtatgtattcaataaatatttactgaataagtaaatgactgcagcacatacaaataaaagttgttgtaacttaagtatggatgggatccaagagtaaatcaatagttctgaacctcgggttccaatagacacttcccgaatgaatgaatcagtacatgaaggagcatccttccagtgaccaaatgcaaacacgttgtttggactaaagaaatgggccagaggcgtggtggctcatgcctgtaatcccagcactttgggaggccgaggcgggcagatcacctgaggttgggagttcgagaccatcctgaccaacatgcagaaaccccatctctactaaaagtacaaaatcagcctggcatggtggcgcatgcctgtaatcccagctactcaagaggcagaggcaggagaattgcttgaacttgggaggtggaggttgtggggagtcaagatcatgccattgcactccagcctgggcaacaagagcaagactccatcccaaaaaaaaagaaagaaagaaagaaatgtcccaggaagatttttaacaatcacacctctttacccaggtctttgagttgcgcacatgtgggcatgtgagagtgtgtgtgtgtgtgtgtgtgtgtgtgtgtgtgtgagcctgtataatgaggaagaagaggctggacctgtggatgggtcttcagacctggagcgggctctcgcactcctaccttgttgtgatactgcagcatttgagtgatgattcttatcttcggatggtagttctttatggagattactctgaaaaagaaagaaccaatgctgagacaggtctgccttatgcatggtgtctgacaaaaagatcaattttactgtctccaaatggggtacccatgggactgaggtaggaggcaggacttgattccagaggcagggctcagataccagacaaaattgaagactagctgaaacagggatggggcagaagcaacttttcactggacaagcccagcagtgtgccctgtcagtttaccattgccatggcaacacccaggaggttccctataacctctaggccctagaacattactattactagatcataggggattgaaatgcttcatatttcaagcccgttgtccaattatgaaatcaactatctcttggaatatgttcatagtgacataactttacaggcacataccaggtcctttcctgaaagcaagttgtaatgcatggatgaattccagtcccagttccatctctcactacatacaatttggggaagccaccatgaggaacaaagaaggccatgaaagaggaaaccctttaatatgattgcctaagtgtctgggtggacagtgagaaagaaagctcaaagaacttgcttctatctgcactgggctcatgggacttgcctttctatggcaatgacccggtgacccagaagttactaccccttccctagaaatttttgcataagctgccccttaatctgcatgcaattaaaagtaggtataaatacgacagcctgcccagagctgctactctatggtgtagccccgctgtgcaggagcagtcacagagctgtaatactactgcttcaataaagctgtttccttctgccctaccatcagcttgcctttgaattcttttctgggggaagctaaaaaccttcatgggctaagccccattttggggctcacctatcctgcatcaggaccagcagccagggctatcctgaggggttgcagacactgggccaggttaaacagtattcccaccaccatatctcttgctagtgtgaaaacaaaatcacaaaacagccacagtctgtgtcctgggcatgaaaaatttgagggccccttggaatgcattggagatgggatgtatgcatgtgcgtactggggagtagggggcctggagcaggggctgccagcttattgcctacgtagacatcgaaagcgagcccaaatcatggggcctccagaggtttgcaatctcccacaccctagggactagcccagaaacaatctgctgagtccaattctccaagttaacaacttgagacaacaatgacaaatcaaacaagcaggatgacaaatggttctaattgtgacacatgcttggccactatcacaaaaaatgatttctaagcagggcttttaggatgagatcaaggactcagccttccatagctaatagagaaaatgatgacttaaacgctggttaaaaataagtgccaaggcattgcgggggtcatgatctggtggaaaattgtctcctacctgccctcagtccaaactcaatgttaagcatggcctgcacccaccccaggcctcacgtgtcctccccacatcaattatggtgctaaagggaggggcagagcgcagatgaatggaaacacgtgggttccagtcacagctattgtactaatgaactgcgcgacctttaggaaaaccctgggctctctgttcctgtttcctcatctggacactgggagcaacagtacctgctttatttacttcacaggcttggtatgagcagcaaatgggagaccagatgtgaaaatgctttgaaatcattaaaagttctctccacgtgtaagttatggtttttgtcattaccaagtctgtcagaagtgacattgtacatttccttctgtgacaaggaaggctaaagaatggaattccacagaaaggcccacctcctaagcctaatcagaaatgcaagtgcatttattatgaccacccccacaaacttcccacccagcagcgctccccacttcaccccttttagtgcagaaatggagagaaggcagccagggagcagctttatctgaaaagctgcaacgtacgaatttaggaaatggatcacgctaaagcctctcccagcacaaattcaccctgcgtttttgcacttgaaggatttcattttatttttgaaaaagtgttgcgttggcccacgcttataactcaaggactttgagcctctgtcagccctgccttgcagttcacagcttcagccagttttctgcattagctcatttcaaatggatctttgacattttaatttcaaaggaggcagattggtctcattaaactgaggaggaaggaggattatacaaataagagaaagacaaagcccatttttaaccctgaacttcccacttctttttgcagccaaggcctcagttctggctctacttaattacatttctgatactacctttgaccagtaatttctttttttcttttctttttttttttttttttttttttttttttttttttaagacggagcctcgctggctctgttgcccaggctgtagtgcagtggcgcgatcttggctcactgcaacctccgcctcctgggttcaagcgattcccctgcctcaacctcctgagtaactgggattacaggcacacaccaccacacccagctaagttttgtatttttagtagatacggggtttcaccatgttggtcaggctggtcttgaactcctgacctcgtgatctgcccaccttggcctcccaaagttctgggattacaggtgtaagccactgagccccgcccttgaccagtaatttctatgcctccttgtcctgccagtcaccctagtacctatgtgtcttcatattaaccctaccacagttagggtttaaataaaatactacaattaagagaaacacccatttcaaaactattactcaggtagccccaaacatctctgtggagtcaaaacattaagcttcatcttcttttggttttccatttggaattttgaagacagtgaagccaggttccttaaagggttacatttttttttttaaatcatttccaatgacagaaaaaggtgtcaaaagttgaaaatccttcctacttcaaagaaaggaacaagtgacacacccaaccctgatcctggtgtagccactgtgcagctgtaactgattcgggaatgagcccaggtgtgaagccagaatctgttccaccctctctctgcagcctggcaagcccaaagcttagaagagttcacgcatccacttccttaaaatgacctcactaagcatattgccaaagaaaactgagtggcaagagaagatggtgccagatgttgcctgccagacacaaggaccagatgcttaagggaggactggctcctctgaaatgcactggaggaattcccccacctcactgatggggaagctccggtcacttggggccactgatggaaagcaaagacaaaggcaatgcaaacattgtcaggatgtaaaggtaacttcttgaccttcaacctcaggtaagttcccaggaggcagtaaaccaagccaccggtagagggggaaccttcggcccgaaagatggctgttcacagttaggtaaaagttcctgggaatgcagtgggacggaaatcccactgaatttagctcaactctccagaagcttccctttatcatttcctctcagccctcttaactcttctgcaatttatgctacagaaaagacaaattccaaagggcctctaactacctggagcaaaataccttgactttttagtcatttcattgtcacacaatgtgactactgggtttatgcaaggaacaaaaactgaacaattgctttttttctgaattaagaaaagaataaggtgctggtgttggggccaatattagcagttgacaggcctaacccttgtgcacaaaaagcactgcacagtgtttcccagtatgacctcccctagatgttctgtaaaaaaaaaaaaaaaaaaaaaagggagggcagggcagggcagggcagggccacagcggcacactcctgtaatccagagttttgggatgcccaggtgggaggatcacttgaggttaggagttcgttgagatcagcctgggcaacatagcaagaccctgtccctactaaaaaaaaaaatctaaaaattggccatgtgtggtggcacattcctatagcctcggctacttgggaggctgaggtgagaggatcgtttgggctcaggagttcaaggttatagtgagctatgattgagtccctgcactccagcctgggcgatagtgcgagactctgtctctatgaaaaaaaacgggggggggttgggggaggtgggagaggagcagaggcttatagtcaaataggtttggaaagtgttctatagtacgttatctcagagatgcatattagtattaaaagcactgaaaagcctttcaagaaagaacattaattttgggaaactggatgaaacagcctaactggtcactaaattcccctttggggtgataggaatcaatatgccgtagacacacttggaaagccctagtaagggttttctcagcctcgacaccattaacattctgggccagacaattctctgttttgggggctgacctgtgcattgcagggtcgttcgcagtgtccctgggctctacctatcagatgccagcagcacggtcccctagttgtgacaaccaaaaacatctccagacattgcaaaatgtcccctgggggcatctgcctttagttaagatatctcaggcccatttcctttagggaacatggtactttaattcaggccagcacccatctcaatctatttcctagttctgtctcaaggaatctcaaacccaaggccagctgtaagccctagagctgccacctgctgagggtgagcttccggttggtgacaccctgtgtgccactgccccaacccacacagacagcctcggctcccccaggcctatgcagctggtgagttgtacagtggcttgtggggcaaaaaggcctcatagagatagtcctctgcagaagatccaaaagggccgtgaacagccacagactgccaagcccagggccttccgcagcgccccaagagttacctcatgatattcgaggcatcctccgcatccgggtcagcgcagtacttgttggcaaggatcaggcatgcatctgctgactctatctaagacaccgaaaggaaaattcacagaacacaaacatataaatagccatgctcgagtgtagtctctctctgttgacagcttcttggggaagctttgcaaagaaaaaaaaaaaacaatcctgagagcctgagagattatagtttttgtcaaaagtgtaggttccaagttcttgttatggtataaacatttcatcttgttgctgttggagggtacaacatgtaccttggtaattatacttttcatttggcatcgttgcttacttgtaggatttccagatttctttaaataacaattaattaagcctttcagtctcctccccacctcctttctcaaccatctgcaccatcatcctaattcttcctatcaggagttggaggtgggtgggttaaatcccttctctccagttagcaaggtaactgagtattggggattcagaaatgtacactctgaagtccttcatctgacctttttcacatcttcattttctataggctgggaagagatcagagctctaaatcagataacatcaccatattgcttagtatccgattagtattcagatattcagaagacaacaaatctatgtatgaaataatgtgttacagttgaactcaaaatatacctactgacttatccaaacacgagcccacaggggtttattccttagaggggaccatgagtttgatgtgctaatgattgcttgcatttaaattaggtccacgaacaataacaattgtccctacgttctcataagattttacataagcaataacttgagttatgtctggataatatcaagattaactggactctatgagcataagaattcttatgctggctcaggtctgcaatctgtcctacttggtatgttatacttaatagatcattcctggattttgagggaggccataatatcctccgtggtatgtcacaaatcatctctgatttctttaataatataaagaaagaatttatccaaatccttttggattattcatcttggccaattatattatttacaaaattatgcggtgaccacagttagcatttagacttcagtgaattcattatattaatgtacaccccctggcatgcaaatattgaacatgcttacaaaatctatattacataggtaaagtagcagatgccattttgccttgtacctttcccttctaagcctcaggtgtgctttatgagaagattctaaattaccagtttctggaaaaaaagattcgcccattatcaatgatatcagataactgcatgtttagttttacaccctgcgtcttagatggggaaaaaagaaagctcaaatgttttatcgcttagtaaaattttattttatattttagcctaatgtttctttcagatgtaaataatagaagtcagagctatattgagtccaacttaagtgttcaatataggaattacttgattattatgttgtataaagctactgggtccatataactggtctacttccttgatgagtagctgattttgaggaatccagcaaagcaagtttcatgttatgaccagtccaagtgtgggatggttataggtagtgttgcatatgccagcagaaggaggtcctgggaccagtggaagggtgacctcaaggttgctggtatgtgattgatctcattaggtgtttaggagatgactcgtggccaacctaggaggtgtgtcccctcagcacagagtcaggactccccccagacccacaccaagatggaataaaagcagaagtcacctcttcctccttaccttgactcttgcaagatcatgtggattgaggacggaaccctgataaaattccacctgagtaaaatgtcgtttgaacagagcttcaagctccaggttgggggagatgctacacagggagagaagaaatcgctattaatttaatggactcgggggtttcagcctccatgggctccttcctctctaatttccacagggagccctggggagaggctgtgacctacagtcacccttttgcttgccataaataaaagactcacactcaagagaagtaaaaccccagcccaactgaaaaccaaaccagtaccatggtaaaagaaagaggttcatgggctttaggaaggccaagacctcaggacaaatgtcttctcttcggtatgaatggaattcctatcttataaatatggaagctgggctgcgccactagtgggatggttcattttatgcggactgtgccagagggtgcccagatccagtgtgatttctgggtgtgtctgggagagtctctggatgagaatggcatttgaatcagtgaattcagtagactaccctcctttgtgggagtgggcatcatccagtcctttgagggtctgaagagaacaataaaacagaggacagaggcgtttgtcccttttgcttctttcctgccggcttgaactgggcatctcttgtcattctcctatccttggactggggttgacattggctctatgactctctggccctcagactcaaacaccaccagctttcctgggtctccagcttgctggtggcaggcagtgggacttcccagcctctgtaatcaaatgagccaattcttcctaataaatctctctagagatagatagatagatagatgtatcaatatatagataccgatatatatctgtattagatatattgatatatatatttcctattgactctgtttcactggagagccctgactaatacaatcaaggattagccgaaggttcccctgggagaggcatcctgctgttccctccatcatgaaccttatctctgcttctgtgtctcatggacttctcatcccccaaggcctggatcaaaaagtatcactctgaggagccacagacagacttaatttactctcattattgttcttgattcacacacatgtatgcgactcatcacatttcttggtgctgatctgtactgacatctttctctttggaggacaaggattaaacaagtgacctatttattcatttgttaattctgcagagatgaaaaagactgtcgataaggtaccgtgctaggcactgggagatgatatttagttagaacctactatacgccaggtaccgtgataagtcaacacttgcctaacatttgtgaagtccataatgacaataataataatagttcatgttttgtaacatttactatatggcagataacattttaaataaataatagtaaaatagtattataaataaataagtaaaataaataatatttatttattttattttattttacttagagtttatctctgtcacacagactgcagtgcagtggcaggatctctgctcactgcaacttcccaggttcaagtgatttttgtgcctcagccttcagagtagctgggattataggcatgtgccaccatgcccggctaatttttgtgttttcagtagacacagggttttgccacattggccaggctggtcttgaactcctggcctcaagtgagccacccaccttgccctcccaaagtgctgggattacaggcatgagccaccatgcctggccatgatgagcattaattcatttaaatctcaaaacaaccctataggcaggtatgttattaacccagagcttcaagaggttaattaactgggccatctactataagtatgacattgatggatgttagggatacaaaggtgaatcctagcaatggaagcatgagcagccagtttttgttttgttttgttttgttttgttttgttttttggagacagggactggagtgcagtggtgccatcttgactcactgcaacctctgcctctcaggatcaagtcatcctcccaccacagcctccagagtagcgagggctacaggcacgtgcccctatgcctggctaatctttctatttttgtatagatggggtctcactgtgttgcccaagctggtcttgaactcctgagctcaagtgatcttcccaccttggcctcccaaagtgctgggattacaagcatgagcaaccacaccttaccagcttgtttattcaaactaaagcagtggatgagagaaaagtggctgcctctgtgaatctgaccagtctttcagacccatgacaagtcatacctcattcagaagcctgcccgggtaataccatagactgatgctccttgaaagagatgtccccagtcacttctgccacctgatcaaaatgacttcagcatcccttggataacacagggttgatgttgtctctaatggttgcatgtgtgttcatcttgaaatgcccaactcatgtgggggcacagcctacacactatacctctagagaactttccaaaacgctcagtagaggatgggccacacagcaggtaatcagtggctaagcactgaatggaacctgtgggtacctgctcctgtgctaacatagcctggtctgttttttcaaagtttggagaaatcagtgcagaaaagagaaatgttggtgccccaacatggtgacaagtcagaagtctagcattctgtgagcaaatgccagaggacgacgatccaccaaacagggagtttgtagggaagccgacctcagtggaacctcagagtaggaccgcgtgctgggtagtcaacagcacgtcaagccagcacaaacatgttagctttgtcctggactttgcgatgtggtgccaggactggccccatgacagccccatctccataaaagaagatgaccatggtaccacacatgtcaccataatggagccccctaattctctccattcctggggcagactaccttttatctaaaaagaggattagtcaaagttgaaaacctcaacattgggtagaagggagataccttgctttcctcccctgtaaaacatacaagataagacctacctcctaagtggattatacaaccaaatatatgttatttttcaggctgatagctaacacttattgaagacttactgcacgcctgactctgctctgcacacttcatatggattaattcatttcattctcatcacagcccaactaggtaggaactactatcatctccatgatttatggatgaggaagctgaggcacagggagcttaagtaacttgctcagccagtagttggttgagtcaggattcagatcagggaatctgagtccagaatatgtatttttactctgtttgtggagtaaatgggagcctgcatgcacagtgacgggctagggtcccatgctgggggttcctaggaacggcagttgttattactattaccttctgtcctgcttcctcttaagttggtgtcttgcttggtcaccaactgactccagaactcctaacgtatccacaccatacagctaatcatcccacagcagataatgtggacacgccagattgctaaggggacaatgatgatgacttggacccacaatgagctccactattatttcttccagagataaactcggatgtggtcccagaatcgcctccacagaggcagactctgctctcatcattgaaccagtgtgttgcttccctttccattggttctgcaatatcttctccaacgaggccaaaagggatcatggcttacccaactctggccccatccccagtgccattccccaagacctccactcttacagacattcagggagtccctcgcagggtgtgtggttgggcagagggtctgacagcagtaggaagctcttacttgtgaagaaaaacgatctccacattgacgtcatcccggtccttgtgcagaaagtccttcaggaagttggaaacactctccagagtgatgtgtccgcagaccacaatgtgcctgaacaggagaggccagttagatcaggccaggcaccacgacaggaccctgcatcccaccccctggcaagacagcagaagccaggcagctgcaggggaagcattcatctcctccctccgcctccataaaagcccagctcccatccccagagggcagtgaggcaaagcagcggtgctagcaggtgctgagactcctagacagaaaagccatatggcttctcacctgatgctgcacaaaatcctattaaaagcccaactgtttggccaagtggttttatgcatttaacaataagtgacattatgcttgtgcttaaatgctgcattatcaagtcccttgcagattcatatctctccctttctgcccacaaagcgtcctccggggagatttactgtatgagtcttggtttatgacatagagcttatcaggtaatgagataacaaatcttgctgaaacgatgattttgtgtgtaagaaagcagacttttatcagggtggctaatgtgcggcctgacacgttataggttctgctggccataagcagtaaaaaggaaattttgcatttttccactataactcctccgacaatgggggcatgtaacactttacagtaagtgagcattactcagggctaaatggggctgggatgcctatggaatggaagatcatgccagctggctgtgcgtccccagagggctgcttccttagggtgcccgggatttccaggagagctaaaggaatttacctcaagatggggagatgctgggaagggatgaggctggaattgctcgccttgtttgagggtggtttggacttctgtttctggaagtagtggctcacccggaagagatgagccccacaactgttgagactgacagtccctccaaccgctcggggctcctggccaatctgactttggcaccaggcaatgtcatggccacttatatgtgccacataatgcccagtcaggagtgagcatttgatgcaagagtcagccacaagacaaaaagccagggactgactgtggagataaaaccactggcttctagtgaagagactgtatgtagcaagaggctcgactcctgtccctgtgccccccaggctcatagtgacagcatctgagtctctagctgcgctctgagacttgggcaggtggtgaacatgcagcatggtaatttcctgggtaaaatttagaatggccatgtcccttgcacttcataattgctctgtgcacattccactaaggcagaaagctcattggctggaggtggctcataataggaggcagtgatgatggcttatgcaatgttccattagatgccattataagagcctgccctttcgttgtaatttggtgcttgactaagtatgtgagaataatgcagtaaactcattggtgaaaggataatgatgcagaacaaagagtaaatcaataatatgcacgatgcagttaataatatcaccattatagactgttattgttacggtggtgcacttagcaatcaggcacgcagcggccaccaaggtgagggaagagtgtcaatgagctacttcagaagagatgtcttaacatgatcactttgctctcctgctaggttgatgaaggtcccttagccacccacccaaattttatgcccaaagcccatatgactaaccccctcattagtatatggtgagtagtatgaggctaagacagtgtgacacacagtgtatcagaatacacaatatagattgaacatttggatgatatgcattttatcatatattttaaaatgtttcttgtggcacatgtacatttacatggacaaaatacttcaaataaatttgcacgttctgaataagatttcagactttgaatttgccaaatatgtttgaagtgaatgagaaacagaattcccctactgacctaacttccttgcaactgacaatagggctactttgccattctaacatcctctgcacatagacttccaagattaggagcaaagccaacatgaatccaatgcgtgggtatctccacaggacagatacgtggctgaggctgttctcatcacttagatgtgaaagtaagccagatgtgattccctgctctgcgaccaagggtgtgggcaaagtatttattcccattcagtgcaggaggaagctgagaggttaataccacccagccggcctcctgtgccaggcattgtaaagttcgaagttctataccagcataagcctggttattactcaaagctaggctcaaatcaatgataggtctggggaaatgcctgaacattcgttcttcctacccagcatgcaaagaactgaatgaacatcagccagcatctcctcctcctctctgaaatcattcatccctaggaaagatgtgtgagaagtgcaaggggaaaagatgagttcccccctctcacccttgaatcaaaagctcagctggctgatttattcagccttagaaaaagtcagggttctcttccttgaaaatgtactgggtacatataaaatatattccaatgcaatcaatattatcccttaagcctttaattaactttcacttctcttaagaagtagacaaatgctggcaagagtgaggagaaaaaaaggattgacttttttcatttggtgctagctatccaataccattctagacaattgaaaatatatatcttttagccacagcatgatttctggggtggagagctgtctttatcaaaaaaggaagaaaaaaaaccttccttcaacgtaattggtatttttgctcagaaaaaaagcgagattgattgaaagcagattgcctttttgcccaaggagagttattaggtacattatcatggcaaccttggagaacccatattgttccaatctgtcctatatctgatttgaagatttatggcctcccccttttgtgccaataatcatttccctccattttgttttccatacagtgaaagttatcaaggagcccacatattgaaaatgtttgaatgcagttagaattgatggatggggagaagctgcctctaactcagcaatcggtattaggagatctgcttccgccagcctgtgtctgaggagggccctgcaagagcatgagggatggatggtgaatggggaacatttatttaccagaaatattttcaagacttttgaagattctagggccatagtttggggaaggatattattgcaggaagaagagaactagaatttattgcatcctcaattattagagatatcaacacaaatatgttaagatagacagcagggtgtgacctcattggaggcagagtaatggttgttcacagggcatgatttgaagaatgccaaaaaagatccccatccaaagttatctctgttgggttccatgatgcctacatatctaccatgtgagattcatactctgatagccctgtgttaactcagctcagacactaaataactaaatagtcttggacaatgtaccaattttgcattttacaattaaaaagccagagcctttgaggggccagagctggtgcctgattcatgaagttatcctgatatctaaggagatgatacatggaagggccaagtaatctgctccatggtaagcactatgaaatggtaagtgccatatggtatctgtaaattaggatgtaaccaatataaagtattctgtggcctatgcaatcccacctaatccttcaacaaccctgtgttctcactgcctgagtcttttcaggtaacctctctgaaactctttccttaagtcatatatgcctggcatcccacagcaagtaaaagtgacttgcccaggatgcaatctgggtctcccacttcagttcccactaagatgaaggtggtggtggaaaggaaagaggcttgtatatctcagcttctgctccttcagggcaagcagaaatggacccacagaggtcctcctggatacatggtggagggggtgttggaggggtcctccactggccaagggagaggtttagtctgggaactggagtggataaaccatcacagttttgcaagatcactagagtctggctggataggcagtatcatgatagtcttagcaaagtctgattacaggcagaaatcataagttccaccggtcaggaactctaagccaaacttaactgaagccatatgattggagcaagctaaggggctgcaaagtgatgcaaatgtccattttattttatattatattttatttattttttagagacagggtattgctctgttgcccaggctggagtacagtggctcaatcagaggtaattgcagccttgaactcccaggctgaagcgatcctcctgtcttaacttcctgggtagctgggactataggcatgccaccacagctggctaattttcttttggtttttgtagagataggttcttgctatgttgcccaggctggtcatgaactcccaacctcaagtgatctgctcaccttggcccccaaagtgctgagattacaggcatgagccaccgcgccctaccccaaatgtctattttagacatgtcatgtacagctcaggacttcctcaccagcctggaatctagaagataataagaatcttaatgatccatttacaatggggaatatttaggaaagttcagctatgagagtagctaaatctctccccatctgtggatgtggatctgaactttcttagaccatcagcgattgtcctgaccaatttctatagggcctgaccactcaatttgtgaagatgaccaatagtcctcaatcaataaccatttctgatctgatgaagtttttggttttaaatgctaggtctggatctgtaaacaaatatttcttgggcaaaggtaacataaaatagatataagctgacaggtcatggcttagaataaaagatccacctcagaaacacaaggaagcatcttcaatgccaaaatagtatccaacggcactttctggagaggaattattcatccagtgtgagcaagtagtgcctggtgctgggtcagggctccataaatatgggctggtttaactgaaaagggcagtgcggtgggtcacggcattggaggggtaagaatgacttcatgagaagaagtttgatgattatgaacactattgagggtcaccataaattcgccagttgcttatttcatgtgcatatcttcactaaatatacatgggtgtgcttctcctgccatttaagcatcgctgcctccagaatgaaatcccacaaattcttctcaatccttctactctcttctcagtgatgggccaggaaagcctgcatgcccaagttgagccagaacttcagtttcagagctcaattccacaggtacacaggacaacctaggggaagtgacttaaggcagaaggcagaagaggacaggagggcagtgactgaggcatcaagagagccactgaagatgacttttaggtctatgacaaggaaaatctacatacttttcccaagcctcagatactggttgttagagccagtagcctttgaaaagggaaactgtgaccatggaatagtcaccattgggccccctcccacgttcttaagtttatctcagcatctgaatgaatagcccttggcaattgtttaatctagcacctttcttctctttgatgtggaaacaggttgcaagatgagtgccagatccagagcacaacacctccctcagtttcatgccttctgatgaaagaaagcagctggtgccagggaggataacctaagctgggaattgggagactggggggcgagttctcagtgacctggggccagtcactaaaatgaagaggcccaggctgactgggctgcacccaccagacactgatgaatcctcacacagggctccagttctctgtccgaccttagttcacacctccatcataccttatctagacatctgcaatcgcttcctaactgatttccctatttactgtccccactgcccccaaccattcccacactccctcaaaaaagccaaagagaagggatggcagcaaatcctactgcgatcaggttctgcgagggcggggaggccttagatctttctttagcagagcctcgctctaggaagacaatgtaaaatgcacagctctgggctgtttatttttaaagatactatatccatttttactggaacgagtataaagaacttaaaaaacccagagctatcttgtcacaataaatcagacagagtaaattgaaaatcctatacagctttgcctgaatacattgtgctcactttgtcaaagaggtagatgaaatgtggcacatattgatctagatgtctctgtaaaactataatatttatatcaaatacatatgctagactctctgtctttctgctgagccttctaattgtgttttcctcgtcctgctcctcccaaaatgcatctcaccattggtagcccctgacatgatgggaatgaattttaagaagtacttctcaagagaaccagcagcactgtatcatacaggaagcagggcgtggggggttagagacccaacgacctaaaccacacagtggtcagcaccaaagcttcacgtttgcccccctaggttgaccttgaacccttggtgtctgcatcaccacctctccatgacactcctgcaagctggcctttcctttccttctcacctggtagtgcttttcttggctacttagtcttaatgcaggtttccctgatttggggcatgtccttcagggttactgtttcccagcgcttcccttgaggctcaatcccccactgccaaaaaataagactaatccaactcccaccttcccacttcctcctttactgaatgtctcaaagagactgacttcagtaaagataggggagacatcatgggcaaatgaagcctaactccaggctgtgctgcctcatccctccaccctaccccaggacctggcttggaacccccaaaacttgctgggctttcaggaactatttgttaactgatggattggttgacaaagtatgcatcttggagactctatcccatggtaagtgcagaaaaaagttaacaggtagttcactgcaagccttttagaccataggcttattccaccaccctgaatctactagcatatttcaagtttgtaagggatctgtacacataaagaaaaataaaaacaaagcaaatgagagtgtgtatcagtcccacaaccccaaaccctgactatcaccatttcctgttaaaataatttttttaaaaaaaaggaggttcagcaataagataatttcctatccatggacacatctagtactttgctaatcacaaaggaaggaaatgcattctccctcctagtgaggaagtgaataaagtaatcttcttctccagctgtcaatggagctgttctggatgtggcaggctgtgctgctgtttccctaaatggggcagaagtctgagcaaatagatcccaacagtgcagcaaaggcacctctaaagcagagccccaaggtcagaggacagacaactggcagccccagtggggaataccgggatgtcccacctgggccaaaactttgcatcttatcgcatgcagacagtcagaacctcagctaccctagagggatctgtgtctacacctccaccatcccaaatcacagttagacctccataattagaccgtggtgagaaatgatcacacatattttgtagcttgtagcctacatggagcctcagtccaagtctttaaattctgagaaactcagtgccggggacattggtagattttgcctgtcctgcatacaccctctcttctgtggacagcacctcattttaatttggggaattgctcctccccaaattaaatacagtctcccaattatatacagtcttgggacctttagtgaaggttttctgcccaagtgaggccaatgggtactcttaaatcttggatgggctgatgctaatcacagtgggagttgattcaacctgatgacaaaaccctgtaatgactactcccgagtttccacttcctcagtgtcagagctgcatctctggttcttttctgtcctttctgggatcttgctcttcagtttttcattggaatctctaaggtaccctaacctttaaaaaaaaaaaacaaaaaacttttcttcttaagtcagcaaaaaaataagtttctgttgcctgcaaccagagaatcctaactggtagacttgtttacctttactttggtttctcacctaattctcactgttacctagtatgcaagtattaccaccatttaggtttctttctctctcctttcctttctttccttccttcctctctggaaggggaattctgcagctttcttcagtaagcaattccacagttgctgaaccctcacaaactgcactgattcctcctatgcctccctccccaacaccctcacccctctgcatcttattcatcccattactttgggcttggtggcctttggccattttaaaataagcaagtcttcccttgacctgaatctcccaatgctagatggttctctgctcttacagagaaatcagggagctgaatggcactttccttttttcagatcaaagcagatttgcccgatttcatttttaatgctgcttctgtacaagcagagactgagagaagactaaggcaggcaaaggtcagcctcactcttcagggatgaaggtggaatagagggagaatgagtccaagcaaagaaatggctctgaattttgcccaggagagggttttgatttacaaagcgagccccacctccctccctaacacccctggtgaatcatgtatcatggtccttgagcacatactgttgggactgaccctcccataatgacaaccaacttgacatatctttgccttgttctccagccacacccaacggtgttgccacagctagcataagctgctagccattcactctgtagactcaacatacttgcataggccccagcagacctccagcatctgttagtcacacagggactggaaggagctacaggttagaaggctggcggatcacctgcggtcaggagttcgagaccagcctgaccaacatagagaaaccccgtctctactaaaaatacaaaattagctgggcatggtggcgtacgcctgtaatcccagctactcgaggggctgaggcaggagaattgcttgaatctgggaggtggaggttgtggtgagccaagattgcgccattgcactccagcctgggcaacaagagcaaaactccatctcaaaaaaaaaaaaaaagaaaaggaaaaaagtaaaaagaaggcatgatacgaggcatgacaggccacagcaggacctttgtggggtctggaaaggagtggacctcaggatcacatcagcggattcccaaccctcccaaatctttctgcacccctcttttactgggtctgtaagcttttaggtgaacaaggcaatctgctattacctatgctctccactgttcaatgggtatgttcaacaacgtgaattatcaaatgcttttgggaggcttccctctaatgtctcttgctttcatgattattgtacacttccatgatttcaatgaataaaattcctgaaaaaagagcatttcactgggaagacgctcctgcatactcaagcttctgtttcactgccactgtttccttgggtggtactgattggtcagaatctcagataagctccaggagagcaagaaccacattttacccacagcacatggtggggattcaaattattgtttgttgagccaatatgttagaatgggagttttcctaaggctgttctatacactagctgacatttgcctttggagtcaatggctaaggtcatataagctcccactgagatgggcacatatctatctctgaactgcccccatgtcctcttgttagaaaggtacaaggaggggagatagattacttttccagcaactggtacccatatttggaacagtccctgtggttctgggggtgacagcaggccattgtgatgcaacaccagtactggctgtggagactggaacccttgggacaagagaatcagatttccacaactctcacaatgtattgacctctataatgttttaataaaaagagacactggacttggccagttagaaagtttcctggtttagtttcatagtatgatgacagcagcatggaaggaaccccaaagctaccaggaaccattttgcacagctctggaaagaagtccagcagagtgaatgacatggtacgaagacagaaaacagggggcaacctagtctggatggctgcaattgttcctgagattctgaatctacccggcaaggattcacccaatcaaaggagccattgatcagaatcttcagcaattataatttgagaaatcatattcgaattattttttaatggaagaaagaatatttgagagtgaaaatctaggcttgaatacgactttttttttaaggtacacagttcatctcccacctacatttctattcttgttttcagaacaatagctggaacattttgctaagtgtgtggaagggaagagtgacagcaggaaaggaggggagcttcattctatcagtattatcaggaaattgatttaatatgcttccaagtctctttaaatagagcttcaagtttgaaagggactgaagatatggcttagaggaatccaaaacagatgccaagaaagaagtgcccatgtcccacgcccaccaagacccctctcatcaggaagggatacctagcacatcacatcagaagacatggcatctaatgacaagcgctttgggtatctacccctcagcaccacgtttcagaagtagtcaagaggtcatttttccaaagtattagggcaagctcattttttgttttccctgttcccaagaagtttaatgctaatcaaagcagaatgcctaatcagtccaagatgttctgtcaacttgaattatctatttgtcttcttatttactgtatctgtctgtctacagttcttcatatctttataaagatcggttattggggcctgtgtttccttctgactagaatcgctaccagatgatccttcctggtgatatgttgatgatttgctaatttatggcttttaaaatctaggaatccaaagacattgctgaggggttcaggctggggaagtcacgtggctcatgcaatgagggctgaatggctacttgatgagggatctaagtctgtgtaggatgcaaagcttcagtcacatttcgaccagagccatgtctgcaatagagaaatcgtaaatgacattttataggaaacacccctcatgagagcagtccgccccttgcaggcgaggaaaagtgagaatagctgttgcccaagacacaagtaaacatggaaagaaaaggcctgtggatcggcccaagtcagtataacatgaaatcatctcaaatccgattcccaagtgctagaggccatgccttcccagaaagagtcgagagggaaatggtgttgtagcaagactctctcagaaccaagagaagaggtttcaataagccctgatattggacttcccaaccacttaggtggccaaatagtacgatgtgtagctcagaaaagctgtggtatagttggagatttttatggatgtgtagaaatgcatctgtccccagtgcctggtagcaagccctcagtaaacacatgtggaatggatggacatgaaggcatgactcgtgttaattcctttaaggtagggtaggctatggggccatagattaaatgagtctttgtaaataaatgatccatgctctggcacactagacaatttaaaattccaaatcctttagaaatcagtctagaaccctggtggacaagacatgagtgtggtggaggaaatggagtggaattccacgttgatacaagacagccaggcaggagggaatagtgtgcgctctcaggaaggaacaaaggttctgagtgagaaggagagtccaaattctgatataaggaaagacacagagtttaaaaataacccaataatcaggaagcagggaagatacgcaggatgccatctcccgataagtcaagcaagcactgctcaggcaggttggggtctgagcgagcaatcagtttttaagacttcctctagtggaggtagaactgaagacctatgtttgcaagtggggcttgcataacctggattttaaaagcaagagtgttagctcccccagcttagtgggtaatgcaagctgggtcaaggtcattgaacaagcgttagttagcatctcctcctctgaggtgtcgcttccttggactactttatccagtgtaactaatccctgtttttctcagttgcagaatcttagtcttttctggttttgcagcacacattaaaaatgtgtaattggcatttgctttagttgtacccttgctcagtgcttgcaacctccttgagactgtaaactccaggaggacaggttccgagggtagtttgttcgccaatgaaccctgagcacccaacaaaacccagcatcatgcctgatgcataacacagagaatgcctgcctgccgagtgagtgaatgaaccgatggagaggggccacaggaatggacagtgaggcaggtcactaactgtgctgggctgtttttagttcttgaattttgttctcaactattgaatactcaattatttcttctaaagtatggaatcctctttaaaatatgagcatttacaataaagaagataattaagtactctagtttcatatttaaatagaaaagcatgacaaactgtccccatctctctgaatgtaaggctctttccaatgtggagaccacatccgaggttgaaggcagacagccctaactccctccagcgggatacaggctcctgagggtgaatattccaagtcaaagctatgaaacaaacacacagaatgcaccctgcagaactggtcacgtggggctctactgtgcctttcactgataaggaagaaaccacctccagatactgctctgtgctgtgcggcagactaactaaggagtgaaagggaacaggtggttccatctgcaagggtatagaaggctctgcaggtgagatctgcccagcagggaagtccaagtttagcagatcactacaattctccatggaactacctttaaaggatggagccaggaaggggaagaaaatgttgaaatccacaaaaaaggcacaattctcactttaggtgtggttcatctgtctgtccttgagagcctttcattgctagaagtgttcaagagggaattagaattctagtctaaccaaatgggaaaaataaaggaaggaatggttttgtcccctctccatctttttcccctcaatcctggggccaggacccttaggggtagtgggtgggcaggaggggagaggagacagccccaaagtgaagctcatgcctttctcttcctctccatcatgagcacggtactctggctccccttatacggaaaggtggaggaagatacaaacaataggagatcactgagtttagagcagaatggagtctcaagagatgacatggagaggcagcaggacgcagggaagcaggctgtccaggttcaaaccccagcccaactctttactagctgcgtgatgtcaggcaagttacttaacctccctgttcctcagtttcttcactcattccaaatggagatgatggtaatacctttctcacaggatcaatgtgaggattctgaaatatgcaaatatttgtaggtattactattgccagagaaggcagtcctggggctttaggctgcactgattcacattctcatttcaggaagtgtgtggcactcctgtctctataggcaaatgttccaagagaagccacagcatttaagtttcacaggcagctttcttgaattggagcaagagacgggttagtccatgacaactattccccaaaccagaatggcggctcagcagcttcatcctgaggaccttccttcaagttaattacactcactttcctctcccaccttggctacatctagtctttcatgactcattcccctctcgtgtgccctgtcagcatttggctaccaggaatcagtagaataatccaaacccatcccattctctctgtcccaaacacctgggcctaggattgcctcaaacttgagtcactcaagtcccaacatgggaaacacaaggtctgggtggctcccggctggactccctctaacaagggggttacagcagatggattcctctctgtgactgattattttccatggcccttggccatgtgaccttggaccacgatcttgtcagttctcataaactaaccaggagtggaatgaatcacactcagggaggagacctctgggggaaactgcaaggggctgtgagagggaggagagagctggggatcccaaaggccatgggagcgtcaccagccctcaggccttccctgtctctaagcagctttgaccttacacaaaggaaaggaggaggaggcagtggccttgggaggcaggctgggctgcaggagggctcccttatgaataagatttagggtatcagcccaagagcccagagagctctaatccctccaactcagagagattacctgcctcagctactcactgaacccttggttgtggacacccaaacccctattcttagatgctccaatccatcataacatacatgaaatagccaacacacacgcacatgtgcacaattacccatacctactgcagggactgggtatccttcaggaggtgatgaaaatgttgggtaaggcactctaggcccttgaaatagtgttgatggtgaagaggctttgagaatgctacttgaaatgtttatattatgccaaacacattgattaaaactgaaaatgaaatgccaatgaaatcttcatattctcaaatatcctgaatttgggtgttgtacaaacaaaaccctgatcttctctgcctaaattttgtactttaaataatctttgaatttcaaagttttatgtctctgtagctttagatcatgagttaccttgagttctctgacaagttaatatattgttagagaaatcatttctgaataaaatatgcacaagtaaacaaatcccttaactatgtatacattctaatttctttctgggcatttatttgattgggtcctggggagcagagaacatgtatgtgtgtgtccatgggcagagcacatggacttatgcatacacaaaaactcagagcacagcacactgttttaagagtctgaactttatctttcaacaaagtttagctgctttccttttgcaaatgcatttaattttatctggaaactttttgacgttagaaatagaacaactgtagtttctcattatgtttgctgccagaatccatgcttggttgctcaactaaagaccttatattgctaattactaccacatgcccatatcccaagcgaaagaaaacttattgattctgacagcccattctctcaacactgaattccaaatgaaaactcaaaatttggccaaacataacatttcatcaatcttgttttactgactggaaaaacaacatcaaacaaagggtgctaatggccctttattaccgtgcctttcccaagcttatattttctgatgaaagatctaagtgaccaaaggccttctttaaactacttagtaattagcttttgaaccaggaaacaatgcataaagtagtgaacaggcccggtgctgatgacaggacggactctgtgtctgcagggtcaggaacagtggggacccaaaaagaacattaaaagcaaagtgcattttcataaacggagaagaaaaaaaagagaaagagagagagagagagaaaaccaggctaaaagcggtgataaaagattacagagccagaacagagtggcaggaagtctgtgatctgaagtcatcagcacctgaaagtttgagtggaactgccagggtgaaagatgaccggatcggactgggggcagtgagtgagtgccgggctgagagccccatctgggtcagctggcaccgaaagctgccggcctccagcccacccaccagctcacccacatttgactaggaaaattatttcattaaaaaaaaaaaatcacctggaatgaaagtcaagaaatattttcaacttagccttcagggcaattgattttattgacttcttggggcagtgattgggaaatgctggcggagacgtcagaagatagggaggccataaagagagccccaggccctcagaatgccttctgctttatggagacctgtccacaccttcaaggcaaaatgaattgagatgctgttttcctcttggcatgggatacatgaccactgggaatctttggacttacttggccttttggatccaaccaatggcccagaaatcagaacagcttggttctaacctcatccagggctgttaagataatattgaggggagggctccattagagggaagatggagggatgtgctgcctcccggaaaagacgccaactggcctcctctggcccactgtcctttgtgcctttgaaaggaaacgggtgtcctgtgggtagttcaagaaaatgagcccttttgtccacctcctcatttcctgtgcagaggcctggacacctgagctcaggaagcactggactcactgaccaaaggggagggtccactctgtcccacacggctgactgtcaaaaagagaaggcagcagtggagggaaatacaatgctcccagtctgattttatttcctcttaaaaaaacaaaagaagctctttaagagttcatttgaaacagaacgagaagggaaaacaaaacaaaacaaaacagttccatgataggaacgtccatgactgggaagaggcatgagtgatgaaagttttctgtgtcctgatccggatggtaggatgatagtgactgggtgtgtacataggtacaagttcctcactttatatgttaaagatgtgtacatttaactctatgtaagttatacctcaaaaccaaaaacaaacaaaggtgactactccagaaaaagctttaaaaaaataaataaaggatggctgctgccagccccctctcccccatggcattctcctcttgaggttgtaaggtactgccctctacttaggaaaaaaccttggggtctctattgaacctgcacattgatatcgagagtgataaagtgatctgagcacacactaaaatagttcccgagaagaaagcattcacatttgggaagccaaacaaaagatttggcaggaatagcatgtagtaccctaaactaccagaaatatactatttcttgcccggaaggaatttcagctgagtaatgagtccctttgaggataagatcggtgcctcctggatgaagaggagaactgggttcccagtggccgcagtgcctttgcagtaggccagatgacctggatctgccacccaaggacttctctgccagagtcttatcctgtgttcttgctacacacaaaccaccataggagggcatcatactagtttgagggaccagaattttatcacatagccagatgatggaagaatgaacgagttttgtttacttgttaggggtcagaagagaaaatatgggcccagttataaatggactcctttcaggataaattcattacatctcttggaatttgtgaatgggagttggtccaagcgtggcaacgtcctcgggtcacctctgacatcacaccccatgcagaaactgggccttccctcacagaagcacccggtggggttggggaggggcagaattcagatggcacctccacagggactcctgaaagtcactcaaccacatcttttctgatgcaactgacttactttctgcctccatgtttgttaaaagtcccgccgaatttattccgactcaggatgagagcagcaatttcgggcacgtagcgggcaaacattgcctacatgcatgaaacaaagaaacaagagccaaaaaaaaaaaaaaatggcatgcagagaggattctaccgcagcagaggcagcaaaacctcttggcatacttactttcttccactaaccgcactataggagcccccgtatttcttgcggtttcctattaactctatgatttcagggacgtagctggcaaacatggcctgagaagataggagacagaagagagactaaaaagacaggccaaagaaaaggggggacctgttcagagggtgggggcactaagatctgaaaacacaaaaggattaggcctgcaaaggtatatattgatatgttggatcataaaaaactaaaagcacgaagagagcaagctcccagaaatacacaagacaaacaaacattggccaccttgacaactaaagaacaaaaaaaaatcacagtcgagaaaaatacaaaggcgacaggaataaataaggtgatatctagttcttcttgctgaagaaaaataggcaagagggggacatgctagtgaaactaaacacacacagacacatgtgtgcatgcacagacacacacagtttcgcaagagaagatcttcctttgtcattaaaattcagaggagaatcaatgcttttatgagtgacaaaagaaaataaacaccaaaagattaaaaactacatttttctattaaaaaaaaaaaaacactgaaaagctcaaaagggaaatttaggaaatcacctgggaggagaagatagcaaggagaaacacaaatctgccatgttttgtccaacaaacatctggcctgtggctggctggatgggtctttttatctataggcacctcacggatgctgtagaaatgcttgcgtgaatgtacacatgcatgtgcacatttatatacatttttaaaatgtataggccctatgcatacaaaacagagagaggtgtatgcatcactacatataaatgtgcgcacggtgtacatacatgaaagctgtgtatggattaggattttaatcactcgcttcataaatggcaaaaaaaaatctaaacttaaaatgagctactttgaaagacaaaatgcagcaactgccaacgtgtggccagaaatcccctcgatttacattagaaggggtggtttagtgcaacataaagagctgcgtagacttttaaaaagcaaacagtgaaactttcttagaagaaaggagcaaaaataccccatgtgtccgctgcagaatggagtgagctgtttgcaaaactgcactctgctcacatggggatgtccgcctggacaagactaaggtgctctctctcctttgatgtagggacccttctctttagggcaggccccagccacagtgtttgttggaagttaggggaggaacataaaggggaagggagagctcttgaaaccgcaaactgtctctacaaagtatcgacagcttctaccagaggcaggtgacagccactgtccttgtagcataccagatgctgagttacattgctaaggggtagacactctcccttattaacagcatcacttttcttaagacaattaggtttgctcctggctaaatggctgtccccgacaagggcaatgtgcctggatctatgggacaagtgtaatacaccaagaattatgcagaaaagtcaccatcgtgtttggatttacttagcctgattgtaacgttaaggcttgcttctagtgcagaatacagtctaaaatacaaagctttaaggaaatgtatcatggaaaatattaacagccatcaaaatcaacatcataataaagatttttttttaccagtcccccgaggatgaagaagaccatgaagaggcgcccaagtgtggtttttgcataaacatccccataaccaacggtggacattgtgaccatgagtaaatagacacattcccagtaggtgagagcctggttgttttggaaattttcccatgggtcccctgaattctccacctaaagcaaatgggacaggggagaaaaaagaaaaacatgctattgaagtgtatacatgcaataaacgcggaagctcggcactctcgaaggccacttgctactgcacaccactctccacacgagatgtgtggttcccgggctgagttctgtgagtcaggatgcagagctcctgagcaggacacagagaaagtggagaagcagctgcaggagatgtcttcctggctgattgagacagagagggaaagcaagaagggaaatatctctaggccttttctcttcttctggtaaaatgtgggaagccagctaaaattcagggcattgcctctggccaggttttagagcactctcttcaaggaaagagccagagattccgtccctgaccttcctcaatgggtttctaaggcccagatggcctggatctgcctctcccacagaaattctaaacacttccgtagggggctgcctccttccatcagtttatccaaagagtatatatgggccctgcttatttctgattcaaacagcatctctggaatctggccctgctctccctcctttgcaaattggcaatggtggtcccagccttgaggctgctggaatcttcacaggggcatggaaagtgagctcatgagaacagcttgcactggcacagcccgttagatcaagggctggcaaactttttcagttttgtgggcgacacaggtcctgttcaactctgcagaggcaaaacttcaacaaatgggtgtggctggatttggagagctttggcccgagactgcagtttccccactttcctgtccttccatcatatttgatctgccaacaaggctagtaggtgggcaggaaaggtactttagatactctcaggagagagggagctgcgggcccaattttactcaaatatgcctgtgatccacccacagggcctgtagacggtggcccccaggcctccacctctgcctctgcaaaatgtttccagggcctggcctctttcacacatcagtttgtcctcaatgtgccattttcacaaaagtttcctggtgaacctgaagggacttcactaatacccgtagtaaggtggggtcatcatcttattaaagacaactatctcctccacatatgtgatttgggtgcttcgtgcttggttacagcaagaattagggtgattaaggttgattttggccatgaatcccatcagcattaagggctgggcaggagactctagatctggtgactacgtgaggccccatgccccaaccactgccatcccaggcctgtcttcctttgggtgataattacctaaatcccaagtgtgggtagctaagcgcgtccttctatcccttatgcaaatagaggctcagccactggtggtcaactttatccaaagtctcagagctagacgaggctccttccagttgtaacagtctatgtttgcatgaaacacacttcccacaatggctgtgctctctaaaagcagggggaaagtctgccttcgggtggtgtgaggggcttgacttaatacaaggctttcaaagagtcactaatgaaaaagaatgaacatttttgaggtacaaatcagacaaaataatcaaaggtggcttttcgtaaggcggaagtggaaagaaattgagggatctgaatttgttgtttactaggaggtgtgggtccaacttccaaccttgtccccagaccttttccaggtgtttgcttaggaagcactgccatcttgtggcttactatagttattgcagacagaaggaaaatctaccaaagcccccatgacaataccaatgagcaatgaactgaaaaatgcaggttaatagtgcaaacattactcaccatttggaactagtttggggtaaaaaggttggaaacccagacaattgtgtggttgcttcccatcttcctgtctacaaccgaggtgaagttaatttccagcaagataaattttaggtaataaaatgactcagagagggtcttgttgcaggcaagcgagagcagaagggtcttcaaggttactcaccaaatggatgaacccggctgcagtcagccacgtgctgataaatatggagagcagattcaccagcttgatggaattactgtgcaagagacaacaagcaaaatccccacgttaccaagggaaggccctgctggggctgccttacagggtaacagcacccgcttagcaggagaggctgccacatctaactcccaaccatttctccattataagggaattctggaaggtggaggaagctgctgggatgaaggtcaggacagagcctagaggaacaaatttaactttggtaaaaattaacttttatttaaaaaactcttcaaatctacagaaaagtggaaagaacagtataatgaacacttgtacgctcttcatttagactgaccaattattaacattttaccacgggtgctttatctccctacatgctttttctcttatcccccccgcccttttttcttctcttcttcttgccatgtacatatatatatatatatatttgctaaaccatttaccaataaatcagagacatcatggcacaagccctaaatactttagcacccaactcctaagaagaagggcattgcacagcataatcacaataccattgcacgcctcagaaaattaaaacataaaaattcagtaatgctatttaatatgcagaccttatttaaatatctccagttgccccaaaattatgtttattgatttttttttattttccccccagacccaagtttcatgcactgcatttggctgttaggtggcttaaatccaactgtcaggaaacaaggacagagagtaaatattttaggctttacaggccatatagacattgtcacaaatactcaactctgtcactgtggcttcagagcagcttttggacatcatgtacaggaatagatatggctttgttccaataaaactttatttacaaaaacaggcagccggcatgggctatagtttgccaatcccagcttcagtcccttctaatgtataattgacaccactcctttgtaatgacattaaattttgtgtgaacctaggttgtcttctataatgttctatattctggatcctgtttatttacttatttatttttattttattttttattttttgagacgaggtctgactctgtcacccaggctggagtgcagtggcacggtcttggctcactgcaacctctgcctgccaggttcaagcaattctcctgccttagcctcccgagtagctgggattacaggcacccgccaccacgcccagctaatttttgtatttttagtagagatggagtttcaccatgttggccaggctgatctcgaactcttgacctcaggtgatctgcccgccttggcctcccaaagtgctaggattacaggtgtgatccaccgcgcccagcccagtttattttttaaataaatgttattgtgtatgtttgaggtttacaacatgatattacctaccatctcacatagttacgtttttgtgtgtgacaagagcagctaaaatctacatatttaacaaaaatcccaaataccatacaattttattagcaatagtcctcatgttgtacattagacctctagacttgatcatcctacatagctccctacttaagtatttctgttaagaatctcttcggggatggcatcacatcaggatatcccagcccaatgactagctccatccatgtggctaaggcagaaatgctaatgtctccactgagaggtgcccatttccctttgtaatgaatatgccaccttgagtgaggccccgagactgcaggaatatcctgctccccaaaaaccttatacctaatagctttagcattcactggtgttccttgagtggatcaactggaccttatgacattttgaggtccctaagagctgaggccttgtctgtctggattccaggagccctgggtccctggagcatagcagacccgtgactctgcactgagtgcactggtatctgcccctgctctctttctaaactgcatcctgttcagtcccactggggtatacctgaacgctgctgtcagcaggtcacttcactgtccaaaggcttcttgttgactaaaagatgacattcaaactctctccttccattgtcaacaccttgtgaagtcccagtctctcccaccacccctctttcacataaactcttgaaactgccatgccagctaaacctatttactatagctattgtttacactatttactcaacttgaaagcccttcccatctagtcaaatttccccattcttcaaagcccagttcaatccctactgcttccttaaagtcgttccatccatctgcaagacaaagtgactttccccggctctcaactccagccattcattggtaattgatcctactgacttaagatgtcttttgtaaagttttaggttgctatttgactcttgtgttccttgctgcatcttgcagaaaagaactctcttttctagctcttgcattttcccagtagtggcttaatgcagcctacagggttgcccaacccattagttttggtcagttcatctctgttatgactgccctctcttacctctcttttggagaaccaatgatttaaattctaggcatttaagatcacagtaatagtttcagctagcttgtttacagttctttcccagtgctcaccacatgtgccaccatcctaagtgctttaggatcacctgtgctttatgtatactaagtcatttaatgctcataacaacaatctttcttcttctatggaagagcacagaggaatccatagtcttagtttttccagagttgattctgacagttcatggaaagaataaacagattcaactttgtgggtgagactgatatttcaaaatgtgtggaacaactttcttctggctcgaaaacttggaaaaacagccaaaatgtccattctgtctctcttggtcatttctagagttaccagattataataattgccaatatttattgagcccttattatgtgttagatgttgtgttaagcagaattctctcctgcctgtaccttgtaagtcctctaaggtgtgctcccacattggagggtaagaaatagatgaagaactgatagccggcgacaaagggaggcctcttagggaggtgtgtgttgttcattttctcagggtatcgttaaataccaagtggcttcacttacatactcctggattcttgggacctgaacacagcagtgtcccaccaacaaccatgtagagtcctcttgagatattaaacctatttagagtctgagtctccttggtgctttggaaaaatgacctaaatatggtgattactaaactctaaatgatggttacagtgatattagtagtgcgttagggagctcttgccatatgcagaacatttaatcattgttgctaaaacagtccatgtttagctctgaaatctgattatttttatgacatcagtattatcacagatccctaggtttaggaatttgctttctaaatgaaactgtatgaccacacatctgaaagctacaagcaaaagatgcaaggttaacccctggtgggcattctccacagtctgaaatgtgaaccttgccaggttaagtagggctccttgggaagaaagagtgaggcacgccaggagcagggctgtgtgctctgcatagcaaaggttatatatctctgtgtggagatagtcatagccttcctggtcaagcccagggatctgggccaaacacgaagctaccagcggttagaatgatttgaaccattcagattctagcctgcttcctaagctttgagggagattatgatcttatcatcaacacctgatccaactaaagtcaatcattctcatgttgcctatacaattcctgagtctccatcccatgagttctaattcacatcgatggacacagtgaatcatgataggtcaggcacaggattcttgtagattagagacctcttccaagaaactgtggatgctgcaagagaaggtctggctccagagattacagctgtaaacccagagcttctggggcctcctttgtcctctatatgtttaacaagacatgtttcagttaacacagaaaatgccatgcactttgtacaaagaagtgtacgtttgtccctgttctgcttgtctctaatttttctctttgtttctggtactgccaggtgctgctggccttgtttgttttactgctctctttgctggacagatgtaaaatacccaccccctaaaaagttaactggactgcaccacactaacataaatggtctgaatgacaacatgagtggaacaaagtgaaattctgccaattcaatcccttaattatctctagatcccttcttctttctctgccccaatttgcactgcctaaggccatgccctaatacctcttccctggactactgcctcctaattggtcttatggtctatgaggtctttgatgcttcaaccccattctctatacaactgttggaatagtggatctttctaaaatgtcagtctaaccacatttcctctcctgattaaaatccttcaacagctctcatttgttctcagtaaagtccatgaatctaagaacctgcatgatttggcctctccctgcacatctcttgcagtctccatatagaatactcttctttacaaactttatcttggagccatttctaagttcatgtcagtagtaatgttttagtttcaaaaacgcctcccaaaaccatattggttaggtacacgatgactcatgcatatcatggaatgctatgtgagaaacaaaaggtgacatagtagatgtaatcattatctcaaagtagtgtgatgtggaggcaattttactttatcctatgtgattttgtgtgttgttgcaatgtttaccatgaacatattttcaaaattagaggaaacaggctgggcacagtggctcacacctgtaatcccagcactttgggaggccaaagtgggcagatcacctgaggtcaaaagttcgagaccagcgtggccaacacggtgaaaccctgtctctactaaaaatacaaaaagtagccaggtgtggtggcaggcacctgtaatcccagctactcgggaggctgaggcaggagaatggcttgaaccctggagacggaggttgcagtgagctgagatcacgcccagcctggacaacagagcaagagtctatctcaaaaaaaaaaaaaaaaaaaaaaaaaagaaaagaaaagaaaagaaaaattagaggaaacaataaggaaattcccattttggaaaaaattgctgagtgatccatgttttagtcatcaatatttaccacagtcaatgagatgtggaattacagcctttaaacacagctgctgactttcctctgacagtagaataagtgttctagcacctgtgtgttagatctccagtttgcagggcaactgagaaactgccaaaacctcagatagtgagagggagtctccttgtctcccctttaattggccgtttcaggctatggagtattctaggccccctatgggcttgcagtttgggaaagggccctgatgctggtcacataattgtgatttgcccatttcatcccatgcactttaattttccttctgctgcattcttaattctttatcaatctttctgcccaccttatgcttctctgccttatttctttcagctcttggcccagtgaggcagccaaagtactggaaatgaaacagcaactccaaatcattatttcaaattgcattgcaaagcctccatccctgcctaatgccacagattggcaggaattcaccgccaaagagagccagacaaaatctccctaaagacgattacatgggtcccccaacccacccttctggaaggaccgctatgaaagcagcagagtatggaagagtcacaggagaatcgctcaaaagtccaaaaccctacaaaagccaaggctgcactttctctgggacagaactttgggatccacacttggggatgcccaaaaggaaggagccaagattagccaggctggcacctggagagagaatggcctcagagagttgtcctaaagcttctagatttcttacaattacatgacgtttgcttctgtgcctggtgacctggcctttcctaccctcttaacctcatcctcctctttccatcacagaacgcttaatgtccaggagtgcagaattacccaaagtttccccaagtgttatgctctcacaccagtgtgctgttagcatcttccttgattagaagtcaacccccaccctacccctcacatgcccagccccatgaggatgacacttttttctacaaggcttacctaaaagtaaccttctcctcgaaaagatccttgactgccctgcaactcaggctaagcccagcttagttactcccctctcaacccctgggcatgctgacatcagcattaaccacaccgtcaggtggcctggccccctacgcagcaagttctctgacagcaggactcctagcatgcaccttgctgctgataccaatgggtgctcactccaggcttgctgaattatctcaaccatctggttatgaccataagtgaaaggaactctgaaaacccaggttgtgggtttgtggcaaaaagcaccctctaacaacaagagtttcatatagtgggaagtggggtgctggaaaaaggctgttttggggcccggatggcagatgcccagacagccttccaccccgtgactcttccctagggccattctctccctcgtcccctggctggctgcttcagcttccccgctctgcactgagagaggcagcactgagtgcagttggcaggtgagctgacaccagggatcccacagccacttcccgcatccaaaggaaagagaggtgagtgtcctagcagaaagtcagaaaaagatattcagatggtccatcattttctcaagttctaaaacggtccagggagtagacagtattcctcagagcaatggaaccttctcaaaatgctggcatcagagaataaaaatccccctaacatatgatgtaattgtgaaacagggagagacagacactacccaatgttagagagtgtcacaaaacaccatccctaccaaaaaagtaagtgtctcttaaggacaaggctctatgcttggtgctgggtactcacgcgttccatctttaaaacacagtctagtggagtgaatctgacatacgtaaatattggcgagatgctagcttcattgatcgtttacatttcaaaagtaatatgattctagcacatagaagaataattaaaaggcagaaatcaaggttattggcaatcagaaaaacatgaagaaatacaatattcactgtatgtgaataatattacattattgctaataaacagaggactgataaattcttatctcaggataatgaacagtaaaaggcaggaggacatacttttaaagacttcagtgccattggattctctttttcttttcaacttgactaatagaaagtgaatttgacctcacagtcacatagatgagcagtcagagagaggaaaccaatttggaattaaagcaaaataaaataaacaagcaaaaaaaacactaacacccaaggagtaaagccaatcataggttgaatttgttggctgtgtcaggttcattcaggaagctaggtcccagcctgtgttaccaggaaaatgatgctgaatctaatcctcaaaactacagatatattaattacaaatcacaaaatatggaggtgtcctgtttttaatcatttatcaaatgcatgaagggcaaccaaagaggaaatggaacattagaagttagcttcttagagtgtaatttcctagaagagaaatttatggcctgtacttattctccattagagcacgtctaacctcttttattagtttattcatcaagacagccttggtttcaggccagctctgcaagccggcaggtcatcaggaaagggatcctctgggggcttttcctcctggtccagttgtgttttccagatcataacgcagttaacagaagtattcatggtgcattcggcaggaggtttgtaggttttcccccaaaaggcaattcacagagaaagccccaagggctatacggatataaagtgaacatctaaaatgtgctttgaaatgaaatgattttctgtttgccgtatgaggtttgtgattgcctctcacagcattgcttctattgcctttacgactgggttcaatttcttatttagtgatgtaataaaggggcgatttagaatctggcagcaaggacttcccaatcaatgagcaaatctatccctcattcactgtgcacctttccccttgacaccgtggctcttatctgggcaaccccactgggcacacagatatcagctatgtgtccctaaaagtgtccctacttccctgcatgcacagctatttctctcttttcaccacatagttccctggccctgcagaagagagcaactcaaaccctactctggttttctctccctctctgtgttagatcactctttctgtgaataatataactattaataatgtcattgtgatgaaagcaagcacacctgatatttgcaacttggcataggggactggaatgaaaaaaatatgacgaagaacatcttaccttgttttaagaatattcagaaactgcaaaatttctgaaaactgtatcagtctcagagctcttaaaaatctcaaacctggaaaaaagaatgaaatagagatgcattattttcaatgtgtgattttaatgttcacagtctgccatttgatttacagttcccaagggtcgaagggatgggaagttcttgcagaagataaaccagctggtacctcagacatattccttcattctgattcttgactggtttaatctcgactgggaaatggactttctctttataaaggtggcctgtttggaacctctttagaggaagggctcatggggagaagccaggttaatgagacttttcatttggtgatctctgattgaaagcactgtttctaagttacctagttatctggcaggattttgtctctgaaaaatcctaggaattgtgatagctcagggtaacccttgtgctaagagcagattgagaataaatcggataaccttatgtctttgatggattttattttttatctttatcttcagccctgataaaatgaagagtacagcccacagtgttatctgttttctacaaacttctatattttcctcccaataaaaaaaaaaaaaagatcagtgagatatcacaccccacaacttcaggattcaaaatttatatagttccccttttattaagtgttaagataaatggtttgtcctttctaaatcaacaacctctcttgaatgaaaaagaagcatcagtgtttaggtggcagaagagagatggagaaggaaaacacatcaaggacattttaaaaatgcaaattattatgttttaatagctaagagtgaattatatttctgttcaggtgaaattcatggtcaaaacattcagtcagtcctgggctataataatttggctatcatgcaagggaattacttacaaaatgctggtttgtcaccgctttgagacacattgaatgtcacacccactcccaaggggattttcttttgcagactttctagaagcattttattaagcaccgccacgtgccaaaggcagtgcgaagccctccagtgcactgagttgacagacaactccacgcccgtgggtggggctttgttctcccacgcccgtgagccagtaaagggcagcctagggcacagtggtgggaaggaatccttactaccttctacttgaatgaggagtacactaactgcacgcaacgtggagctgtttaggtaataagggaaaattaacttaaagttcatggggtgggggaaaatctgtacaaggaaagagggagaaaaggattggctcaaaaaaataatttctcatctgaaaaggattaaccatcatgaacagaagactttttttgaaaacattctccttctatgctaaataatacttatataacttttattaaataattgcagagatgagacgggatgttgatgaaataaaaaggctcacggccaaaagcacagttgtaactgagctgatgaaaggctgacttagcaccgctgaaaaccgaccacggcgcagagtacaaaactaagaagtcacctcagaaagcagagaaaatatgagaaagggagaaaaaaaaaagatgaaacttcagaaaatagaaacacagtagaaatcacagagatccaacccatggataaaatgtgttggccaaagggaagtcaaaacatcacattgatcataagcaaaggccaggacataacagaaaagaacttttgagatatgaaaaaatgactggagactaaaaggtaaaatgaaggatcagttcttagagaccaatgccaagaagcatctggcttttcattttcacatttcaagtattaaaatcaagcaataaaaataaaccaccagtgttgatggggttatttaccgttaatgtaactaagatcattatatttaacaaaaagtgttggccgggcacggtggctcatgcctgtaatcccagcactttgggaggccgaggcgggaggatcacgaggtcaggagatcgagaccatcctggctaacacagtgaaaccccgtctctactaaaaaacacaaaaaaattagccgggcgtggtggcgggcgcctgtagtcccagctacgcgggaggctgaggcaggagaatggcgtgtacccgggaggcggagcttgcagtaagccgagatcgcgccactgcactccagcctgggcgacagagcgagactccgtctcaaaaaaaaaaaaaaaaaaaaaaaaaaaaaaaaaaaagtgttaaacagcaattgggcaattttcagaatttttagacaaacagaatttgacccaagatttttatacccagtcaagtggttgttcaagaataaaagtaacaaaaaaaatttcaaattctaaggtctcaaaaaatacattgtttgctcagtgtgtgcataaagtttccaaagaggttcacaagacttgctaaatcagaatgggagggggcaagggctggaaattaaatttataacagactctactgctggtcctaaccttccagcccaacctagactgttatctcataccagtatcactgtcgcatattgctgagctaaaacgacaaatgtagaaacgtggagtagaaggcgactggcagttagcactgaaactatgaaagataacaacactcttccatgttccttgagggatacattccaagacctcccagtggatgcctgaaacctcagatagtgccaaatcctatatgcattatatacacacacctacggtaaaatttaacttataaattagcacaggaagggattaacaatggcaataataaaatagaacaattatgacaatatgtaccagcatcactatacttgcgctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaacattatgaattgtttatttctagaatttcctatttaatattttcagactacggttgcctggggataactgaaacctcaggaagcaaaaccatagataagaggcactcctgtagaaatacatgctagcaatgtattagccatttagtgtttaatcctgaacattctgtgtgtgcatagatatgcttttatttatggaactaaaaatagaatacaaacaacctgaacttcaaactggatttcttctttttatctttaaacgatggtgtttgtatcgtatatccattgctgattggcagcttgccacatttgagtgagttacacaaatatagtagaataaaagcttttcttttaattaaggtgcatgaaagtaagggcaggaaagaaatgaatgcagaggccacaaggtcctatactcttgctagacacaaactgcagatctagctctgagcaccttcttaacaaaagcaagcaggcagacaggataagatcaatagtgtatacatatgagagaaaaacaaactggcttgcaggagaatcatttatttttcccaacatggagaccagagggaaatatctccttgcaaaagggacccagggtgatgcaggagcaagacccctgtgggctgaacaagggtggcctttgcttatttgactgcctcatactgggcatttttatggcactgagtttcactaatgcaaatgagccaatgaagttctccataggttaaaaaagtcagtctacatttcatcctcagatcaagccagactatctggagaaatggttggtctttcaggaatcattcacaatagcttccgtattagtccgttctcactctgctaataaagacatacccgagactgggtaatttataaaggaaagaggtttaattgactcaattccacagggctggagaagcctcaggaaacttacagtcatggcagaaggggaagcaaacacatcctacttcacatggtggcaggaaggagaagtgttgagcataagagggaaaagccccttataaaaccatcagatttcgtgagaactcactatcacgagaacagcagcatgggggtaactgcccccatgattcaattaccttccacagggcccctcctacaacataggggtattatgggaactacaattcaagatgagatttgggtagggacacagccaaaccatatcagcttcctaaccgctttctgccctggaccccttgtgttctctgctcagaagcctccaatgccacccattccacacagagtaaaagtcaaagtctttcaaaggcctaaagcaacaccatcccaccaccagcactatctccttttggatctgatggcttcctactgtcactcctactactgtccgctgatctggcagatgtcttcagtgacacttgaacacacaggtatgctactgccccagggcctctgcacatgcagcctctctgcctggaatgctgtttgccagatgcccacatggcatactccctcacctcctttgggttcttactcaatgtcccttgatcagcgtgactttccctggctacccgacctaaacatgcaactcctcccacaccacccgtgcaactccctatcctctttcctgcttcacttttctcctcagcatgaagcactagcacctcggttatgtggttactttctgccttcctctctttagcatcagctctatgaggggaggagctgatgtctgttttgttcagggctatatttccagcattgaacatagtgtctggcataaggtgaaggctcaataaatccttgtttgaactgaatgagtgaatcaaagttttgagaaataattagacggcggagttaaaggttagataatccacattcagaattctgagactatatgttgcctactaaagggaaaagccagaagccctgcggggtcccctgagagaggtcagggctgcactcttgggaagtagaaagtagcctcatcagggaaaagccttaacgaatgaccactctggctatacccagaaagagcccagaagactacagacagcgacttcaggctaagagaggagaccaagataagagaggtgagagggggaactctttggtgacaattattcatcttctctattttataatatcttttattatttttattctataaaatctctgaaataaatgattttctaaggtaacacaaaatagctataatagagttgtgaagaagaaaatgtgtatataccaaaagccaggaattacatgccctccccaaaagcttccaggttcagagagttttacaagtgagatttttacagtttcaaaaaatagtaacttctctatctattctctattatatgatcaattcttaaaaatggacttatctgtgtttttccatgctctgtattggtttagaaagttggcattacctggacacaagttcccttgcattttttcttaaatggcaagcttatcacactaatgactaacaacaataatcctaaataaaatactagggtatcatatccaagactgcattaaatgaataaaagacatgagctatagcagatgctgtagggtacagcccaaatcccctcttcagggaccttatttgtcctgggctcttgaagagtgacctgctaaaggctcagagctagtcccttcatgagaactgccctctgctacaaggagctgcctcacctggggctacatcccctgtcagtggtggtgccccccacccccccaccccccccccaccaccacacacaaatgctggctgatgtagggacaaaggtcagctgccttgcctcaatttgggatactttttcctgtgggatgggttgaggcttcccaggcagctgcagccagcctgagttctccacccttattccctcacaggcatgggcattaaatcctaccctggtgatctgcataccagaagaccgagcattctaagagtccatgtgggcatactggaggcactcagtaaatggtaatttcatcatatgaagaattacaatagcgtaggagtgtacacacgccacagaaaagtcatcaaactggactagaaagcccagaaacacacacacaaacacacacacacacacacacacacacacacacacacacacacacacacagagtacatatagtgttactattattttaaattactggtgaaatgatgatgttgacaatgacattaatctattattattgatgatatctagtatgtttatttacttacacacactaaaacttctaactatatcttttttaaaaaatacgtacacagaagaaaatagctaaggagacacaaatgagacagtgtatccagcatagtttgaaagcaacagagccaagtttcaccacaaatgtgacaaactccacaaagcccaagcttctagccactgccctgtacagacttcagccagtcatttccaattcagacattaggactcaagcacacactttcaagacttgtgatacatcttaccaacttgtcctcacaatttgcattcccttcagtatgcaaatgctcttttgcctgtattcccactggattgagtacagtgatagagaaaataggaaggaaggaaggaaggaaggaaagaaggcatgaaggcaagaagggagagaaggagagaaggcaggaaggcaggaaggcaggaggggaaagggagagaacgagggtaagaatcccaatttgaggtcgggcatggtggctcatgcctgttatcccagcactttgggaggctgaggtggactgatcacttgaggtcaggagttcgagaccagcctggccaacatggtaaaaccccgcctctaccaaaaatacaaaaaattaaccaagtgtggtggtatgtgcctgtaatcccagctacttgggaggctgaggcaggagaatcacttgaacctgggaggtggaagttgcagtgagccgagatctcgccactgcactccagcctgggctacagagtgagagtccatctcaaaaaaattaaaaatttaaaaattaaaaaaaaaatcctaatttgatagaccccaaataagagctcatggctgttttattttgcttttctatcttaacaaatgaagctaattattttttcatataattattagtcattttattttcttctctaaagtgctttagagtggcctttgccagtctgcctgtgtatttatcttaattgtagtaatacaattatgttctcatataaagaagattttgtataccatatattatctcccaccgttcgtcattcttctcaatttggcttaaagtatttttcctactgtcaaattttacttaaggtgggtttctttccccatgaattctaaaatatatcaatctttctaccatgttccctttttttaaaatttttttggccatccccatcatatagataatttttttttttttttttttactgcatctatttttttttctttgtacttttggggcactggttctggactttgactgtacatttaaatcacctgggaaacttttagaattgttgacacctgggtctcagcaccccctacctgcattctgatttaatgggcgtggggtacattcaggcagagggagtattaaggctccagagtgattctaatgagccatccaggttaagaagcattgcaaactttttctataaatgaacatatagtaaatattaataaatattttaggctgtcacaacgactcaactttgctgtaaataataggaaaacaaataggtgtgaccatattccagtaaaatgttattcatataaataggccatggacactaattttctacacttgctttggaggcatgggattcaaatccattgtgcacatgaatcacctggcatttgtaaacatccagattctgactcagtgggtctccgatggggcctgatactgtgcatttctaacaagctctaagctatcgtcaatgctgttggtcagaagaccacactttgggaaaacaaggctgcaaggcagtggtccccagatttctctgccattgcaatcacccgaggattttaaagcaatactgaggcctgcttcccaccagattcaacgggtctgggatacaagctgggcatcagaatttttataaattctgattcgagtgtgcagccaagtttgggaaccagtggttcagaatatattttcttttctctaacctttaatttgttaatctgttttgatgtatttatttattttggttaacagtgcaccaaaaggaccaagctttatttttctaatcaagaagattctaatgtacagccagatgatggatgaggatgagtccagtgtacagccaagtttgggaatcactgctttagagtatcttttattttctttttttaacctctaacttgttaatccatcaggatgtatttatttattttggctagtagtatgccaaaaggagaatgctttattttttctccaaatagcaaatttccgttaatccgagtaatcacttgagtaatttaaaaccagtaatctaccctctaagcacactaccagtctatttaaatcaattttaaagaacatactggctaactagaagttaaatcaataatacaataaaagattatttataaaacaaagcattcagcttaagattttgggggaaaagtagtcttgacaataggagaaagctgattttttagttcagtgtttatgactaaataaccagaaaaccaataaatatgaaaaaaaattttaaaaatctgtagaattttatgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaacttcgaaacttgatacacacaaaaaagaaatccattataggataacaattgagatatacattgaaatatatagtaacagcttcccttacagactctgcacccatatataatttatgattaaattattgcacatacattttattaaaattctaaactgttccataatacaaaacgagatctaaagctactaacttatattataaaataaacataaactgaggaccaaaaactgactctcaaagcacaaaaataaagtagaaatggccctcaacttacaatggttcaacttaatgattttctgacttttcagtggtgcaaaagtgatacctattcaccttaaaccatactctaagtattcacacaaccattctgtttttcactttcagtacagtattcaatacattacactaaattttcagcactttattataaaatatgctttgcgttagatgattttgcccaacagtaggtaatgtaagtgttctgagcatgtttaagatagggtaggctcagctgtgatgtttggtaggtgaggggtattaaatgcattctcaaacttaaaatattttcagtttatgatgggtttgtgaggatgtaactccatggttaaattgagaagcatctgtattctaatatcactaagatcatagatgccaaaattctgtatataataccaacataaattattcatcaatgaattaaaatgataatccagagcattctagttaaacatagcagatggatcacaatggtttatgtctgccccctctcaaaacttcactaaactaatacaaatgttgagggggtaggaaacagcagaatcccacaagaacaaaaagaatggaagaggagattacaacacagaacagacgaacacaaaatgtgggtagatactctgttagaaactgacttggcatacatatatatgtatttatttatatttatataaacatatacatatattttccatgtatatatttccataatgagaaagaaagacatatacacacacatatgtctatctccacaatgataaacagaatattaaaaatgtctttggtcaatacataaagactgaggttgatgggggggtggttgggatgcagagatcacagtgaagaagaaaacaaccatccaaaaggtgaaatgaagtggctgaccctgggaagaaggaggctgtgacaataacactgattgactggggtgccaaacaggagtagtcactacatggcagcaagtgcatacacttgaggtgttaaaatagagcaatatcctgagtaaactgtaactcttggaagaaacacactgtctctacagctgtaagaccagttaccgaatagaaacacacagtagcatatctcagtactccccagacaaactgcaacacacaaagacagcattcacatataggctaacagaagatctcaaatgcaaagataagcacaaaacaggccaagcacggtggctcatgcccgtcatctcagaactttgggaggctgagcaagactccatctccaaacaaaaaaacactgtcaagtacatctacatataaccacatggatgaatcacacaggcgtaacactgagagaacaaggcctgacacagagtcattctatataacccagttatatgaagttcaaaactgggcaaaactgatatatggtcaggagagtggttacctttgtggggtgtagtgactagaaggttgccaggagaagggactagggggtgacaggcaataatgactgtttcttgagctgagcgttggcttctcaaatgcattctcttcgtgaaaatttatccagctgttgccaggcacggtggctcatgcctgtaatcctagcactttgggaggctgaggcaggcggatcacttgaggtcaggagttcgagaccagcctggccaatatgatgaaaccccatctctactaaaaattcaaaaattagctgggcatggaggcaggcacctgtaatcccagctacttgggaggctgaggcaggagaatcgcttgaacccgggaggcaggggttgcagtgagctgagatcgcgccactgcactccaacctgggcaacagagcaagactcggtctcaaaaaaaaaaaaaaaaaagaaaagaaaagggaagaaaagaactaaagaattgccaaacatttgaggaaaggcaactttccttcaagaaatgcacatattacacttcaggccaactgacccttaaggatacaacattaacaaagcattaaacaaaaaatgctttagaaaaatatttgaaaaatataaagagttgtgaaaaactatctcaactcaaaaaatcaactaaatatcttagcaattaaaattttgaacatcaaaatcttaaaaggccagcttaatagaagaatgggcatagccacacagcaaagtagagggctgaactatcacacagccatcttcatacaaaggggcacaggaatgaaaagtgcaaaagaaaaactaagagacccagaaaacaggaataaagttttccacatccatgtaattgagctgccagaaggaaaaaatgaaggaaatagagaacaggaaacatttaaaataacattaaagtgtcctagaccgaaagaatgacctgtatcctcagattggaaaggtcttttaagtgtccagcaggttaaattttttttttttttttttttgagatggagtctggcactgttgcccaggctggagtgcagtggcgcgatctcggctcactgcaagctccgccccacggccagcagattacattttcaaagacctaaatccaagcatattgtggataaattttataacatcaatgtgaagaaataaatcccttcaaagcaacaagagtcaaattattgtcacaattctcctggcttcactggttgcaagaaaacaaaagaaggatatctttacaattctcaggacagattaatttgaaccaagtaatatatacttagccagttgaaagaaaaataaatccaaaagaagcaagatacaagaagcaacatggaaaagataaaagtaatggattcatttatgtgttgactgagtatgttttaaatgaataaataataacaatgatccaaaattaaaatctctggaaataaatggaagatggaggtgtgaaggagagagggcaatgggaaaaagaaaggtgtgcagaaattcttgtcttgataggatacaatcaatcatatatattaacagaaaaaaattaaagtatgtgtatcaaaaccttaaggatataaattccatagcctagagaaaaaaaaaaggacaaaggaatttaatcaaatggagaaaagaaaaaaagaacaaaaacttcagcccatccaatgaaaagaaaaaaaaaataaaaggtatattaatcagaaaacatagttacaatagcaaaagagtccaaatatatttgtaatcataataaaattaaattaaaattactttcacctatggaaagacagagattcacatgatatgaaaacaacaacaataataaattccaggcgcatgctatttaaaagacatacactgcaaacaagacatacagaaaagttagaaatgaaagaatggaaattatgtgcctggcaaatgctgagaaaagaggaacaaatagagcaatgactatatcaaataaagtggcagctactgcaaaaagttatataaaaattatatataaacattatattaaaaagaataaaaagtaatatctcatattgataaaagaaacaatccacaaagaatgtgtaacaaaaaaaaactttatacacctaaaagtattcctttgagataaataaagcaaatatgacaagaatgcacaaatataggacatttaagtagcatttaatcccttgggatatattcgtatctatatgtatctgaatggatgggcagaaagacacacacatatattagtaaactaggaacacacattctttaataacagccatgagcagtctcaaaaactgaccacatattaggccacaaagaaatttcatcaaaatctaaaatgcaaaaatcatctaagtcacatttaccacaaagcaatagaataagaaagtaataagagcatggcaacaatgactaagcagtagagaaatagactctattttatcagaagaattttacagacaataaagaggtcatcacaaatcaaaaggaagacaggcatcatgcaatgatggacctcataccataatggaaataagtttgagatgaattaaaaattaaatatagataataagggacagaaaaattgaggaaaatataggtatatattattagccctctgaaaagaagaatttctaatttcatgtgtaaaaggagtcatacaatctttgaaatacaggctctgccaccaccataaaaacgtcaaaattctgcatgtttaaaatcataataaacacaatatccaatgaaaaaataatcaaatatgatacaataaggataaattctttgtaatgtcaaaagcatgtatgtaaaatactttatcattagttgataagtaggcaaaaatcaaacagctacatcatgaagtagataatataactagtgaataatcattaaataaattaattaaatgaaactattttatcttaacttggttcaaataaaaaaaatgtgcaccatatacaaaaaccaactcacaatgaattaatgacttaagatccaaaactgtgaaactactagaagaaagtattgagaaagagccccatgacaacggtcagggcaataattttttggaaatgacccctaaaacacaggcaataaaagcaaaaatggacaaagaggattacatcaaactaaaaagcttggcccaacaaaagaaagaatcaaccgagtgaagagaggcggggcgcagtggctcacgcctgtaatcccagcactttgggaggccaaggcaggtggatcacaagatcaggagatcgagaccatcctggctaatacggtgaaaccccgtctctactaaaaatataaaaaattagccgggtgtggtggtgggcacctgtagtcccagctactcggcaggctgaggcaggagaatggcgtgaacccgggaggtggagattgcagtgagctgagatcatgccaccgcactccagcctgggagacagagcaagactctgtctcaaaaaaaaaaaaaaaaaaaaaaaaaaaaaaaggaagaaagaatcaacggagtgaagagacaacctacagaatgggagaaaaatatttgaaaactatacatctgataagggcttaatattcaaaatatatagagaacacatctcaatagcaagaaagcaaatagcccaattaagaaatgggcaaaggacctgaatagacatttcgcaaaagaagaaatgcaaatagccaacagtaaatgtttaaaatgtttgacatcactatttatcagggaagtgcaaattaaaactacaatgaactatcacttcacatctgttagaagggttattatcgaaaagacaaaaggttaagtgttggtgaggatgtgggaaaaaggaacccttgcatactgttgatgggaaggtaaattagtactattttccattatggaaaaaggtaaaaagtttccacaaaaacccaaaaatagaactaccatacaatcaagcaacctcaccactgggtatatattcagaggaaatgaaatcaacgtgctgaagagatgtctgcactcccatgttctttgcagcactattcacaatagccaaggtatgaaatcaaccgcagtgtccatcaacagatgaatgaagaaaatgtgatatatatacacaatggcatattattcagccaagaaaagaataaatcctttcatttgcaacaatgtggatgaacctaaagtttatattaagttaaataagccatgcacagaatgacaaacatcacgtgatctcactcatataaaacagctgatctcatagaaagaggggctggggcggttggagggaagggtggttgggtagatgttggtcaaaggatacaaaatttcagttaaataagagaaataagtttaagatatctactgtattacatggtgactatagttaataaccatatagtattcttgaaaaatgctttaaaaaattaaaagaaatgcaaattaaacaaaaataagtaagcactgtatttattctacttaatagcaacatatttgagcttcacctagtggagatgactctacaatgaaatagtcttataattccattgtggaattataaactgataaaaccttttcagaaagtaattcagcattattaatcaaagtaattccatttctgggaatatagcctaagaaaatataacaaaatatggaaatatgctacagaaacaaagatgctcattgcaaaattgttcattaagcaagaaaaatagaaagcagcttaaaatccaaaaataggtcttacgtctgatacatcttctttataggatattatatatgctcaaagattgtaacaaggaaaatttttgacataatgttaagttaaagaagtagaatgtcgaaattaaaatagcgattaccaggagctgaggggagaggaaaaattatttgtttaatgggtttagagtttcaactttgcaagatcaaaaagtactggagctctgttttgcaacaataggatatacttaacattactgaactgtacactaaaaataattaaaatggtaaattttatgttatgtgtttttcaccacaattttttaaaaatagcaaattggaaatgctgaaaaaaaaaaaaaagaagtaaaagatgaagtgcatggtccctatgataaaactatgaaaactataggtatgtgtaaaatgaaaaagtagaagaaaagcataaaatgatgacagtggccatgttacaaaggcagacattttggatttctttaatattcttgagttttttaatttttttgtaatatttatatcaaaatttctatttttatgcataattacttattgctgtagtcataaagtcagtggcaagtcaggactggaatacaggttttcctggctccgagccctgtactcacatgcaagattcagtcacatgagaccattggctccaggtgaggaggaccccctgccagagctttcccttcgaaacttgctgcccagggcctgaacaactaggtgaggctcctcctgagaactattgctgtggaattttagcaatgaccagacagattaagggatcttgaactcccttctcagataaaagcagagttactgtactgacagaaattgagggataaacaggtaaatgataactcattcactgcttcagggttcctgtgatccccagagagaaaagactctggagattcatacatgtgaggtctcgggagaggacaagacagaaaacacaacagcaaacacatccaagcccataccagaaagcctgccagggttttccaatttgctattttccattccctttcactccttaatctttaaatccaaaaagctgaaaggttccaataaacgtctgtcgtttccaatctctgcagccccacgcaaatcctgaagagcaattatttttgtggtgtctgacaaggtcattgttatctggccttgcagctcagagggatcaaactgagggcaggcatatcagggtaaacagaggatgcccaggagcatggggaggcttcttcagggtggtcccctgcacccttctgccatcacaggtcccacctcccatccccagcttggtcactgtgaggaccacctgcttcttagccccagcacagagtgaatctgagcctctccttcccagctggagaaaaaggactgtctcgcttcctctcaaatgcccctgggcttttgttcccacagtcagaatgtgtgttctataaacagttcttgcttgtctgaccttttcaccatcctttcctttggtaattgttcaggttgttttgctccctacttttttaaaaaaattttttgagacagggtcttactttgtcacccatgctggagtgcagtggcacgatcacagctcactacagcctcgacctcctgggctcaagtgatcctcccgcctcagccccccaagtagccagccaccatgcccagctaattttttctatttttttagtgacacagtttcaccatgttgccaatcctggctccctaccttaacccagtcctggttcctgttctgatagatgctcaacatcagttgatattcagactgggattgtcgcccattcattcattcattcattcacccacacacatgcacagagtcactgcttccaccaccccttgtggttccagatgctgcagcacaggggtgaggctcctgcttccaggtcttctatttgaatagaggagccagtaagtagagaaacacattttttaaaagtaaacaaataggacttactcactttacctctttactttgttttaaaattattgaattttttaagagacagtgtctcatggtcacccatcctggggtgcatgatcatagctcactggagtcttgacctcatgggctcaaatgatcctctcacctcagcctcccaacatgctgggattataggcataagccattttgcctggtctgactttacatcttaaatatatgtgaaataacttatcttttccctctccactgccagaaccatggttcacactgctgttacctccatctggaccaagagccccacacgggtcttcctgcttcacttctctaccccagtccccccaggccccaccagcattctccagaaagcagccagcatggtcttttcaaatatccatcagattacattgctccctgccaaaagccattacatggcatccatctcactaaaattactttcagattccttatctcgctctggaaggctctccatggtttctgctcatttcatcaccactctccatgtcctcacgccctgcacacagtgtctctgctccagaaacatttcccagttcgtcctcagctctgagtcttcccttctgtttcttttcttgggaatgttcttcccccagatcattgcaaggttggctaatggaggtcttctctgaccacccgatctggagcccagtccttcgccgccattatccattcttctttatagggtttaccacaatctaaaatgatctcatttgcttgttcaggtgcctgcctcctgcccgttcctcagcagactatctgctctattggggcaggtgtctcactcactggctcactaccaagtgcaccctcttctagaacagtgatgactggtacatagtgagtactcactactgaaaattaataaatgcattaatcctttcaaaggaaaagtaagaagggtattggatactaagttaaacccatggttttactcaattattcaacgttttctcaggaagtagtgtatgtgcccttagcttaataattccatcatttggtctcttctctctagtggctttaatcctgattctctccaaggccagatgttacagtacagagcagctcttctctgtgatgaagggagaggaaatataacaatctggccagctaattctagggttatagacacagaagcatgaatatttagattccaggcatttcagctgacagaaacattttatatcagttctaatgaaaaggattgactaggtttcacttattgcttgccaactggaattttgttaggcacaattacataatgcagaagtatttgagctgtgcctacccacatcagaatcctaaactaggtttcaaagggactacattccattttaaagaaattcctagtactgctaactttcctggaaataaaagctatccctccctaagactgacatttttatggccagaaatgtacatttaatctatttgttttaaactgtaatatattatggatgcctaaataaagccaaatgcctatcagaaagcagttgagaaaagaaaatctgcctagaaaactattcttatgatctctgctgggtaagaataaaaaagtaccacccaagacaggcaagaccacgctcccatggtcaaatgtaaggacagaaaatgagccacaactcgcactgtagcccctgaaaaaaaaattatcgataggtccaaatgcctcttccaaaaatgctgactcactgaaaattattgccatttaataaataggaagcaagctattacatcgtttgccaaactttctcccacatttctgaaatatattctttaatagctcaataacattcaggagcactagaggccagttaaattcatctaaaaaggaaggacgagatttctgcctcacccagcacatctgcgttgggtgggtatgccaagaaaacaggaatcaaggtggctatcacctctccactagacagttccccaaatccagcctagacggaaagcactttttttcccaggcagcctccaggaatacggaatacttttgggaggagaagagccatggacgggtgagtccttaccccaggatgcacaaacaccacagcaagacaccaatgactgccggaagttcggcggttcctccttctccggagcagcaggcccagacttcacccggtagccattatggaacaggtcccccagggacttcttgcggcgcctgccgggtctgtaaagctctgtgccggttctgctggatgggtggcggtacaccagaatcttactggggatcatggtagaaggagggagatgggctaggctttcggctcccttccattcacttcttgcaggagtcaatgctctggaaagacctggaggagcctgtgttcctctgacccgtgctgcaaacaggtcctcctgtccagcgcagtgtgggtcaccagcatctatgtcctggtggagccaatagacactctctcctccctcaccctccagtccctcttgcaagaaccccggcatgctctgggcactggatgcacgcagccacatcagaaaggcggttaagaggggcgggggaagcactctgatccacgatgtcctgcgagctgatcaatcagcttcacgctggaaataaccatgtaagctcctttggacatggtttagggggatagaaagagaaaaggctataattcctcaaatcaagtggtatagaatagagtgtgagagaggctgcagtttggggcccactaagtcgtttcttttattttagtaatcctgcttaacaactgaggactcataaggaggattcccttagaggatgtgatgcccaacaagaaagaaaaactgaattgtcctactcctcctgtcgtggccacctcccaccactaacataacccaaatacgcaaatcctctgctaatcctacatacaggactgaggaagaagagggattctgggctatccagaggaagatgggaggagacactcattagagctccttggcccaccccctgcttctttgtcccattgttttcagcatcttctctcattaccaaccccagccccctcttagttctctgttacaggctacattatggacccccatccctgccaaagtcgtaggttgaagcccaaaccccaatgtgatggtatttggagatgaggtactttagggagtgattaggtttagacaagatcatgaggatagggccctcatgatgagattagtgccattataagaagagagaccagagagtttgctctttctccctctctgccatgtcaggacacagtgagagggcagccgcctgcaagccagaaagagagccctcaccagaacctgaccatgctggaatgctgatctcagatgtccagctttcagaactgtgagaaaataaatctctgttatttcagccacccagtttttgatatcttgttaaggcagcccagagtgactatgaaagtctcccttcccagggtactgagtgtaaacaaaaatatgacacagacagagagaggggaaacattaaaaatataaacaggaaaatatccacattccacaagttgttagctgaggctcctcataatttaatccccacctattttttcagacctctagcaaggctaaaattattggtagaattttcaaagcataacatttcttctcaatgtggattagttcattcacctgaccatgacgtattgagcatctattatgtgccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccgggcgtggtggcaggtgcctgtagtcccagctactcaggaggctgaggcaggagaatggcatgaacctgggaggtggagcttgcagtaagccaagatagtgccactgcactccagcctgggtgacagagggagactccatttaaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaatttttttaggccgagggaacagcatgacgaatatcttgaagagggaagtagatggcctggtcctgacttgaaagaaactcaatgtgtttaaaaagaaattggtgagaaactaactctccaacacctaaagttgtctggaaatgatagacagaactacaggtcctacaaacactaagaggataattttaaagtattaggaataatattatgtctccaaaacttgacaccctgatgaaatgaacaaattcctttaaaaatacaattttctccaactgacacaagaaaaaatagaaaatgtaaacagctacatatctgttaaataaatggaaacttcaatgaaaaacattcccacaaagaaaatttcaggttcaggcagtttccactgcagaattctaccaaatatttatggtggaaataataccaatattacacaaactctttcagggactggaggaaaagagaacccaacttgatttataatgccagaataatcatgacattgaaacctaataagagtattatgaaaagaaaaaaaattacagaaaaatatatgtcatcaacatagacacaacaatccttaaataaatactagtcaaatgaatccagcagtatataaaaagaataatactttagaatcgagtaaatagagtttatcccatgagtaaaagattggtttaaaaaatgaaaattaattaatgtaattcaccacattgaaaaattaaaagacaaatcatatgatcattttaataggcatcaaaaaataatgaaactatgttgtgttaagataatgtgtcgtgccccccaaaaagacaagttgattaatgaaacagagtccagaaatagacccatatatatacaatcaattgatttacaacaaaagcaccaatacaactcaatgagaaaaataaagtcatcgccacaaatggaaggaaaaatggatatctacaaagggaaagaaatcagtctcaactcttacctaacacaatctacaaaattagtttgagatggatcactgacttcaatgtaaaagctaaatctgaagcctctataaacaaacacagcagagtgtcttgaggacactcggataagcaaaggcttcttagataggacacaaaaggcactcacatttttaaaaagactgataaattaaatatcagtaaaataaaaaacttctcataaaaagacaataaattaaaagataagccacagattaagaggaaacacttgcagtacatttatatgacaaagaacttacagaaataaaaattaaaactacaacaagatggcaccacaaatccattagaatggctaaaatttaaaagttgacattatcaagtgttggtgaagaaacaaagcagctggcaccctcacacgttgctagtagaagtgtaaaatggtgtatcttcctttggaaaactggcagtttcttgtaatgttaaacatgcatctatcctatgacccagagactcaatttctaagtatttacccaagaaaaaaaaatatatgtccacaaaatcatttgtacaaggatgttcataacagctttattcaaaataagccaaagttggaaacaacctaatggccatcaacagggtggtttgataaacaaattgtggtatatcccataatggaatattagcagcaataaaatggaagaaattattaatatatacaacaatatatacaaatatcaaaaaccttattttgaaggaaaggagctagttagaaaagtgaataccctgcatgattccattcatacaaaaattgagagcagacaagactaatctatagtgattgaagccaagatagtgatttttttatgttcaagggaggagagagcagatattgacagaaatgagcataaagaaacattccaggatagtaaaaatgttctctatgttgatatggatgacagaccattttacagtggtgcatatctctgtcagaactcactgaatgcaccctcaggatctatgcattttattgcatgtataatatacttattaaaaacattgagatgggctgccatgttagatggtatctccctgtcaacagagatactcaaacagagtctgcttgtaccaatttagggaacactaaagtttcacctgatgcctaaacagagatcatctgctgtaaccctgtaaattccctcccaacttccagtgggcagtatggcatgaaacccctgcaactcagagatggctggtttaattggagaagtgaaggatttgtattcaggctctgccaccagcagctgcacatctgagtaagttatgtaactcctagcctcatttcctcatctccgaaatagggattatgacatctacttcacagacgaactatccagattaaagaaaacgatgtttgcaaagctctgcacagggtctgacactcagcaaattctcctccaaaaatctgccaaagcactagggcccagtcaaactggtctatattctgccatcgaatgccccatcatcactgggcaatctggtctcctactgtaaataaaaaccccacctatctccatggggcacatctgccagcctcttcctaggaccctgtaggtgtggcaataaatgtggtccctggaaccagcagcaggggatttggttcctggcatctccacatacgagccacatgctcttggaagttattccaaccctgcctcaagtctctgacttttaaaatgggaaacacttttcaagataaatctgttcatcacaagaaaggatttcttataaatttgaaatatttaaaagagaattctatgcaaacgtatgcacacatacaagtgaatgtgggcccatttctctggacatgtgtctattccaaaaaaaactgtcataaactgtatcctcattttgcactcctcccaccagtgtgtcccatggtgccacctggtattgtctgcctgaaagaattctaggagggcttcatttgtctctgaagtcatagatcttcatctaccaatactgggaaaactcccttgctcctcttcctctgcattaggcttgtttttctgagacagaagtggtcagagaaaaaggacactggaatccattcattcatttaaaaatattgaccaagaaatgaactcagacgaaattgacctcttcagtgaagtcatatctaattccctcaaccctgtacaaagtaatagtacatttattcaacaacatattttcatggagtacctatttagaaaagagacggaatctgggcccagtgttataggattcaaatcccagctctgccattaattgggagtgagcattagcaagttccttcaactcaaagtatctcagtttccccaactataaaatgggaacagtaatagtaacctacctcatggggttattgtgaggaatgaattaatatctataacggttaaaattgtccttggcacataggaaatgttcagtcagtgcttgctataattattactaggagccagatactgggctaaccatattggggatacaaatgtgatttgctctaaatctatcctcaaaaaatgtacagtcttgaggagctgtttacaatctacatttgtatttagctaagataggaaagatgactatctacataattttaggggacgatccaccagcccccaaaagaaattagccttcttctcttccttgtttattgatgcctaaaattcccccataagacagcagcattacccagtaagaaaaaactgtgccttgggttcaaatggatgtaagttttgaccctggctctgctcctgatgcactgagagaccctggctgcttatatgaaacctgaatgtctatgactgcatgtaaaaaataaagatgagaagctgggcgcggtggctcatgcctgtaatcccagcactttgggaggccaaggcaggcagataggttgaggccaggagtttgagaccagcctagtcaacatggcaaaacttcgtctcttctaaaaaatacaaaaattagccaggcgtggtggcctgcacctgtagtcccagctactggggaggctgaagcaggagaatcacttgaacccaggaggtggaggttgcagtgagcggagatggtgccactacactccagcctgggtgacagagcaagacttcatctcaaaaaaaaaaaaaaaaaaaaaaaaaaaaagaaagaaagaaggaaagaaaaaagatgagaattatgcctctcaggggctgtgacaataaattgatctacgtgtgttttaaaatgcctttcacacagaatatgctacataatcactcattcctggtctcctccagaagtccctgcacttggcctctctctctcgggtgtaatggattggtccccattgaaatacatttccttttcagagtcatttatccctcagttagaaagaagtattgaccatggggaagggggactgtgaagccacctgggcatggcagagggggccaggcacagaggagggagcacaaaagaacgaacaatgaagcacatagagaaataaaacctaactcgacttgcaagccagtgatggccctatttttagctgacaagtgagtaatctgatgtgtgtgacttgaaacagggaacataaacatcaaggctgaatctataaccagccacatataacttgtactataacttattcccagaattctagactgtttgaattaagtgtctgcaggtctcttcttcacgcacttactcttattaagtttgggaactagaagcctgtgtcatttgcacaggtctcaagttacaagggaaaaagatgctttgcttggtctctggtttgactattccaaagaatctttcctaatctccaattcgtctttgtctcccaccccaccagcctccctccctccttcccttccccctgaaagctaaccatcagaggggtggaatagcctctaattcagcccattcttccctcatccctttccctttcatcatcagctagcagtgaaagtcaccatcctcttggacctcccatttctgaggcattgtctgtcccagaaccccatgcaggacattggagacaagtgaatctaacctcgtccaatctccctcttcttcccgtagataaaaacctgaactcaaagaagagaactggaataatcctcccttatcccacttcccatggtgagccccagctgggacgctgacacatggccccaacttttcctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctttgcatagccctgggaatgagccaccctcatgtttgcacccaggcctctctcttgcctcatcctgcacctgccatgagtttactactgagctcacttctgaaattggctctgcattgcctgtcacctatggcaagagagaaacaactaggttatgactattgtgaactgagaaaacctataaagccaattcagagatcaaatctatcctaaaattaaattcaagcagaatttttgtgccagcggctttgaataaagactgaagaacacggtgagttatatcttcaattacagtttacaaagaacagaggtactccttccaaaaggggactcttgatttagctctctgtaaggacagaaagcataacactgaatcttgggtcagcaaaaacattttcacaagggcctcaggtatcatgagatttagctctgtttaattctgatgctcaacattaatttaaggaaaatgaagtacttgttttgggggggattaatttgctaccaggcacacctcagctgtgttttattctgaagctctaaattagcaccaggatcaacctggataatctaaatcaggggttgccaatttttttctgtaaagggccagatcataaatattttgggctttgtaagctgcacaatctctattgcaagtgctcaatgcggccattggagtgagaaaactagccacagatgatacaaaaatgaatgagcttggcctcgttccagtaaaactttccttacaaaaataggtgatggaccagatgtagcctgtaggccatagttggtcaacctctgatgtagctgacatcttgaaatgaggaaggaatgtttaatttgagaacaggtacttctacatttcacaaggtagaaatctgtaaataacaacatttggaagttccttctgtttcctgcaacactcactttagaacctaatatcatgctatttttattgctctggcttaattcagttatatagaaatcatttctattcaaatagacgatgaaatccttgaggtcaaggtctctgtccaacttctttgggtataatccatcgtgcctagcacagctgggaactttgcacttgcttaaagtgttttcttccctttctgaaggacagtgattcacatctctgcttttgacatgcaaggacttgacgatctatttaacctaaggggagaagagtctctttcaaagaatggattgtcatccccttctccctgcccctgccatgtacattatgcttctaatcagtctggaataaagcgatgtcatgggcataaactaatttcttccaatccaaaacaagttagcaagtctcattttgtaattctaaagtcttcagctcatgtatttatttcaacatttttttcctataaataaatggctgtgtgacttgtctccttctttgtgttcatatcccaatgtccagtgtagagtggccttcactaaatatgtgtagaaggaatgaggaaatgaatgcaagatgggcttagctcataaaccctttgttttgttagagacttttgccaactcttttaggcagttacaatattttgatgggcaagacctgtgctgttgggctgcctggtcaaacccatgcatagtgaaataatccgtctccaatctcagcctgcatcctaaccccaatttgtccctgagtgcaaggtcactgatctgaatttgaatggcaggctttgttgacctaacaactctgttaggctcacccatttctgcatactactggtgagtgacagaggatggacactgaaatctccatcttttcatagaacccatgcaagaggcacaaaaccatctgcttagtggtcatgtggcagcagacagtatctcagaagtcctcgcagcatatgacttcactgatgaagatggatcacacttgagcagggattcttgatctctgcaaaacagctcatacacaacaggaacaatctcacagataagaaaaactccagaagttggtctcgggctatgaaaatttctgccacaatatgatttatatgaaaataaataaagtgggtctactactttatcattagcaataagtggattctttcttcctgccacagacaaactgaggatgtaaatgaacaccatactcgcattgttgcttatgctgttgttcttcacccactgcctgaggtgtaggtttgcaaataaaatcaaaccatcattattctggactgattatccaattagagaatgaaataggccagccctgtcttccttcttcttccatcaaatgccattcttgtagccatttcactgacaacatgaggggccaacagaagaaataaacaggcataaatttcaaacccaggaaatttatgtgagcaaagggaaagaatccagatatataaaatgaattaatcatcaataagtcaccacatccctattacatggtaagttcttttctgggagctgttagggccagaaagggactgtaagacacagtccctgctttaaagaagtacaaacaatcaccaaaaataaaagcaaaactgaaaaacagcaaataaataatcatttatcagaaccaactatggactatggatagtttaaaagtgctgagagcatagcccacatggcagaagtgcataaataatgcaaaaccttacattggctgacaatttaaacttcccttcatgatcattcttctgtcagaaccgctgagagagataaagaagataataataacaaaagaacttcaagtttctggtgattctaagtaggttctagtttcaggagtattccaacacactatgttaccttagacaagtcatgttctctctttgtgattaggtttctcatcaaaaggaaggaaagaaggaagggaggaagaagggactgggagtgttggtaatagataacccttaatatcccattcagatcaaatttctataattataatgtggctctctgcctctggaggtcactcagtaacaaagaaatataactttaaaaatagccaaagtaggaaaaataacaatcattctcataaatctgcagtttctttctttctttctctctctctcttttcttctctctctcttctcttccttcctttctttcttctttctttctttcttttcttttctttctttctttcctttctttctttccctgtctctctctctctctttctttctttccttctttctttctctttcttcctttctgatggagtcttgctctgtcaccaggtgggagtgcagtggtgccagatcagctcactgcaacctccacctcctgggttcaagtgattcccgggcctcagcctccccaagtagctagggactcaggtgagagtcaccaggcccagctaatttttgtatttttagtagagatggagtttcaccatgttggtcaggatggtctcgatctcttgaccttgtgatctgcccccccttgcccttctgaagtgctgggattacaggcatgagccaccacacctggccataaatctgcagtttctacagctactttgcaactatgaacaaatgctagtgtacacagaaaactccctccctcctgtaagcttcttatgcatgccacagactctggcctcccagctgggccagatacatttgaatgctggagcactcagctgattaagatacctaatttctgaatgatcccactcacaccaggaggacagtgtttagagcaagatgttacatctcagttgactcaccttgtgcaatgatttctttttataaatgctaattgcaactcactaattaagagagatgttacactgggcaggaaaatcattgagtcaggaaatcttgcaattttctctagcatatttcatgaatcaaaagtcttgatctgatgcagttttttcatggcctagagggcagaataggagctgaataccacagcttctcttcataagggtggtatggaaatggactcccagtttaaaagagagtcaaatgtccatcctgggagaattagcagagtattgtggttaagggcagaggctttgaagacaggcctggactaatttatttttgcctatggtttaggacagagggtccaagactgtctttttcatcttgtcatctcagcatttaggatagcaaggggtacatagcaggtgctaaataaatgtgttgtgaaatttaagtcctggttctaccatgcataagctgtttcctagggcaccttccataacctcttggagactcttctgtttttttgcttttgtgtgtgtgtgtgtgtgtgtgtgtgtgtgttgttgctgttgtcattattttgtaaaatgggatgtctcagttggggttcctctgcaggagaacctgagaaaaggatttgattacaaatagttaacttgggaagtgatctcaggaaacaccagtaagggaacaggaaagtggggaggagatgggaaagcatccataaagagtttgttatcaagcatttatcactgtgggcaactaaaggaaaatcccactggggtactctggcagccaggatctacacatggctttatgtgtaaacagaagagccttgcgaccaaggggtgagggggctggggcattgatccaacacctcctgttggtcactggttgaggaggcattaagtccctagcacttacgacctgtagacaggcccacaagcaagcttcagtgactggagaaagtcctctggcaaagaaatgcagatgctggcaattcaaaatctagccacctgcactacaggtaagggcaagcgggtctgggttgcggtgacaggcaccaacagggccagcctcccaggaataataaaacctatgtcttaggttgatgtgaggcttaaatgaagcggcggatggaaaggactgattgcgaccctgcacactgtacctccattcactgagggcttcctgctgtcatgagaacatggaaaatgtggcgctccccactaaggcccctggagccatgcatcaggtagaatacagtctcaagggcatcttgagaccttatagatccagagaaatgccacttcctagccttggaaactgacaatgcacattagcatatggaaggctctgaggattcttatggttaagaaactctttaattaaatgaggatttcccaaacttactggagcacagagttctctttccaaataatgtatgccaactttcagtgtaatccaacactccatgaagcacattttgggaaaagaaggcctgagactggtgaattttacccagaaaagcattccataatttccagctcacccccaaaattctgctgacaaatatgtttccttaactacacccaaatcttctgatttcatcttctttttttctttttctttttgttttttgagacaaggtctggccctattgcccaggctggagtccagtggcaccatcttggctcactgcaacctcagtctccagggctcaaaggatcctttcacctcagcgtcctgcatagctgggactacaggcatgcacctctacatccagctaattttttgtattttttctagagatgggtttcaccatgttgcccaggctggtctcaaactcacaagctcaagcaccttggcctcccaaagtgctggattacaggcatgagccaccatgcccagcctcacctccttttttaatgaacccaaacccaccctgatgatttttttattctgcatttctcagattcataatggttttcacgtgtgatttgaaatcatttatgggagctgcatgagcaacttacatcctggagtttacaggtgttgcaccctgcccaaagttgctgagtgctcaccaagtcctgcttctctcagaggcagcattacctaatggacaggagtctccgggcccagctctgttgcttattaactttcccaacgtcatttgtaaaatgagaaaatgtctgttgttcacaggtgatatagttaggctctgtgtccccatccaaaatctcatcttgaattgtaatccctataatctccacctgtcaagggtgggaccaggtggaggtaattggatcacgggggcggtttccctcatgcttttctcgtgatagtgagtaagtctcaagaaagctgatggttttataagcatctggcatttcccctgcttgaactcactctgtcctgccaccctgtgaagaaggtgccttcttctcctttgccttccaccgtgattgtaagtttcctgaggcctccccaggcatgcggaactgtgagtcaattcaacctctttcctttataaattacccggtctggaggattccttcatagtagtgtaagaatggactaataccacaggttactatagaaattaaatgaattacagcacaaaacatccagcactgtgcagccaccaactaatgctcaatgaatgtcgcttgcctttcaaatttcttcctctaaccacccctagccctgattccaattcttcattacttagataattgtcatataaagagaaaatagaatgatgaaatggaaagactgttgcctgaataattcaggccacttagtgagtatctatatccatatagacagctgtgtagctacctctctacaggtaggtaccttaatatgcaatgtccatctgtatctatatagagatacagatatatagaggcagagatatttcatgcaataaatatttattaagcacctgctggtgcctggcattgctctgtgttggatgaaaatactgaataagacagacatgatccctgctcacaagtaggttacggcctagtagtacagacaagtcacatcaagaaacaactaaacaatgaagcaaacaaacaactaattacaaattgcttcaagcaaatgcttgtataaattgctataaaacacacaaattccagtgagggacactttagactgtgtggccacagaggcctttctaatgaggtgatagatcagtggagaactgaagggagagagtgggccatcaggggacgcaggggcaagtgccatccaaaggagcgggttgctgcctgccattgctgaggcagggagaagaagcctggggggtgcaggagaaggcagaagctctaaggccatggcaggctttatgggccgtaaggaggtcttggtttccatctaagaagaaggaaaaagtttaaagaggtgggccacaaaagcagattgaaaaagggttgacattttaaaagatccctgcaaacaactaaagaaaggagatgactgtgagattctcagagaattctttcctgcctgctattgatctccaaaaagtgtgattctataacaagagcaaacattgacagtgagtcagatacctctgtaatcatttttaaatcactcattttattcccacaacaccttacatgcggtggccatggttgtccccattttacagatgtggcagcagttgaggcacagagagcttaaacatcttgccgaagctcacctagcaatgagatgatggagccgcggttgaaatttaggcagtggaactccagatgtgtgctcaccctgccctgttctgcctccctggaagcacgctcagccatggctctggctgcctctcccatgctgcccccgagatttcattccctgtatgcctgaacgtcaacacaagtgtctttcttctcagtcccatggaaacggttcctccaccattacgatctgaactaaaacaataagaagatgctatgcaaaaaatgaacctgggtgagtactgaacactttaaaatgcaagactttactaaggctaaatagaattgaaagctatagcctcagaagagaatgtcacaaaaccctgacacagtgaaacaattacataactaagaagtgaggggaaaggatgggggagaaaatgaaatgtcattttctcttctttcacagcagaaagttcatctgttttacaccaaattaaaaaacaaagttggccgggcatggtggctcacgcctgtaatcccagcactttgggaggccaaggtgggtggatcacgaggttaggagatcgagaccatcctggctaacagggtgaaactccgtctgtactaaaaatacaaaaaaattagccaggcacggtggcaggcacctgtagtcccagctacttgggagactgaggcaggagaatggcatgaacctgggaggcagagtttgcagtgagccaagatcacaccactgcactccagcctgggtgacagagcgagactccatcttaaaaaaaaaaaaaaaaaaaaaaaaaaaagttaaatgaaaacatgactctaccttcatcttttctcctaattgctttctcatattcatatcagcatgtcttaggaggtaaaagttacaaagtttagcgattgcttcatttttctccaatttttctacattcaagtgaaatcacctttgcaaaattatgacaacaagagaaatctgacagagctgactccctcttgcttccaacttccaagctacccttagtcattcctgggcataggccaagctaactttgggaggaatttatagtttaacctttaagcaaggacagtaatagcccttcccaaaactaaattgtccttgtaaaactaacgaaaggccataaggttagggttataagaggtgcctgaattctgctaacacataagcgcagttaaatgataaccagccattgttctggaggtcacagatttgtaacttcctcaattactcttgtaaataacatcactactgtagaactgaagactggccctgggagatgtttttcagacttctggcatttctggcgagtgactgaccccacctggacccaagactcatgactcagccagtcctgtggtccccacccagaggactcaacacgagtggactgttttccatacgcttgtggttttacccccaagcaatcaacattccctgttccctagccccctgcccaccaaaccatcctgaaaaactcctaacctcctagcctttggggagactgatttgaaggataaccctagtcctccagggtggccagactcacattaattaaactctttctttacagcaatactgccatctcactgaattacttttgtctgtgcagcagacagggaaaatccactgggtgactacacaaataagcttaaacttaacagttttattttttaaaaaaacatgtaggccaggcacagtggctcatgcctataaccccagcactatgggaggctgaggcaggcgggtcccgaggtcaggaattcaaaaccatcctggccaacatggtgaaaccctgtctctgctaaaaaatacaaaaaattagccgggcatggtggcaagtgcctgtaatcccagctactcgggaggctagtacaagttcattttatataaatttctgtttgtctaacttatttacttatctactgtacagaaaaatatctagaatgatctttatccaatgtgatcaaatgttttatgatatttgctttggtttgttggacacattcttcttggcattttctgtgttgcttccatttctcttaaatgaatatgttgagttttttaaataataaaataattattttgaaaatacataaggaagacgtccagacttgctttacttgatcatatgaaataaactcctcttcacgctggagcaaaataagagcactcttatcttgggggttttggaagtatttctgtggtttctgggatgcaatatctcagccagaaaaataagcccttcatcctgccttcagcgaggcgagccccacagcaagggccaaagtctaggaggcctgagcatgaggctgcagtgtctccaagccccactgcctttaatgggaacagcgtcctggcaccctctccaggatcacagcagtgagctctgtcctctggtcacctgcgccaccaacaccctgacaaggtcctcctcctccttagcgatgggctgcctcctttcccacagcttctggtgcccccatgggttgggggcagggagggaagtagcaaagaattaagaatcagatccagagaagcatgtggtcatatcaaagaaggagtgtaaatagctcctatacaatgaggtgatcagatctctaagaggctcagggaaaataatcaggaataagtggaaagacagaaatgaaactgaacaaaagaaaacacttttagggagaaggaagtttgaggcaggtcatcatcctcaagaatcttctttgaggcaaaagagctgtatgccatgaggagaaaatgatacaggcagagcaagagaaaaataatgacctagtcattggctcaagattaaaagctataatagaccctttgatcctcacagtaactcctttaggtagtgaaggcaagagctcatctccttattataggtgagggtgataggattcagagactatagcttgttgctcaaggtcaagcagactggtgcaggtgcagcctggaccacaaggaggtctctggacctgatcactcggccatgggagtctcctctctctccccttcccccttttcatggaagtgagagttgtgtgaatctgatattccccatagtccccccctccatgattcctagtttgctcccagctcctctcccctctctagctccataactggggtcaaagccaggctaacttgagaagctgagtggaaatctcatttttggcttgctaagaagttgtcttgagacccctttgtttcatagggaggaaggtttcccagcagaggttaagttttgtgctcaggtttaaggcatgagtcaaggtcaagcttcggtagttgcccaggttttatttcaagggaagaaggagttcaaggtgatagctctctttgagggagggaggaagggaggactgtgtagttgtggatatggtagcctggccagccaatgcgtaagtgtaataagtaatcctcatactctcaccccatgctgcaagaactgtggtaataaccttgagcaacggcacacccttcctcctaacaacacaggtttaggctaaagacattatccattaaaaataaccacattttataaactttgtgttgtgtgagttttttccccattcttttttgaagcaactggcttggtacataaattacactgtgtgctagagaatatatgacacggctgtgaattacaaggtcataattttaccagcaattttagatgctgccataaaccatccaatgtctgagagagctctaatacattttgatttttttcctaagcccccagaatggcattctaggccagctcttaaaagatgcttcatttcttgcttttgttttaggaaaacaatagccaagtaacatcatccgctcctttctttcttttcttccctatagtatcgttgccttttatttttttgttaaattactagcatctatcttagatagatgttccctcagccttcttatgggaaagatgggcttatgtagggctttgagtgagcaaagttcccagagccacaccattttggcccagggcttgcctaaagacataacgaagtgaccttggaccaggtggttctgttcagtctcaggtggaaatgttttccctggtcttctgtccttaccttcttctccacttcaacttaagttacacctacatccttgcttttcccctaattttcaggcctttgttcatttgcaaacacttgccctcagtttgacctgcctattcccccctcctgtagctaacaaatttctacttcagactccaggaaccagccagaacaccacctccttttggaaagtcttccctgggacacgtcaggctgtctcttttctgcctgttcccccagcactctcctgccatattcaatgcaacacactggaattctttacttacttccttctcccccatgaatgagctcaccagcccttgtcccttttcttttgttcattcattcatgtctaaattcacaaaacattcattgagggttccttttagtaacttcagtaagacttgacacagtgcctagaatgtggtaatgggaatgtctgttgaatgaaacaaaatgagctaaaaagaaataagtggatggaggtggatgaatcccaactactgtgcatctgcaggacacggtcaaagagaaggtccctaacagggtaactgggaaggctctcctcctgttcccctgctcttctccaagggtgtcaacggagtaagtcctgccccagagtaaatccactccagttactataaccacgcactgaggatccctcagctgcctccctatatgatcactctgaaatattcacaccagtccacttcctggctccccaaagaaggatgcaaattcctccccctgctcacctttttctcttgtctggaatgctcttggccctccactccacttagttaaggcttttccatgttttaagactcaactcaagtccagctcccccagcaagtccctatggctacaggcacatctgcctacttttaacttatagcatatactacatgtggttcctaatcagaacataactcatcccatctgaatacaggcctaactaattggcgtgcactgagggagcaggggcagaccatagttctcactgctgagggggaatgtgactggttaaaagacctctaagtctagcccaggctatgctatttactacttgtgtgacactgcagacctcttggaacatccttgcccatatctgccaattcagagataacaataacatccatctcacagagtttatcaaatacagtaatgcttacaaaaggttttcacatagttgaacagctgtggaaatgtcatgtcttataaatgcacctaagtaaactcaggcaaccctaataggccctggttttgttagtcattgaggccactccttccatatgttatgttcccttggcactgagcttcctttcaaattaagaattgaattgattcatgcaggtgactcaacaactcataatttagatctgctttcactctcaccatgaaatacacacagacagctgacaccatgctcttgacttacgagcctatttttctaaaaggcccagtccctccaaggctctttcatccactcaatatggtcagccacaggcttggtttgaactgcctgttgatagaaacattgtctgtcggctccatggtccttgaccacatgacagccttcaaggacagatgtgggataaggaaataaataacagctgttttactgacacttgtactcattcattcaggccaaggtgagaaggatgggtaggattcttcatatggactcactggtatatcctagtgagttttgtttaagagacagggtctctgtgtttgtcacccaggctggggtacagcggcatgattatggctctgagcagcctcaacctctttgcctcaagcgatcctcctgcctcagcttcccaagtagttaggactacaggcataagccaccacgcccaactactttttttttttgtagggatggggtctcactatgttgcccaagctggtcttcaacccctgggctcaagcaatcttcctgccctggcctcccaagctgctgagattacaggtgtgagccaccatgcctgatggagttttaatagtagttactgcattgcaccagccagatatttcatctgagaaaagtcaggcacactaggttccatcattcaattactatcctattaagctgaattcagttatgagtgtgtttagagatgtgcatgtatcttgtagtcaacgcatggataacatgtgaattctatccaaagcaataagtgctctgcatacatttaaatgcatgtcttctcatgtttactcttctgtagtattatttaactatttattcatcttttgttatattgacttatgaaagactttgaactcttgttgtagaaaaggtatttggaattcccatatctataactagattaagctactctaggctgaaattgtgtcttacatttcacagtataccatgcacaacaagcagagtgctatgatccatatgtatctattgagtgaatcatttattaatctcaaattacatccccaaatcctgttctttccttcctttgcctttttttcctagatatcaagaagcacactgattctagttaagtagttattactttgagctcagttaaagatactaaatattggcactcttggtggcccccattccaagcatccttttatgtaaaagaactgtaatcctatgagcaaagacctgtaaaactgactgcagctaagggaattatgcccccatgcagataatgctgtggaccaaacagttccgataagcaaacaaaatctctcagacaattatgttcttgtttaaggccgtttgccttggaattcccaaaaggattctggaggattgcaaatttgctggggatgaagaaagaaagtactagctagagtttaatagattattggattaagacaggccagaaacagtcaaacaagaaaagtattatgcaaaaccttctaaggttctaatctcaccttatttctattttgattaatattttcctgggaaagaaaagatgggggtttttgttgttctctgactacaatccagagataacatctttgcctccagttttcatcaagataaagacctggaagacccgagccaaaaggaaggagctggaattttttttaaatctttctttctggtctttaaggaagttatctgaaaacccactggtactctccaatgggtaaagaatgagacagaactagcagaaagtgttaaagcattagacaggcaaattaacttagagacagtgggagaatgattccatctccattgattttccagtctgtaaatatgaaatgctggaaggatacttgtgacatttggaaagttttatctagaaatctccaattaattttagagtgcatagcatacatcaattaaacagactgcggggttcatatttcctacacggtcgtgactcatcctcggaagatctgacccatcaaggataatgatttcatcttgatattggtgactaatatttctgtttgtatgtccagtgtctgctacagagcctgacatagagtaagtaaatgctcaaacatatggataaatgaatcaattaaaaacctcataaaatctttaccctattaatcttcctcctatagcaggggttggtaaactacagcctgtgagacaaatctggccaccaccagttcttgcacaggacaccagctaaaaatgttttccccctacattttaaaacagctaaaaaaattagaatattttatggaatatgaaaattgtatgaaattcaaatttcagtgtcccgaatacaattttattgggacacagctatgtccactcttttacctattgcctatggctgctttcatgccacagaggcagagttgaatggtggtggtggagatcatacagcccctgaagccaaaaacattgactatcaggccctttatggaagaattttgctgacccttattctatagaatggaacttgggaacccttatcatttgtcattcattccattgttcactcagtggctatttactgagtatctcccatgcgtgcagtgctctgtcccattctggggataaaacagagagctgagaaagatccctgccttgatggaactcacagtctgggtctggagcagcagaaagaggctcatcaagtaaccttccaagcacctttgcaatcacaacagtgaggagagctaagaaatggtacatggggtaagcttccatgatgtactgatggttatgctaattactaaagactgtcaaatcaggacccaaattgtctagtgccaaggtggatgtctttgctccttcctttttctgccctgagacactcttcattctcagttgggtttcccttttagaatgacctgtgacatgtgtcttctcctcatgtgacactcttcctctttctaaccccagcacctagaacaaagcctgacacacgggagacactcagggcatcactgttgaacaaatgaaagaattaattcattaggagaagaaatgtaagcaaattcctgggcatccccaggccccagttttctcatcagtagaataagaaggatatgatgtactcaagcctcccagctcggcattctgcaatttgtcatgtcctgagagctggactcatctggctttctgattcactcctctctgtggacataaggcagactccctctgactcagcagcctgatgcatcttcctgagtgacacatgaactctgcccaaggcaaggcggccagccccaatccattccacggatcactgctgacagtgaatgggagtatacctgggggttttagccaaggtctgctcaaggtctttggcataaagggaggccaggttgaacacacaccagcaggaagagagatgaccttgacttcataaattggccataaattagagctaagaatcaggaagattctccttccatgcacatttctaaatggcagtttcaaggcaggtggctattttaaaacacagacacaaactcataattcaccctctttgtcccccaccctcctacatgccattgatctttcttttttttttttggaatcctgaaacatgatctttaagaaaagacaactggactccaggattacttcctagctcttcctcctctagaagccaccatttctcttcgctatctagaccccagggaagtggctttggcaaaagcacatttgcacccatggatcatttggttttcttgtcctgttaactgcctggttctgcagcacccagagccagataatagaggtgttccttcaccagccacagctactatcaggatccctcttagtccggaggtaacagaagcaactggttgaacgtgtttcctcctgggaaatcctaaatgttccatatggcaatagggaatctagagttgtgtttctccttgtattagggatattttccctctttcagtttcttcccattttttcccatctaaaatatgttttttccactttgctgagatgaagaccagccagagagtcaaaggaaatgacagacatgccataatagaaagaaaaaaatacagacttctgaagaatgagttgattcatgccatgaaaactcacgataaaaatattcactacttttttttggccacttgtcatagtgtgctgcctctgctaggcagctgaaagtgtctcatatgaaaagctctattatcctccacagaaatgacctttgggacccacccaacggtagtcaatggtaatattatactaacttgccccccaagaggaaagaatgaaataataatacttaaaatatgaatgcagagaagtcctcacttaaacacagtacttctggttcataaatcagttctgacacattgaagtacacatatgatgactagacgcaagtttattaacacattttctttctttttaggtctgagaaacatatctattcagaatccatacatttgttcattttttgaagctgacagcttgataggcaaaaagtaaagtgacagatcatttcaatatttcttttaaattcaaaaccaattcagtcaaaagaccgaaggaaaatattctacggagataaaatgataatgcaaacaattgaagacagtcctttattttagtgaaaacaggtaatgtctgtactctggagtcgggctgacttcctcctcttaacctgccctgcaagtccaattagaatggttttctgcggggagttgttttccatttatacttagcccgaacacgtatacctacttttcaaactcttagctattcacttgacatttgtcttcttcagtcttcactaaatagtctttggaccctttgggagtcttataagagttattttctgaaagttaaaaacgtaggaccttatttcggcagaggttaactaaaccaggcttcaaagaggattctgagggcgacagccactataatgtccattcctactttccttcactaggtggcagcacgtcacaacacatttttcagaacagtctggggaaaatgcagttgagctaaagtgaggttggggagtctctgcgggctatgggaggaggatacacattagggcaggtcagtgcatggaaaagctggcgacacttgtgtttcctataggtcccctttgttcccagtggagctggggcccttcgtctctaacaaaccagaagtacttgtactaatggaagggaggctatttatttcataaaataaatataaacaaacaagaaaattgaaataagaagtcctctgaccatgtgcacgttgctccagacaccaaaacatgagaaagcacttctgacccagtttgtaaattcgagttatagtattttacgtttgctaaaatattcacctaccacagtaagaatttttgtttatctgatgcaacctgtttggtgttataggcagatgctaagttacaggctttgtggtggatactgggcaacagatgtggtaagaaggggagcagcccaagatgaaatttcctccaaaacaccagaggttcctgtctcaagcagagaaatcataatactgcaacacatactagtttgcaaagggcaagtcgctatggccaaaaatgattgattcagaggaagaggaagggaaggaagaagaaagagaggaagaggaggggaaggacatggaggagggaaaagaaaaggagaaggagggagagggagaggagaaggaggaagaggatgaagaggaagaagaaaagaaggaggggaggaggagttttaactgaatactgtatttttgccttaatgtaggaaagatgaaggggagaaggaggtaactgctagtggacattgagaagctgtcaatacagcaagaccttgccaaaggttgatcaatagcctctttttaaaattaatacatagtagatggatgtattttcagtgtctatgtgataatttgatacatccatattgtcaaactagggtaactgggacatccatcaccttaaaatatttatcttttctacatgctaggaacattgaaattattcttttgtagctattttgaaatgtacaattgattcatgttaacttgtcaccctaatgttaactggtcaccctactgatctatcaaacaccaagtcttatttcttctatctaagtgtatatttattcccattaatcaacctctcttcatcctcccctccttcctacccttccctgcctcagataactaccaatctactctctatcttcatgagatccccttttttttagctcccacatgtgaatgagaacacgcaatatttgtctttctgtgcttggattatttcacttaacacaacgacctccagttccatccacggtgccacaaatgacagggtttcattctttttcatggaacagccttcctttgaagagagacattcactctcctgctagagacagcctccacctggcctgcttcacccatttgttatcttcttgtccctgtaagcatttgtgtttgcaatctggggtttatagattcatctttcctatagtagggctaaaatatcttagtttaaactccaagcctaggacaacagctggcacattacacttgttttaaggtttgttgagtgaatgatgataataataaagatgatgataataatgaaaccggcaatatttatgaagtttcttaaccagggcagagactagggtaagacagtgatgcatccagggaacaaaattgaaaggcacgctcattttctttttctttctttcttttttttttttaattttgagacaggggctgactctgtccccaggctggagtgcaatggcatgatcttgtctcactgcagcctcgacttcctcgagcaatccttccacctcagcccccaaatagcaggaacttcaaacatgcagcatcatgtctggctaatttttgtattttttgtagagatggggtctcaccatgttgcccaggctggtctcaaactccaggactcaagcgatcctcccacctcagcttcccaaattgctgggattacaggcatgagctgctgcacccagctgaggccctcgctttcagggtcacttgcttcatcttgctcctagcctatttataacataggccagttttctttacatgatttatctcattggtagggcttttaaacatttctgtctctcatcacatgtatgagttactactaaaccgtgggtatatagtagtaattaaaagctcaggcgctgagatcacaaagatgtgagttcgaattcttgctgtatcacttgctgaagtcatacagcaagtaagacaggtcacacaggtcacctctccaagttccaagttcctctacctgtgtgttaggattaaatgagataggccggtaaagagctttgtccaatacctgccacaaaatatagtcatgcattgcttaatgacagggatgtgtcattaggcaattttgtcattgagcaaacatcataaagtacacttagacaaacctagattgtatagcctcctacacacctaggctatatggtatagcctattgctcctaagctacaaatttgtacagcattactgtactgaatactgcaagcaactgtaacacaatggtaagttttgtgcatctaaacatataaaagatacagtaaaaatacatattataagcttatgggaccaccattgcatatgggaattgttgctgacagaaacattatgtagcaggactgtacatagcagctataataataataacaataacaagagcaaaaataacttattttattcctattacatttataaggatttcagagaaaaattcatgttcaggtcatcaaaattgattagtagctattgtatgcaaaacatagtgccagacatttagaggaatataaaagaatatataacatagctgcaaatctagaccagggatcagcaaactttctctaaaaagaaagataataattttttaaggcttttttgggtcctatcttcttcatgtcattgccataaacaatatgtgaacgaatgaacatggctatgttccaagaaaactttatttacaaaaacaggcagtaggccagagtggctaactcctgatctagttgatgagtcaggacaggtacatgttacttataaaaacacaaccacatcagaagatcacccatgatcaaaagagtggctcagactatagtggttttggaagaggcaagtaacaggataataactggttgagtgcaggtaagcagagaagacaagaaagcagctgctagacaagaaactaccaaaaccatggcgatggaacatatctgagattgggtaggagtggttggtaagtaggctggctagagtgaaaatgggagaaattcacaaaaatgcaaacagggctggagaagaaggctaggtgagaatataaagaaggaagaccatgagactgagttttttgtttgtttaatttaatttaattttttatttttattttttttttaagatgggatttcactgtattgcccaggctggagtacagtagcacaaccacagctcactgtagcttcaacctccaaggctcaagcaatcctcccacctcagcctcctgagtagctgggaccacaggtatgtgccaccatgccgggctaattttttaaaaaaatttttgtagagacagggtctcactgtgttgcctaggctggcctcaaacgatcctcttgccttgggctctcaaagtgctgggattacaggagtgagccaccacactcagccaagtttttacaaaaaggaagtatctgctgtgctcccaatctggccagtgaggtttgcaatccactcaggaaataataagctaattttaccctttatgagctgggttgctaaattcctacctggccttaaaggggtaagtcgaatttagtgattgtgatatgggagcaaagtgtcaccacactagtgtttggcatttatttcgagtgatatagtgtgtcttatgaaaaatgggccaggcacagtggctcacacctgtatcccagtactttgggagaccgaggtgggcagatcacttgaggtcaggtgttcaagaccagcctgtccaacatggtgaaaccccatctctactaaaaatacaaaaattagctgggcgtggtggtgggcacctgtaatcccagctacttgggaggctgaggcaggagaatcacttgaacccaggaggcggaggttgcagtgagccaagattgtgccactgcactccagcctgggcaacaatgcaagacccaatctaaaaaataataataaaaataaatttaaaaaaaagaaaaatggagctctgctcaccacctatcatctgttcttactctcatgagcaggcttgggcccaggcctgggcatctcagtgtctgcaagtgagatgactgggaaagaagatttgttcaaataagtcaccctgctattggagagaggctggaccctaagagagcccttccctcgaggagcgggctgagatactgtatccctgggagaaggttggaggtgaggctccatccctgggagaaggtcggaggtgaggctccatccctgggagaaggtcagaggtgaggctccatccctgggagaaggtcagaggtgaggctccatccctgggagaaggtcagaggtgaggctccatccctgggagaacatcggaggtgagactctagggatgagttagaaatttggcctgggacctccctccgcccctctccttccctaatctccaacacaccctgtatctattttcctgaatgagttgaccctatcctaatttcagagagtttaggaagcgatatcaaccaaattggctctagacaaaatactagtgactaataaagtcaagcaaaggtgctcattcttactagtaaccaaggacttggaataccttagaaggggattacaagtggaagatccaagagctatgggaaaagggttctgctgttcaagttgaaattgtaatatggaatatcataggatgagtatatctcaagatgtaaatgactcagattttaatctcaaaaacatatgaaataaaggattacattaataagaatactgatatttaggagcacaaaatagcaaggtttactctaataccagaatcctggaaacttgcatagcagctacaactagaattcaagttcagcctcaccgtgggctggaccagcagatctcaaagtgtggcccccagatcagcagcagcagcatcacttgggaatgtgttagccatgcagatcctcaggccccatcccaggtgtactgaatctgaaactctggggatggaacaccccaaatctgtaatttaaccagacctctaggtgactctggtgcactcaaagtttgagaaccactggtctatctagaatacatagtgtgcttgttccaaagcaattgtccttaccacgacccaaagagcctcacagaatagatttcggaaagtacgtgtgcgtgtgtgtgtgtgcgtgtgtgtgtgtgtgtgtgtgtgtgtgtgtgtgtgtgtgtgttgaagtttctcaggtattcaggtatgttcctctggtttaagaaccaccactgtgccaggcctctcaacagtggctgcacaagtgaaattattcagagaacttgaaaacattctggtgactgagttcatccccaattctcatatgcttggttagaaatacagtctggccaggaggacgtgtcagagttcctgggtgattctaacatactgccaagatcatttagcccatagaagaatcaccaggagaatttgttaaaacagattcctcagccctacctttcagagattctccaggtttagggttgaactccaacatttttatttctattaagctcccaggccatgtgctggcttgcagaccgcacctcgagtagtcctgctctaggagaaacatgtttatattttagatacctgaaatcttctttgggctgggatggccaactttcctccatctgttcctcctctaaattcctataaacttactgttctttctagaggacactccaattaagttattaacatcttatagaggcaagatctatgttttccccatctttgggtcactcctagcacctagggatttgcacacagtaggtgttcagctgaataatgcagtcgaatccctgagctggtttcaggtgttcattttctccctatctgatctgctagccaggtcaatccattatggccctggtctcatggaaaagaatcaaggcatctattttttgaagatgatgtgaaggtaaatatacgtccagtcctagagatttaggttgctgaggaggctgttccaataataccccagatgaagtacagccatctggagaggttttggcatccatgcaaacctactgctgaattcgttccttgaagacattcattttaggatggtatttccaatttggcatataacagagccatgcaaatcaatgaggatttagaatctctacttacggagggcatcttatttaaagcgtgtccctgacaaagcaatatcaagggaacacaattggaaatctcttggagaggagtaatttctctagaagcagttttagctatagcagcgaccggaacagcaatgagctccctgaaatacatccaaatttttagtattccacttggctgggctgccttcttcagagcccaatcatagggacagaacttaataatgagttcatttttcttgtcacactagagcaattcagttgcaatgctattcataaggtgtatgttgccattgaattctttctcaaaaaaaaacaaaaaaaaaaaagctcaagccaagagtagagccccatgtcagtctatatgcgctaacaaaataccttagactgggtaatttataaacaacagcaattgattgctcacagttctaaaggccggaatgtcccagatcaaggcgacaacagattcagcatctggggagggttttttctctgctccatagatggcactttcttgtttccctgcatggtgggagggacaaacagcctcccaagggcttctttcataagggcaccaataccattcctgagggctccaccctcatgatctaatcatctcccagaggccccatctccaacacgacggcattgggatttcatttcaacacatacatttggggcagatacaaacattcagaccatagcagcccataacatctagcatgatactatttcaacatggactaatggtaaaaacatggattgtttttatttatttggctacttgtatagaatgggtcaagaagctcagaagaggggactggtgaacatgggggaaaaaagtagtttggaggctggtaagttattaaaaatgtgttaacttgtagcttgagagacagcatagtatcatatcaagtaacatggactttggaggtagattgcctgagatcaaagctgagctctaccatttactcactaggtgactctcagcaatttatttaaccttctgaagcctcagtttccccatctgtaatatgggcccccaaatgacacctatttcatagtactgtttggaagagcacttgagacaattatatactgtatgtacatacacatacatacatatatatacacatatatgtaatatgtgtaatatgaacacatctaactttattctagttatggaagcacttttcttttggatttctctttctctcaaaccccccaacccccactctcctaaggacacctggcccaaaaagggaaatcatactttttcttttctttatttcactattcttattctaaagaaacccacagactacagacagcagtttacttagaaggctctgggcttcagggaatctagatgtccaagttgaaagtcagctgcctggaacatggagtgggtgacctctgggggcactcaggggcccttccttccaggcttcgggcactgtcactgagaagcaactcccttgggggaggggtgcttttggtcatagcggttgagtcaagttatcagatgtcaaatagcttataggagttcaaagtgagcctatctccaccactgctaaccacgaactgcccatctgagcatgatgaaattggcccccttcccctctccccttgctacttaattgctcacaaatccagcaaattgcaggaccagcctctagggggcaccagagacctttcctttcagagcccaaaatgccatttcagtagcagcagagtagtgtgtcctggagctggagcatggtccagtgtctcttgtgctttttggcctactgagtccttaagtatatttaatttaatttgggtagggtggtagagggttccttttaacagtgtattcatgatttctctagcatttcttcaggaaagttatttatttcttttagatatagaatttttaccattggtccattcactcaaaatcacttcaaaaaacatttgctaagcttccactatgtgcaagagtgtcctgggcatacaaaaagtaaaaagccatggtgtgtgctgtcacagactcattctagagcagcgtggtcccacagaactgtctatgatgatggaatgttccacatctgtgctgtccagctccgcagccaatgagccacatggggctcttgagtacctgaaaaacagctggtaggatggaggaactgagcttttaaataggcaaatgtggctaggagctaccatactggacagcacagtgtattagtttggtgcaaaagtaattgtggttttggccatttttaagtggattggtaagcctggctatttaaagtgtggtccacagagcaggagaatcactacacctgagagctggtggaaatgtagatctctgacgttagcataggcttcctaaatcagaaactgcattctaacaagatctcctggtgcttctcatgcacagtaaagtttagaaagttaggagatgcatacaagtggttctcatcctgactgcacttcagacacaactgagaaacattaaaagaagctgagcctaggtcacaccctccacccagagattcttaggttaatggtttaaaggcttggcctgaacatgaagagttttaaaagcactctgggggattctaataaaaattcgagaaccatcccagcataagtcagtacggtggctccaaaactggagatcaccaggagtgcttgttaaaacacagactgctggctccaactcgcggtttctgatccctgggtctcggttgagctctaagaaccctcatgtgtaacaagtccccagtaacgctgatgctgctgatccaggaaccacactttgagaaccactggtctaatcattttaaaagatgggctccagaattggactaacctgagtcttggacctgccacttacttagaccctgaacctcagtttcccaaactgtaaacttgggctatgaatatttactcatcgagttattgtgaatattaactcagagaatgactgtgagatgctgggcatagtgcctacttttaataagcaatcaataactgttccttactatcatgatcctaagaagactcactcattcattcattcaacaagtatgaactatgtgtcaggcactgttccaggtactagggacatagcgaaaaacaagggggccacagtccctgccacattgctatcatggaagctgcagtcctacctgtcagtacaaagcaggctgcgtatggtgctcctatagcacgaatcctaacagcacaatacaaaggtcagagaggaattcattccaatggatgagaatgggaaagctgcacacaggagctggagtcagagctgtgccttaatggggagaaggattacaacctgcagagtcagggcaggaacttactcatgaccaggcacagggcagagacagcaagaagatgcagctagcagcctagtggagctggggcaggaagtacagggaaaggggaggcaggaggcagggctgtgcatatggggatgccaaccagggtctgcctccactctctggccaaaccatactatttgtgtttgtttaaatcccaaacactgaaaattactgatgtcaggaaactgaaaccaggccacagctttcattcttgattattcttaccaaatgcagaggccagtcaacagaaggtccagagattcacagaatcatcctgaccctgcctgaaggtggggcggggctcttcagccaagcaggtggccttgggcccagatgctccattgaagcagaggaacagagagatgcttgagacttcagctgagccctgggtggggtaaccattaaaaggaagagtggtgtgctgaccccatccaccgcttcccttaggaaaatggtggcctaccaccacaactctttggtctcatttgggtttctctgtaaactccagaaagcaataaagcatgattcctaaaaaagagggctactaggtggaggttatgcagacctaatatgttcccctcagtcactgcagctgcacaggaaggggcacccaaacctcagagtaagttgcgtaagaacaacagacaacaggcaagtctgtctagtaactcacctgttcccatgaaaagaaaaaaaaatgtcactccatgcaaatgaggggtgtgggagggtgttgagcttcaataaggctctccccaacggtctcctccctaacaggctgtaaaataacatgaagcatggccccaaagggccgtgaatgacccctggagcaaaggactccaaaaggctctgcagagcttttggcacatctgaacaggggcccggatcccagcgcaccctcttctgggctctgactttggcaagttactcaacccctcagagcctcagattcctctttggaaataataatgggaataataatatgccccttttggtaggcagaacgatgaccctcaaagatgtctgtgttaatcttgggacctgtgaatatggtcatctacatgccagaaggaaatgaacgcagcaggcaaattaaggttgctgataggctgacctggagatgggaagagtatcctggagtatccaggtgggcccaatgtaatcacaagagtccttaaaagtagaagaaggaggcaaagaagagatggcaggaagcaagatcagagtgatgcaaggtggggatgcacccttagttgctggctgtgaaggtggagaaaggggccatgagccaaggggtgtaggtggcctctagaagctggaaaaggcaaggacatggaatcttccctagagcctctggagagacccatgttggacttctcacccacagaactgcttggaaatagaaaacttctacaccattttgcaaggttgtgaggctgatgcttggcactcagcaaggcctctctctttcttccttccttcctttcttccttccttctttcctttcttccttccttctttccttccttctttcttttctttccttccttttattttccttccttcctttcttccttcctttccttccttgcttcctttcttccttccttcactttcttccttctttccttccttccttctttcctctttccttccttccttctttccttttcttttccttcctctttctctgtttctctttctctctttctgactttctttcttttcttttcttttcttttttcttttctttagcagggtcttactatgttgcccaggttggtctcaaacacctgagctcaggggtcctcctgcctcatcctccccagtagcaaggccactttcttctctaggctgttattagcttctgtgggtacacaccatgctccacacatactaggcttcattctccctgtcttagcccatcattgcagcctccactgagccccagcctctcacagaagcctatcctcattctcccacccacatgagctctcactcctctgaactcccatggcctttacagcctgtaccttgcaattacgggcttaattatatagtgggtagtgttacctgctgtcactgcatgtgtgtttattttggttccaaaatgagattgaaactttagtctcaaacaggaacaatgttttgtccttttgttgttgttgtttttaagcacctgtgctttttttatataatcctgtttttattgccttctgacacaaaaaaaggactattttgggcatatatttataagcagataccctacatcattgcaactgccctgtgattgggcattaactcatttttctattttctagcagagtttactgaaggttttaaggtttaaggtctaaggccagttctgatacagacaatagaatcaagtttatagttttccaatcatggttccaatgaccatggtcccttatcatatgccgatttcatcagtcaaagaacaggggatggtgttggaaatcacagtaccagtaggatacagggtggcccggcatgtgttcctctcatcccagtgctgagcacacagtaggtaataaaaatgggctagaaaactggctggtgagtgcatcattactttcctcctactcccttctttaaatcctacaagatcaccctcaacaaaaacatacacacaggcaaggtgcagtggctcacacttgtaatcccagcactttgggaggctgaggcgggtagatcacctgaggtcaggagtttgagaccagcctggccaacatggcgatcccgtctctactaaaaatacaaacattagctgggtgtggtggcaagtgcctgtaatctgagctatcggggaggctgaggcaggagaatcgcttgaacccaggaggcagaggttgcagcgagccaatatcgcaccactgcactccagcctgggcaacaagggcgaaactccaaaacacaaaaacaaaaacaaaaaaacatacacacaaacagaggcagcacagcccattgacctaccttggggatacattcccaaaagagaatgagacagacggacatatgagttctccttggagcatgttattcaaatctcaaaataagataaagctctcatttcaaggtgcatttattttagtgaggtttggatttgtaagggaaacaaaatgaataagttggtgggtggggacaggaattaaaataagcagcgtcttgctgcttgccgacatgactgtcctcacatccgctgccttattttttattctgttctggtttgttttctcctgcggtgctttaaaatatgatgggtaggttagaaagagagaccgaggtaatcctggcttctgttcattaagctcgtatgaagtacgtgctgtgctactcacattacctcggtgaatccctatgaggtgggtgctgtaattagcccattgtacaggtgagataactgagcctgaggcagataaaatgctcatgctgagcgacccatcagcaaacagtttagccaagatgtggactgagttggtggagctcagagctgagctttaatctactctgcgccaatatccggggtgttcttaagccccagtctctctgtcccagatggagcaggtcggatctccaagctgctgaggggcactaggactcgggagacaccaggctagctctgcattcttctggtcctcctggcatttctagaaactggaggtgggcaaggaggagggggaaagaggagccaggagaacacggagtcttaaataagatctcttccctctcttcctgcctggagtgaagccctttatgagtaagcaccgatggagggatgccaacacaacacagcaaaactagccctgtcattcccaacccaggcctcacaactccaaatcattcaaggggtaaggacacagaaagaagagcagaggaagagtgtggacataaagtcagaccacatactggggaatgcacccctcccaccactcccaggagatgtgaccttggacaagataatctctcttagcctcagtttcttcatctgtaaatggggaaatgacaagtcctgcctcataggtttgctctgaggattaagtgagtccgtgtctgtgaggggctttccagagtgcccatcacacagtaggagctgactacatagtagtgtctctatgagtacaccgttacatgcactaggatgatctgcacaatgaatatattctgtactatacaacacgcaatcatatgccgacaattgaaaactaaacacggtgtggggagcgttctgggacaggtaagggcagggaccctgcattcactctggtttttatctcccacagagccagctaccgcacagtcctgtaccctcagcagggccaggaaagtttgtgcaggagaatggggatagacttcggtttcctgcatcttatcccaaacctcagccagaaaaggcagcacccttccactttccaggagaagggcagccatgcctgaaatgcccctatttaatgggattatttcttctcctttataagtcatatctcatgggaatgttcattttctctctggaagctcattggtacaatggttgtttcacaatgtaataacccatgtattaagtcagatgagaacctccttgaaatattattgtactgaattctcttccataacagggagatcagttttagatttcacccaaggagatttcgctaccaaagaacctaaagcatttcattaaaggtgctttctcctacaagaggaaagaggtttttttatttttgttattattatttcatatcccaaaaggttattgttctatgtgttcaatttcaatagtacttatgcttcctaaccataccgtatcatttacttccttattaggttcagtgtttcctgctttcccaacactgcagtataggagggtagggggataggactctatttcttcactgttgtttcccaatcatctggaatggtacctgacatatagtagatgctcaataaatattaatatacaaatggaagcacatttagagcacatttcttttggaaagcgaccacagttgatacaaagatgtatctcattagaaattcatttccacctcttttatttcctattcaatttttttcacccccattctgtgtttgtgccaatagattttttatgagatcacaacatatctccaaaaatcagaattaaatcatccacaggaaggctatggatttcaaagcataccagaactcctggccctaaaatgcttcagggaacgtgtcactcaccacaaggaagctgggctccacacttttaccgggggcatgttctgctcactgcagaggaggatgtctccaccacagtcaccagggagcccttccatcacccaggcccacaggggaccaagagacaatggacactggcagaaagtgcagattcatgaagtgtgaggactagaaggtaatttcatttaaacccccattcttcagatgagaaaactgaggatccagaaaagcaaagtggttgttcgagtgcacagggtaattaagcacagctcagtgaagaaggcagatcccacctctccccttccccatcgatttccctgtgtgtgcatgggtatgtgtttgaactcttagcaacaagatgttttaaaaggagtccctgttaacaactcatccataattttgactcaggggtgctgctgatagaattctactagcttccctgtccaccccaatgacctagatcccaaatttcccattaatgacccaagaaccttaaagactttctgagctaaaagattcttcgaagtcatctagccaaatctttatcttacagatgaaaaacaacaggctaggtaaagaaaattgagctcccaggtcacaaagccagttagcagtgaagctacagcagctgggactgctggcacccagggccacgtaagttacactgaggacacttctcagatttgtgtgtgactctactagcctcatcaggataaggagaaaataaggaggaatcaggatacgatacggagaaaataaggaggaatcaggatacgataagcaaaaaatccagtctaaccaagcatatctcaggtccaaaacaaaaacttttccttagagcaagagaatataattctaatgagaaaactgtagcaaaagaaatctttttaggatatggacacatacatatatatatatatgcatgcacacgtgtatgtgcatataatatagagattaccacacatactatattaagaagatgcttattttttaaaaaaatacttgacactaggtatataataaattcccagtgctagcaatggcatcaaaatggattgctagcggaagcctatcttgacacaacattttttaagttatccatcaatgtctgcacaaaagaaaatacacatattctttgaaccagcagttcctcttccaggaacctggaactattgatagaattagaattatacaaatatatgaataacagtgtttattaaaccattgtttctagcagcaataaaaggaaaaggaaaacattcaggtggtctatcattagggttatggctgaatatactgcgatacaaacaaattatggaattttatgcaactcttacaaaatgagttatcacagagctgacggaatgtccatcatgattagttaggaagccaaattgtggtgcaatgtaattatttgaaacaatttcttatacaaacaccaccatctctaaaacactatcatgtgtgcacatgtgaaggcctgggaaccgtgggtgtctaaaggaggaggcagtgatggaggcaaggggaaaagatgatgaatgctctcttcacacatctttgttttcattgattacaatgcatgcatattactttttaaataattaagccaaaaatcctaaaaataaggacagaaggaacccacaaatagtcctccaggttctgtttcggcctgccttcttccctagtagaccccatgacagcaggaatactctgaattcagggaaaaaatgaaatcaacgcagcaatgagaaacttgaagctgtctctctaagccctgggcttccatgactatcctctggtcaagttactttctccactaaagtgttctagtcctggtccaggaggtgccctgtacagtacagcccagcagcactctccccttaacacagaaagggacctcagtctcctgtaaggtgagagatgactcaagaagcttcatctctccctgccctacaaagaaccttgtacctataaatagaccatgcagaacccactttttggaagcagaccaaagctaactttggcaggcaggcctctggggtacctgagccagccactcggaaagttggccttacccccatgggcttcttaatccagtcctgactctaagttcctgaatgaaaagtgacagaaccatgaacataaaggccctggctgtgacagtgatgaccactaggctttgacaatgataaaactgcactgcctgaagcgcaaactgtgcaaaccctttggggctagtgctccaaagagagctgccaccatcaacttctaaaactccaagagcccgttgttcacattaatacatacaacattgtttgtagggagacagccccctcatccactgcaaattctgtccttcagccatgactcaggaaccaggaaggagaaggaaagagaggctgacttaccaagccaacttctgtttaagtacacagacacaaacacggggggcaccgtgaagaaatccactacagagttcacttccagccagaaccacaatttatcgttggctgcaataaactgggggaaagaagaaataagaaagagaaaaaacatgagaagcatggtgctggcatccaatgtacactcttttgtcaaagggtaagttttgagttttcatagggccaccacgcccggctaatttttgtatttttagtaaagatgggatttcaccatgttggccaggctggtctcgagctcctgacatcaggtgatccactcgcctcagcctcccaaagtgctgggattacaggcatgagtcactgcactcggcctatttctatttaatttttaaggtctggagggagacattatgtccttctcatatctacacaaagcacatgcttttatgattggacacacacgttttctagtgccccatagagagccctatatagactaactatatgctatgctagtcttaagagaaagatcaggcagtgtatttttctgtggttcccaacagcttcatagggaagattgggtgattttacttgtattagactcattcatgtaaatataactataaataaagcacatatgtacgcattcacacacacacacacacacacacacacaaaattccatccatctactctcctcaccttcctttcattcatactcacaactgctctctcagggctcagctaagtgaacactgctaaacgtaattttaagagctgaagaggtttatttctatttacttttgttttgttttatttttttgagatggagtcttactctgttgcccaggctggagtgcagtggcgtgatttcagctcactgcaacctctgcctcccaggttcaagcaattctcctgtctcagcctcctgagtagctgggattacagatgcccgccgccacgcctggctaacttttgtatttttagtagagatgggatttcaccaggttggtcaggctggtctcgaactcctgacctcaggtgattcacccgcctcagcctcccaaagctgggattacaggcgtgagccaccacactcagcctatttctatttaatttttaagggaacagggcattatgtgaatagagagatgagaaacaatccaccggtggatacatcatcatttttcttcaatccctatttctcccccttgaaacaaaactgatgtgaattccagaaaatgcttagctaaggagagggctctctctcagactgaaaatcagaatgcgggtgcgctgtttctcctggaaatatcttgactgcgagagcagaggctgagggggatgatccctgggtcccagactgaaacaccccattgtgatactgaacaatgttgcacaaacttacccgcaagccgaagtagagaaggaagaacacgttgaaagccatgtcgatctgtaatgtgaaatctttgtagaaattctggcaggattctattgggctattagacaggaagaagaaaaagcaagaggtaaatgacaggtagtatcatcctgtctcccacgatgctgagaagtggtagtgcttagggtagacgatgaaatgaatattcataaaagaaaacatttggtctttctgcctcctgggatcatcaagcaagcattgccaaggggtctttccattcaaccattcaggaactactgttcttttatttattgttttcgaaattattatatactatcattttttatcatcattcagcagttgaactaagaatctaaagaggatcatgcagataccctggaggaaggacaagcaggagaggcctccaaattccttaatttcatattaacccttaaagaacttctttctttctttgagaggacacatactaaagctaaaacacagttcctcatgccctccaacgcattggcagtggggcctgttttcaattaaacacagtggttgtgttttggaccttttaaaaaccattagttgattaataaattcaggacccaggagcatctcaagaaagctagagaggagaggatcctgggtgaggttctggctagattaagcacagactttctgtgcaggactcggatctggggaaagaagcattgtccgaccagtcaaattcagaccattaaaccaaaaggttgaagcagtactctaagggttaattttttttttttttggcatgcatgctaattgacttggtgtgtgtgtcgagcagccaatgcaaacccctagcacactctacttcaagagtcgccagttcaaaagggtactactatacaaactggtacaagacttctgtgtgctttcctgtgtcaaactgatcagaggatcagtgtgtggaaagtcccaaggtttgggctgggtgggaagtaggaaagcctcataaacactcaaagctgtgaatggaaattcacatagtattctgtgatcagtaggtaaatagtaacacccaggccaggaacgtgaaggtgaagtgaggtgagggaaaggagacagaataccaagagaagcaaaacactttagctaaagggaagcgacagacctcctccctccaggagagggccagcttgagaaatggaagatgaaggatttcctagtagtgccactttggaaatcactgtgtgcaataccagttagtatagttgcacttctgtaaggacaacgcttggctgttcaacaggcaggaatctgtgcagtagaggaactcggggcccacttagaggcagggtaagttagtctgtgggaatctccgatcatgttccatgcactggatttatccattcttcatctctgctacaagtcaaacatgccctatatcatctcccaaatcacgtggaaaaatctccagacaagcattaagagtaacctttatttgcattcacaaactaggtggactgaacaaaaaacaacactgaaaaacagttcaaaaaaaaacaaaaaacaaaaaaaaacgacaattgccaggttttcactaaggtagggaattgggtagaaagacagcatggaatttggttagtccaatgctgaaaggagacacaagcaaggaagccaaatatcacagcctgccatggctctaggcctgctctcctacacaggtactaatttcgatgaaaaaaggaaaatccaggctacagtgaatcggtgatacttctgcaattctcaggccatgggggtgcttgtttttgtttcaaaaacaagacccaaaggtccatgggtgtcagagttcccagccactctagttgcagtgaaaaatgtacaggaactaggttgaccagaaatcctatagactccagggttgaagagacaatgcatctctgcaggatacgttactaaagagtaaatgtgtgtgtgtgtgtgtgtgtgtgtgtgtgtgtgtgtgtgtcagagaataagcaagcaaggatggggagatctgtaggtaactactgtactcaggtgctcacttgtgccagcggggactcacatagctgtgcattataaactcacagtcatcaagattgatgtatacgcagtcaaggggagagaaaaaaagggcttggtttccaagactatcatggaaaactgactattgtttcaccaaggccaaaaccttacagttgccctcacagtcgttattggtggagttactggtggcatatttggggccatcatgagttccctagctcctattaatcccgtggcctctgtggttaatttggtggtaacctagaaatacagctaattggaaaagtatttgctaggctgtggtagaaaatggaatagttgggggagagatgtgagctgaatgccacagaggatacttggattcaacataaatggaaacaggtattgagaagagcataaggaattggctgcagtgacttctccactgtttcttaccttcctggtcctttctgtcatccctcctcataatgcttatgttcaatggccacagtgagagggcttgaagctagaggacatgggtgttgaaaaacgcaccttaacaacacccctggtttacaggaaaccatgttgaagccatacaagaccttttccttttctctaatcctttcaaaaaatttagaaccgatttcatcatgtttcattatcattccttgcgtactagacttggagctgaaatactaaaggaagtaaatgatgccgctggcgcgggtggcttttcctctggctggagctggcaggtaatatgagcatacctcaataatatgagggggcagggggcaggcagagaagcaggaaactctgggacaaaagacccatataggatgagtgatcgggcaatgtactttctatcccttttagctatttcctgcttgccactacagccccaggagaaatgtcctgcctgatttttttcaagtggcaacagaactgtttatcagatcccctctgagataagtcctctgagtgcctgtagtttacggactcgcacaatcagagaccacagagtggagcttccaaatccccattatttcattccccaaatggaaacaacccatggagaagttcaatgatcctttaaaaaaagaatacatatttcaacaacaaaagagttggccatatcaaccaggatttattttcctcccaaagagacttcatcttaatgattaatgcacattataggatggagaatgaaatacaaacacctctcccttcttgtgtaaagtaggaggagtttccttgtctagatacacagaaacttcaaaagctagcaaagaaattgtgctttaaagaaaaaaaaactacaaaggaaagtgactctggatcacacacagacttagatttccagtctgatgaggcatatccacctcagaaggatttacatgggcatatgttgccaacaggaaaaaaaaaaaagtggagttttatgaactgaaataacactagttctgcctctggtagtagaaaactgacttaccctaaattgctacgggttaactaacttaacttatatcctcttaataattagagaatataagatacttggtaagtggcagactattcatttctaggctcccataatccatgaaacaagtgtgatactaaaaccacaggcaaatttagcatgttgaccaggactccatgactgagcaccttcaaaagagcctcagtaaagagttgattcttatggagtaaatgttcagttgtagggtagaggttgaaatacaaactcctatttcctcttggccatcaagtaagtacatcctcagcatttagatgcctctacagaggaaaatgagactcacccaaagtgggaaatgtttctctttcctcatctacttagtcatagaattttcaaaaagactcttgagcaggatgatccaacagaccttcccaaagactgacttaagaacttatcttttcagagcacaaggcaagtgagggctacccaggttttttttcagagggcaggagctctcagcacaaaatctcactgctagcagttgttcctctgggcatcttcctcatctccaagagggaaggatcacccgctcctcacagcctctaaacttccctgggtttcctgcagtctgttttcccacctccctgagtctggctgccgaaccctgtgaagctacttctccagggtagtggttctcaaactttggcatgcagttggagggcttgttaaaatcttgctgggctccatccccagtttctgatttagtaggtttggggtgggggccctagattttgcatttcttacagtttcccagataatggggatgctgcttatctgggaacaccgctttgagacctgccactcccaaaaaacctttcttgcaactacacactaattataggtgttgctgctcgagaagcttcccattcagacctgaacagagatgattcagtgtttgagccagcccccagataaccagctgcctaccacttagctaattgctgggatcaaggggttgaacagacattttctgtttcagatgcgaacaagggggtgaaaaaattaaaaagatacagggaagcaattgcaatgccactgtgcaagcttcaccagtggacgttccaattaacaatcagagagtacctgctgagcacattttagattaagattaaaaggaaaaatgatgaagtacagatggggaggggttacggagaccatcatttacaagggataaagaaatggtaagtagcttaagaatgacaacaacaataacacacacccaagatgatttactagggacgggactggctgaggaacaagatatcattttgtgaaataatttccaacgttcaaattctcctcactcttgtggctagtccctttctaaattgaatggggccctctcaattcccaccaggattatggacaggcagagttcaggcccacagcaccacagacatgagtcaatgcaataagcctaatgattctagactcttttcctagtctcacctctgcaatgttgccaaattaatttaattaaaaatgtcattcatccaccatcacggtccctgcctgtttcatatagtaactctaagcctggctaggaagaatttctaaaacctaaactcattctacatctcttactttattttctactatgtttcagtccaaacccttgccttcattatttcatgaatgtgacccatgtattccctaattttaaatctatgccttctctgtggcctcttcaactgctgattactctttgtgttcaaaccttgggcagtcttcgaggccaacctccaggcttgattcagcaaactacttgtgccctcattgacctctcccatctctgaattcccatgctactgggaggaaaaaaattctaaactgcctcattatgttcatattcaattattcttcaattcaatgtaataatacctgacaattgtataaaatttacatatgctattgcatttggtcctcacaaaatggcagaataaagtagatattgtactataatccccattttacagacagagaagcagaggctcagatatccaatcaagaccctgcagctatgtggtagagttaggatagagacccactagccttgtgccataccacttcctctccagatggagtgcagccttcttggagaggaagaggaagcataagacatagtgtctgctatctacagagcctcgcctggggctcatgcaaaaatgatgggggttgactgattcataaatccttcatagaggaggacaaactgccctagaaaataactgatgtgtctgttgggtggtctaggaaaatgcagaggaagcagatgtattcaacctgtacctaaccctaaccctgctctgtagagactgtcatgtgggacactaataatccccagaagtcctctctgggaccccgtgtggggtggtggtatcaggaagactgatcccatcggctgaggggaagttcttctgcttatagagggataactcctagttatccaactgattaaagatgaatgacccttcaagtggcccaattttccctcaccctctcctattctaggagaacaaggatgaagataatgaaagctgataatacttagacactctgaagactcttaattatgaactagatgattaataagctttgcatcccatttgatccaatcaaaataaataaaaaagatgatatcatatggatatggatttttatggaatctatctataaccaagagagtaggtctaagtgatttgaagctttcctggctacctctggatatcctggataaactgcctacactggaataaaagcatctagccagccagaatattatgagacagactaattttaaaaggaggcaagtctttgcaatgtacttcaaattagaaactgatattattattcataaaatttaagatcacagaaaaatattttgtgagctaataacaataatggatttagtgtgaatgacatgatatgaattcatcattgagaaagcaataatatttatatagaacattttctcctgaacttgggacaacaccccaagactgccctgaacctgacgggatccaagctgaaagctttgtattcttttggttttcttcatgctgccattttacttatcttatcagagctgtgtacctaagagtttatctttctaatatcgattcttctcatgtttacactggacggggcatgtgtgttcaataagttgtgtagtttttagttttaccaaacagaataaagcctcttcactttatcccagacatcatggaatagttatcttctaagatgtggtcacctttgatgggtcagtttgtggtcaatcatccatcaatagtaatgatgataacatcaaaatgggccccccttttttaatcttaaaacatttttcttagaccttgaaatgactctaatgtaaatagaaaacagtttttgttactctgcagtactgatcgattatgatcccatgccagctggttgtttaactggctttactgggaagtcatcagttatgggtttgtatcaacaggactattaatccttttgatggcagcaggcttctaattatagctctgctcagttgaagagatgtgatccaatagccacaaatatatgtattccatgttgaaatgaattggagcataccggaaagtagtataaaaaccctaacaactctttagcatccatatacactctgtattcttgagctttgagtaatatggagactcctgaaacaatgatagcagttgacttcagagcagttgtaaggctcaggatgtctacctgaataattattcctaagagtaaaacattcttctaggagacaaagaaaatgacatagattgctaacagagagaatggaatatgtcaattctttataaatttctcaataaaacacacacagatcatttgctttcaagaaactcaggtggcgagaacccttttgtttgttatgaagttcttttaaattttatctaacaagacttcaatattatatctgaactaagagtctcctttcccatcttcattccatatttcttatccacgatagacctagataggtatagcaaaagcaaaatacgggcattacaagttgacctcaaaagtggttggcagctaggtagttttagaattcaatggaagagctaaagttccagccctatcacctcctagctataggatcttaagcaaataatttgacctcttcaagtctttgttttctcttctgtaaactggggataaggttacgaattcccaacgttgttctaagactgaatcagatgactcagcactcaaaagtgatagtaatttccaaaactaaggtaataataatagtgataatagtaactgtttgtagaaaatgcccccaaaaggcaatcattcaactgaacaaaaactgataggatcaattgtttctatttttttcatttgtatctgctttactgcctctttatctggtgttgcactgtaatccaaatgcccaacaggctgtgcattgggctactgtaagatttcacaaatgcctagtataattctatagagtattaaagaagaaaaagtgaaaattatatttccatgaaggcagccacacagtctcataaatgctaaataattagccaagatttcttgacagagaaagccataagtcactttaatgagtggccacaggagtttgttattctccttttttcctagtttttttttttagagatgagagctttccttgcctggttggcttagcacggatctacataagaggcagagatctgaaccagtcatatgtcttgtaaatatctcttgtaagttttcttctctaagagcacgtactttttcactgttacacttttggaatgatgtccaagacaacctacccactaatgcttgttttctccagcttatctgcagactacaattatttcaatcacagttgttaccagagtagaattagtgttcatatttgccagcaacttctatgtaataaatcagagctaagctactacataaaacagagtctttccaaacaagtattgcttgattttagttttcactaaactgtcttaggaatcatgactgaccaattctactcactcgttccactccctccactgattctagccatcccttttttttagggaacccttatttatctagaaaaggaatgggatggagtaggtgattcaaatagcactaaatgcatatgcacttatgcacatataccagaagacagagtgaaagttcttcgagggcagggtcaatgagccatgtataggtatggagtggttcatgtgggtgggcacccacacaacgtgtacacacaaacatccccagcctcccagcacaaatatatgctctccatccaaccccaaccccactctgggaccactcacaaaacaggacagcctagatgaggtgattagaaatgggggaaaggaaagagaagagaagtcccaggtctgaatggagagctgagaatctagacacaaatgctggcatggggaatggaacctctgacccctggatccatactcctctcacatctacaggaatttagtcctagggaaacaagaatagactattcatgtaaccactacattctgcttcctatgccttttttttctggatattaaaattgccacctatgtgctaggaggctgataaacaataatctataaccagggatagccaacaacccctagccattggggagcaacagcctggagctcacatttctgaaagagagggcatcctagagaaagtagctcagggtacagtttcaaggcacttcatatcaaggcttcccaaataagaagccctcatattcatacaggggatggcagaggctcctaagagaaaagaagagctctctatttgccaaaggctggccaatcagggcacggttgggcaggtaggctggtactcccatagcataacagactgtcaaatcactgtgggacttctttgggctgttactagatgcagacttcaaaattctgtctgagccttctccagatgtttgccttggactctttgggcctcccctggtcatctcaccagtcccctatttaacttatgccttatactcccttttcttgccctcctacctggctttgacatagtcctgtcatacctggatggcatgaccctggcaatggcaccttgctatgggtctacctgtaaggatttggagtacagaagctaaaactattgaatcgacagctagaaccagcctgttctgagttccggactgacagttgcggataatgagatgcctgagacgtatctctttcttattctgaaccttagtatttcagccagtagcctaagaggtctattacagttccaactcttgtacctcttggcacatctgcactcaagcagaatggcacacaagcccctcagcagggcactcaaggtctacactaacaaagagtaccaatgctgaagacttgctgatcctgaatgtaggaagcctgagaacatctggaaaaaaaaataattatgtttaaaaaacagttgttccatttatctgctgcttcactttgacgaacagaaaacaatgtcacataacatagatagtcaccacaaggacaccagcttgtttaaagttacacatgaatttatatgtgatgctgaaggataattataatggcttatatctatttctaacatcttgaagttttgttgttgttgttgttgttattgttgttgttgttgttgaggattttttttaagaacacacagagaaagacctggtagaagtctttctgacatctggcatagaagacaattatacctttattgcacaaggaaataaaatagctgtgtcttagctccgtctttggctgacagctaaggcctggaagttttgtaagttttcctatttaggagttttgttgagagcctagcagcctcacagccaaaacggagtgtctgagatgctgctgattagaagtcatgggtctgctgagtacaaggctagagtcactccttaggaatgtcataaaggacctgggcagtagaaaccaacaccaccatggaaaatcagacaggatgagttacctttaaaacaaactgtcatcattaatagggaaaatggcaatgacttattaacccctatgattatacaatcatatcttcaagtatgcacacttttcatttccttcttgacaacttcatgaaagtaatgtctcatctcctggaacatttcttttcctttttttttctttccttcttgcttctaattaacattgaaaatcatttatttatcaaaattaggtttcccctgcccatgtttcagaaataataaatagctggctgagtatggtggctcaagcctgtaatcccagcactttgggaggccgaggcaggtggatcacttaaagtcaggagttcgagaccagcctggccaacatggtgaaaccccacctccactgaaaatacaaaaattagctgggagtggtggtgaacacctgtagtcccagctactcgggaggctgaggcaggagaatggtttgaactcgggtggtagaggttgcagtgagccaagatcataccactgcactccagcctgggcaacggagtgagactgtctcaaaaaaagaaaaataataataaatagctatttccaccatatcaatgacatccactagatttttgggtataaatttggaaagaaatatgatgaattacctgctcagtggggtgaagtgtctttctccttgcttcctcctgcaggcccttcttttaattttattgtcctatctttgaacttctctagagatgttattcctatcattataaaaacatctctgtgagaggcctaggatggccccaggaagccgatttcttaggattttctcttctgtctctgtgaatggatctctgtatccccactttctgttgggcttcagaaatcctttcattttatgaggaatcactgtgtttttctgggaaagaggaatgggtctctgtactgaagaatctcacaaaagagaatcagatgtttccttcgccaagcccccagatgaaaacgttcataaagtgagaatatgccaacgtgctgggcaggatcgcctgcctgcacaggtctgtactgtaattacatttaagctcctttcaaaaagcgaaatgctcccattcaaaggatctttttactggttaccaaaagaacatgttatgaaattctaagcaaagtccatttcaatataatacatgggatatggttaatagaataggaggaaaaaggactgtgggaagagcttcaatctactaagcccccagattgtagaagatcagatttcatgaagaaaacctaaaaataagataagaagcattcggctttgtttcattctgactgcttagtgcctactcttgggctaagggatgctgacaagctagtatcatcaagaattgtctaggaactgttattcctaccctaggattatcacagcttggaatgcctcgcctttcatttttctcagcttacaaccaaggcatgtctaaaatgcaaagtatctatttgaaatgacaaaaaaagaaatgcagtgagaaaacagatcctgacagttgtgttttataaaagtccattctgagaatacaagaaagaagtatacaagtttaaaaaaaataaggaaaagaaagcagttttaaagtaagtcattagacagccctaaggcaaaaaaaaaatatttcaaggagagaaaatgatcacaatttactaatcaatgatgttgaatgcagtgccaacatgctttaacaaatgcgatatttcttcctagtagtaccatttcatttcttttaaagttgaattaatagttttactaaacactatgaaaacgatcaataattgcatttcctgaggcatttagcccaagaagtgcttttaaaaggtatatctttttatttagatatttgttagatctaagcaaaatcaaatcaggtaacattattcagaaagacatgaaagggtatcatcatcctggtcacttggtgcacacccaggtggagtcaggaacatgtaggactgatgatcaggtaggttgttacttggaaaactggtcctagcttctaattatttgtcattagtctttgctcagcataaacctaaaaacgggagatttatctctctcttttccaatgtcctagtcttgaattttcaagggacatggtggcctttgtgatatcacagcaaactgagggcccacagggatgatccaggagaagcctcaggcccagtgcttcagtgtattggaatgctcgctgctttaattcatgcatgcgtccagtgctcaccacgttcagggccatcggggaaagcacgtcaacatgcttgggcagtgcaggaaaagaatctggttaacctggaggcgacaaccgaaagggggaggttgcatcatgcaaatgaaaaccacagcttggccttagctgccatgcagaaaggacctacatcaaagagtctgcagtgcggctcctgggtaagagtcgatatgagagaggtgagttacttcagcaatgagagacacaggcagaaaaatgttcaaaccactctaaacagaacactgtacagagcgctggcattacacgcgagaagaggcagctttggggacgaggaggggcgagacagagggaaggtgaggacagaactggccgttactcaatgaaatggcttccctggccatcctttcatatgcatgtatttttataatgtatttcacttcaacaaataacctcatgagagtttttaacatcaaccataattgttaagatgttgtgaaaattcaggagaaacaaggcatcagttacataaagatacacaccatggtttcctgtagttacagttcattatagaagcagagctgaagcgggtcagataaataagagacagttaagtgccaacatccttaacactttggttacagagctcatgatgactctcaaggcgtaatgtagtgttgaaggaacccaacagtcgtgaaagctcgggtggtgcaagggtagggactctatgcatctatacccctgaaagccatttataaccctgaagttaaccacgctctcaagtgaagccatcttttcttcatctcagcatgaatgacaggtgaacagtgagctcacctcatacatattgaccatttagcagaaccctagttacgagcaagattctcaaaggtatttcttatcaaaatcaattcatcagcaaaaagcatatatatgtgatatatatatatatatatatatatatttcttaacatttctcttaaaggagtaataatactgttttaaattcagtagagattcatcaagcttcgctctaatgtcaaggctacactggatatctaaaaactagtttcctgtaaactccctgcttaatataaggcttgttatcatttttcttgcctcttctgccttttatgatctctggtacattgaacacaactcaaaaaatggtacggtctagtcctaactcacaattcctgcctcctagttctgacaggggaagagcaagccccgtgcttataaattactccttctaaaatgttctccaggagttcagccttctgattccctgcgtgtatgatggaggccttgatagggaacttaggtccagtgtgaatgagcagtgcactgcctcactttccacactcagtgagaccttaacatacccactgaaacttgagcaccacccagaacatgggagtgaatgcaggtagaagcaaaacacaggattcctcccgacactaccttcctcattccttgagatgcagctgtttccacttgatcacaatttattctctcttatagattaaaaactcagaggcttagttgaatgacatcttttcaaaggattatctttttgaacaaaaacataatagtctgtacattcattcaacaaatgtctctgagtttttttctttggtgacaggcactatgctggttttggagacatataattcaataagacatgattcttgctctggagtagttttccatttagcagagaagtctacccagattttaatttctggcagcagatatgcaagagcagcttgtttaaaaattctactgattaccttgtatgaccttggataagatatttaatcatgctgtgcctcagtgtcctcatttataaaatgcaaataatacctacctcctgaggttgttgagagaaataaatgagttagtaaacgtgaactgctttgttagtggccagcacatgatggatgctatgtcagtggtagctattatgatcagtagtactcaaatataagtaagaagcaaaggactctggaagcagaagatcgcctctgcctaacttttgcagtaggccttgagtgaggattagaaactcatcagcgtgagaaggcaggggaagggatggaagcagagggctaagcttgggcagagagacagaagcacagagaacacagtgcattctgggagtggaaggacacctcgtatagagcctaagtagattgtaaggttggcaagaaacaaggccagacaggagacggtgaagcatctgtgtgccctggaagcatgtctgctctttatcctataggaaatagggagctgacagaagtttatttattttttatttttattaaatctagtttttgagacagagtttcactctgtcacccaggctggagtgcagtggtgcgatcttggctctctgcaacctctgcctcccaggttcaagcgattctcctgcctcagcctcccaagtagctgggactacaggcgcctgccaccatggctggctaatttttgtatttttggtagagatagggtttcaccatgttggctaggctggtctcgaactcctgacctcaggtgatccacctgtcttggcctcccaaagtgctgggattacaagtgtgagccaccacgcccagcctgatagaaatttaaatgctggagagtggtaccattatcttgtcttgtagcaagttaattctggggacaatatagagtaggaattggaagcagaaggttgtgaagacagaggtcaattagtcaaattaaatccccacggaaaaaagtaacctatgcacatactaagatgagcatcattgttgccatataattacagtatcttaatatcctgggaaataccccttcttcagggcctgctgctgtcagagttctttaggaagaggggattaggtccacagtatcactgaagcaatttcctaaaccacatggttctctctcctaccacggcccccatgtctattgcaggaatctgtgtcatgaagaaatgacagcacatgtctcttaatcttctggaaaaaaaaaaacccaccctagtaagaagctgttctttctgctatttggagagcagtctctaaattatagttagaatcgacataaaatgaacatatttcagtacctcaaataggggtacctggacatagtagacacatgccaacaattatagacaaattacagataacagattatagacaaattgtatacatgtgatcacacccaggcacatagaaaaattacagtgaacacttctgctgcatccactattaattacctaaagaacttggttagtcataccgtcaagccatcaacttaactgccttttaagtgtccatccaaccctgtgcacagttaggatttcatgagcatgttggactggttttctctcacagaatcctgacctttagatttagatgtccttagtttccagagggctgcctgaaagtatgaattctggggtgtgcagggggtagggggtgaggctttcttttggcaggagttgacaagaggaaagatgccattttcaggtaatgtgctttctctttaaaaagtgaccaagtgtgtttgatactcacttagctcaattttaaccgtggtgggagctctgtaccctatgttggtaaatcagaaacaggaaagttctgtctgtgtgctgctgtgaccatgcggtcatatttgtttggtggatttccatttgttccaagtccattctagtttggagtttccatgaagccaggccaagtgtacaaatgctaacacagggaaaaagaaccctctatacatggacttacggagaagacaatacacactgaacttggaaaaggagcacaggctgagattccctaaagtggcagccaccttgctgcacagcagacactcagggagatgctccaggcagcaattgctcagcaggaaggcatgctggggaaggacctcatttcaaaggagagtagaacaggcctaagtgctgggattacaggcgtgaggcaccgcacccagcctgaaattagtattattttaaagttcacgcatgtgaccttataaaaatgttggtgcttatttttaagttatttctttttctttttaaaatttggtttctcacaagagaatttcattgtgctgatggaagagttctgtatactgactggagaggtaataaaacaaatttatgtgggataaaatgtcttggatctacacagcaaaaaaaaaaaagtgcttgtaaaaactggcaaaacatctgtacttgagtttacagcagtacgccaatatcaatttcctggttttgataacataccatgcatgcctatgtagcatatagcactatcatggggaaagcttggaaaggatacagaaactctgtcctgtttttgcaacttcttgtgaatcttaaactatttcaaaatgaagttctaattttaaaaaacagttattctcctgtttggttttactgtagccagacatcaggctagtggtctatttctggtgatatgtgcctctaaatgtctacagactgatttctttaacaaacatttactcagcacctgttataggtataatactgtgttcaattccaaaagatataaaagagggataagaaaccacagtgatacaaatcaacattaactatcttagttcctttctcaaaggagtgctaattgaggcaaagacatcatttacctactgcacaaattctcagagacaatcccccaagataatcagctgtcaataaatgtaggtcgttaatgtaataagcaagcttctagaattaacccacagtaatctcttcaggtaagcagatatcaggtaacaagctgtgctgaataatgcaactgatgtgataatgactctcttccttcacgtacagttggtgcaggctaagccatccttttccttagtttttcagtccctgttttgtccttcccagaactcagtgctcaccacactgaggagccaacaagtgatacctgcttaatgaaggtgcagggtgacactaagagctacttagattttaagaaacaactgaaaaggcttcaagaatgaatgtctaattggtggaatttcaggtactttgcaagttagaagagatgttttggagtataggagtatttacagcaccctcaaactcacccaaggatggccatctaccacactctctactaaaataagttgtcatgggcaattatattggaagtaaagtcaaggccaaatgaggcaataaggatggatccttagaatgccaaagactttgcaaggaacatgtcaacagtttttatcattctgagaagctgcctctaacaggaacaaaaagaaaacagagaaatgtgcaaagaataaaatctcctggaattgaagcctcagcaaatgaatatccaggaagagccaattcaatccttcctgaaatagaagatgtgtcactgctgttaacctgacaccgttattacctgcaagtggcttgggcttttaagaagtctggaagtaccatctttttcttgctgtttaaaggataaacaactagaacagctcaatccgggaacaaatgaatttttcaaagcattccccaaagaactgggaaactcctgctatgaagaagggtcctatcctaatcacaacaatttttaaagaagttttgtaacagtggaagacagaagactcccagaaatatttgacatctgtaagaatgaacagcagctaagaatggacgggctgctgcattcactcctctgtttcacacccatgctattcccttgcaagctcttactcatccacctttgaacactcaactcagtggctgcctcctccagaaagcctcccctgatcctcctcccacccagaggtaactgaacctttttctaggcttttcttcctgggtgcttctgttgtggcgctcatcactcatgaagtggtaatttatttgtttgtgtatctgtctcccttccctgctagactgtgagctcctgaggggagagccttggtgttttgtgtctgggttcccatcatcatggtacccgcaaaataggccctcaatacatgtttaaggaggaggagaaaaataaatgaattgagggagaaaatagacaaacctggaggaaactgattataattcaacagtaccaagatactagggaagtcccatctcccaacatggtttcaaatggccccatagtcccataccaattcagaacttaaattaggctaggcgtgatggctcacacctgtaatcccagcactttgggaggctgaggcgggcagatcacttgaagtcaggaatccgagaccagtctggccaacatagtgaaacctcatctctaatagaatacaaaaattagctgggcatggtggcgggttcctataatcccagctacttgggagactgagtcaggagaatcacttgaatccatgaggtggaagttgcagcaagccaagatcacatcactgcattccagcctgggggacacagtgagactccctctcaggaaaaaaaaaaaaaagaaagaaagaaaaaagaacttaaattatatgacaattacatcagttacaatattactacaatccctagaggatgaggtgcattcaaaggactgatttgtgtgctcttcccgtgtttcaggggagtttcaggttatctcacctcatgtgtgcaagaagaagaatgggaatgaccttggaggtaacaagattcaccactcagcaaagccatttgacctcactagccatgagaggtccaagacctgagaaggctatgggatagttaaaattccacaggagagtctccccgagggcattcaatttctgtgtcattaggcatcacaaaatctaaatgcctaaaactaaaaaaaagtcattcctctgaaactaatgagtatgcacttttctccttctatgagggttatcttctataactgggaaaccaagattgaaatgaagttgcccctgtaaacattataaaattaatcagggaagaagaaaggggaaaaaataaattaataaaccaagcttgaagcacattcagcattaagcatgaggtcaactcattctctgacctgcttcctcgacatggtttggtgcctattgtcctagaatcatgtagactctgtgataagatgatagttccccttaagtgctctatagataacaacttgaacattaagaaatgttaagctttccccgtgaggtagtctttcaggtcctgcatacgagtgaaactactacatcagctgatctgaatgaaagaccccacgggtgaccccaggaaggtctgaggaacaccacaagaagctgactcaccaaagaacacaatttccacattctgatgatttaatcccccttcccctgatcagtcaacaaccccaattttccagcccatcacgctccatgatgttcttaaaaaccacagcccagagctcctcagaaagatgaatttgaggctctcctcccatctcctcccttggtgccctgagatagttaaacccttctctgctgcaaacctgctgtctcagggtaatgggtctgttactatgcagtgggcacacaaacttattggttctatatcagaaataatacacagaggtgattgaagccccagttcgttcttctctctttgcttcaaatgatatatttttttgtgctctagctcaggaagctggacctaaacttgacacgaagcatactaggagcaaagctaaaaatctagagatgtgtgcatatcaaataggaggaagtcagctcatgtttctcttgctgattcatttctccaggaagccaacccaaggaatcaggtgttcaagcaacaatggaaaaagatgaattaaaatctccacataagaatacatagatgaagaggagtgtgggtgaggattttaacccaaagggtctccttggagagtaacttatcttactggatataaatcaacatgctctaatttttccagtaaggctgaatatatttaaaccttcaaaaaatatagtaatttttaatgcagtcttagattgatgaaggtttcttatagtttttactccatgctgcatatatgatgaagattccattaggaagtccatctgaaccaagtatttaaatcacttaacattaactttcctttgaatttgtcctctcatatcagcctagattttgataacctgctccttctagtcatcactctccctaaatataaaaccattttttaaaaaatcaggacgactttttaaaagtctatgaaattgtaaaaatttgtagagttatcactagcttctgaagtgacacctctgggtaggcaattctacaaagactatttgtaactatatgagctaatagtatagaagcagtgatgtaaaactgtattatttgtttattatgagcaacagaataatggaatgaattaatgcaccaatctcgctctaatgaatctatggacaacatgacagtatggtgtgaacagaacaaaataaaaccattgagtgggtccatttgcaaataagcccatttccccataaggcgagagaacatttgtttaatttaaagcttaagaacaatctctttacatacaaaatactttttctcagttaaaaaattataagtgctaagacaattaaattaatacagcatcaccatttttaaaactgaaaaaaagaggtttaattaatctcattgtgttctaactcactgttaaatcaataaaagagtttgaaaaaaatgtgtcaacctgacgttggattcattgtttttctatttagtagatatgtttaagaattcattgagtggtgttgtggagtttaaatgagttaaaacaggacaagggcttagacagtcactggcactgattaagggctcattaactgttacctgttgtcaaatgtaaagtcatgcgccaaacttctatctgctcttggtttttcgtctaactgggaactggacctcttgcctctacgtaagtctcctaccacccgtattactctctctctttcccactgagctctaaccatactcatcttctttctgtttcttcaactgtccaagtttttggccatctccactggaatgcaaggcccataaaagcagaaaacatgtgtgttttgttcactgtttcaccaaaacctacacaagtgcctgacacagactaagtactcaataaactttgctaaacaagtaaataaataaatggagagccaaaggaaggaataaagggaggcagggagggaggggggggcgggtcttagttcattctcactaagattaagtctatggtcaatactagtttgctagtgtttcctttatcaaaccatgcttgttattaggatcaggctgctcccacctcacttcctatgtctatatgatttttttgtactcacaaaaaggattttcctctcttgcattccaacacaaggagttccttgacaatttaatattatataatatatgcacctggaaagatgtttgacatctaatttttgacttacacttaaccacatatttccgctttcatttgaaggcaaaatggaacattttcttgtcaatttttttttctagattatgtgaagaagaaattaatagtcttgtcccatgttaatctaaagctcttctgattacataaatttaatagaggactctccctaaacaaactttaattccacacttaaagtatctttacaatgacaaaattgttctgcattctatagatattggaatataacacattgcataatttagaggttaagaaaatggactctggattcagaccaggggttcaaactctagttcctattactaaccatgtggacattgaaaccttctgaggtgttctttcttcatcaagcaaataaagaaaatcgtagtagtgctactaagtagaataataagtttgtaaaaggcttatcatggcactttgcacctagtaagtactcaataaatacagaagctgcttgtagacctagagagagcaaactagaactaagatcagaatcccctaatgatagccaggcaagccagtacctgacctattgaacatctggtagagatccactgagtgaacggctgctactggtgactaactgcatgacagcctttccttgtcttcctcgctaatgtctgttcaggttgtgtggcccttcctatactgatgtgatgtattttgtagaatccctctccttgagcctgtgatggccaaaattgcgtgcataccataaatgcttaactaggtaaaatgcctttgtaagactctgatgttagtccctgctgacaactttctacctcactacaatccactttaatctttgcattgacatttctgtttagaagagcaagccaggaatgatggctctgggctgagaatctggaatgcagattataactgctcagcaagttcgcttgctttgtgtaaactggccgcacttcttttgtcctcatttggaaaatagctttggctgcttgatatcgccacatcttccattttacacattctcagtttctgacaagaaaagtagagagtggaatgccacactgttgcaaatctgcggatacgcatcagcttaaccttatttgttctggtggatttttgtagatgagaatgaatatttgggctacaaacttccagcttgattcccttctcttagttccaatttcccagggtttgtttgctcaaatgcccaatgtaagagcactactctattctaggggccaccttccactgctgtgggttgacctcaacaggcattaaacctgtatgcagagccaggcatggtggcacatgcttataatcccggctccttggaggctgaggcgggacgatcacttgagcccagaagtttgagactgcagtaagttatgatcacacaactccagcctgggcaacatagcaagaccttgtctctaaaaataaataataagtaaataaaacgttttaaaaacctgtgcgcagaaatgaaagcccatgaacagcaaaaaaatcaaatgcaatcctggagctatgcataaaccaaaggagagatgaatatgtctagattaaagttctttagcatctactgtccatcttatgggattccatagacaaacatacagtagaaaagctcaaaataaaatggctttattctatatttaaaactacattttttccttatttgtgttattgcagactattagtttttcatgcacaggcaagagctaaacaaatacactgattccccaatgtgaccctctatagcatcaagacctatttttatagcagtgtaagtacatgcaccaactattatgtgttcttatgaagtaatcctcatcctgtcaactgctgtaagatcctggggaacatgctgagcaatgctggtgttctatggttatgcagtacttggccaagctcagtgggtaatttctcctaagtatatatatgcttaaatggcacctaccaattatctctctttggaagagtgcaagtgtagcatgcccactctcccagatgtgtgcacattcccgcctccacagagctgtctcttcgcctctcctctctagaagctctgggttagtcctttctccaggcacagaggcagctgagtgaactcagcctaggggagctatcactgttcttttcttacctctaggagttacaacagagaaaacctgttctccagaaaaagaccaccctctacaatgtcttcataggaaaaaaaatggtcacacctgtgacacagccctaattgaattcttataggcacctcagatcaaagctacccaataacctgaggtaatggaaaagaaaaacaatagagtatgacatttattcatgtaccaaattcttggtttctcacctattaatttttggtcttgcaaattttgctggaacagaacatgatagagtactggctctgaagttctaggttcagataacaaactcaaaaggggtttaggaaactaatccaagggagaatcataaatttgaaccttaacatggactctgttctccacattaaaatatattgtactaccttttttcatataacatatcaaagaaaccaagagttggctcttcgaaagaatatacaagaatgctagacagctggccagattaacaaaaaaagaagattcaaataagtgcaatcagaaatgacacagatgacattacaactgatcccacagaattacaaaagattctcgaagactattatgaatacctctatgcacataaattaggaaatctagaggagatagataaattcctggaaacacacaacctcccaagattgaaccaggaagaaagtgaaaacctgaacagaccaataacaagctctgaaatggaatcagtaatttaaaaaaaacctaccaaccaaaaaaaaaaaaaaaagtcctggaccagatgggttcacaaccaaattctaccagatgtgcaaggaactggtaccaatcctactgcaactatgccaaaacactgaggaggaagggctcctccctgatgcattctatgaagccagcatcatctttataccagaagatggcagagacacaacaaaaaaagaaaaacattaggccaatatccctgatgaacatagatgcaaaaatcctcaataaaatactggcaaatcaaatccagtggcacatcaaaaagttaattcaccacaaaccaagtaggctttatccctgggatgcaaggttggttcagtatatgcaaatcaataaatgcgattagcattataaacagaattaaaagcaaaaacacatgatcatctcaatagcctcagaaaaagattttgattaaatctaacatcccttcatgatagaaactctgaaaagagtaagcatcaaaggaacatacctcaaaataataaaaaccatctatgacaaacccacaaccaacattatactgaatgggcaaagctacaagcattccccttgagaagaggaacaaagcaaagactcccgctctcattactcctattcaatatggcattgcaagtcctagcctgagcaaccaggcaagagaaagaaagaaaaggcaaccaaataggaaaagaagaagtcaaactacctctcttcactgataatattactctttacttagaaaaccctaaagattcttataaaaggctgttataactgatcaatgattttagcaaggtttcagaatacaaaatcaatgtacaaaaatcagtagcatttctacacaccaacaacatccatgctgagagtcaaatcaagaacacagtcccattgacaatagccacacagaaaataaaatacctaggagcacagctaaaaaaggaagtgaaagatctctatgtggagaactacaaaacactgctgaaagaagtcagagacaacacaaataaatggaaaaacatttcatgctcatggataggaagactgaatattgttaaaatggccatactacctaaagcaatttacagattcaacactattcctatcaaactaccaataacattcttcacagaattagaaaaaactattctaaagttcatatgactccataaaagagcctgagtggccaaagcaattctaaacaacaaaaacaaaaacaaaaaaacaaagctggaggcatcaaactaccaacaaagctggaggcatcaaactacctgacttcaaatatactataaggctacagtaaccaaaacagcatggtattggtaaaaaaaacagacatatagatcagtgggactgaacagagaacacagaaataaagccgcacatctagagccatctgattttcaacaaggctgacaaaaacaagcagtggggaagggactctctattaaataaatggtgtgggtataactggctaaccatacgtagaagaatgaaactggactcttacctttcaccatgtacaaaaattaactcaaaatggattaaagatttaaatagaagacctcaaactataaaatctttgaagaaaacctaggaaatacccatctcaacatcagccttggcaaagaattttttactaagttcctaaaagcaactataacaaaaacaaaaattgacaagtgggacctaattaaactaaagagcttttgcacagcaaaagaaactatcaacaaagtaaaaagacaacctatagaatgggagaaaatattcgcaaactatgcatctgacaaaggtctaataactaggatctataaggaacttaaaaaaattgacaagcaaataatcccactaaaaaatggacaaaagacatgaaatgacacttctcaaaagaagacatacaagtggctaacaaacatgaaaaactgctcatcatcactaatcgtcagagaaattcaaatttaaaccacaatgagataccgtctcacaccagttagaatggctattactaaaaaatcaaaaaacaacagatgctggcaaggctgcggagaaaagggaatgtttacacactgttggtgggaatgtaaatttgttcagccaatgtggaaagcagtttggaaatttctcaaaacacttaaatcagagctaccattcaacccaacaatcccactactgggtatatacccaaaggaaactagataattataccaaaaaaacacatgcacctacatgctcattgccatgaaatttcacagtagcaaatacattgaatcaacctaggtgcccatcaatggtggactaaataaagaaaatgtggtacatacacatcatggaatattaaaaagccataaaaaagggtgaaatcaagtcttttgtggtaacgggaatggagctggaggccataatcctaagcaaattaacacaaaaacagaaaaccaaacactgcgtgttctcacttataagtgggagctgagcactgagcacacatggacataaacatgggaacaatatatactatggactactagagaggggagggaaaggaccgtgggttgaaaaactacctattgggtactatgctcgctacctgggtgcaatatattcacataacaaacctgcatatgtaccccctgtatctaaaataaaaactgaaattaaaaatatatatttttaaaagtactgtatgtatactacttttaattatgaaatgccaatttgttatattctctctctctccttctctccctcccctgctcagtgtctcttgctcttttctctctcttgctgtcttctcttccctcttcctcattaagctgtatggttaaggaaatgagagcaatctctgcttcaaggcacagccaagaggaatcagcgctcttgactttgacatcttcaattcctactaccacacttcgtcagagaaaaaaaatgacaggaaacttctagacaagatgattccctgccattatccttaaagatctatccaaatcacatcattcctttcacttgctaattggtttcgtaagccttcttcccttccttatgttttctattcttatttttgggacaattgccgacgtatgcatagttctggattttttttttaagtaatttgtagttgactatcgtttatttctgcaattggtgtaattaaatctaattacataatcggtgaaagactgagtaattacataattagaatgtgcaataataacagttgaaatcctattgttatgacgtgtaatgatacaattatgatgtataacattcacagggtactctgcaacgagcaaaaacggctctaaccctggctgaatggagcacagctaaagttggagacctggaaagtagctttcagcacctatacttggacttgcttatcatccttatccccctaatgtatcctttgacttttatactccacaggaatcaaaggcagtaggcgaggtctaaggaaggtcctcatgagggcaggagcactcacatctccaagaaccaaatcaccaatacaatcagcccttagacagaaaggagcagcaagagatggactcacatttctgaaacagtcactcctgcatgtcagttttaagtttgaaactgtaatcaggagacaaaaagttagggttggagaatgtctggtgatcacacacacaattacaagtgggcctagtgattatggcctgggacatagctcccagctctcagtctgccctctccaccccaactccagtcatcttaatcaccaggacatagaccaaccaccagaagtgctggcctcccaggtccttgctctgctgattgtcggtgaccctttcctttcctccacgccacccacccactcccatgatcttgctctggacccgaagaaagcagcaactatagtgtttctgatatctcggcctcaaacaccccattcatcaacagcaacctctcatccttgtgctcgcctgttcacgtgctccccactgggacccttccccaacctcagagaaatctccaaattctggacacctcccccgacatcccacccctggccagtcatctgctccctgccttgccttgcaacgctccttgtccagcctaattcccatagtccaccattgtcatcacccctgggcagcaccctccttccataacagaagccctcagccctacttcacaccagctctggaaagctgaaagttcctgaataaaaccacacaagggaaatgactggtttcgctttaaattcatgatctcaaactgcaaattgacactccatactgactggcaaactgctatttttcttgaattggtttgctttccaattttccaaggccactatttcacagttttccttctctcctccaacctcccatgttcttttctgcaccatcaggctcagtggatggcctcgcctcatcatgtcattaaaagtcacataaaagaatcaggccagttacactttttttcctaccagcagctctccaacactgcacttacaggcgcccagcacatcctctgcctcttcattcataacacaccatgccctccacagacactctttcagccctgtactgtctaactgtactgtgttgctatagcaagctctcccttgctgctggagctctgctgccaaaatataagcttgctcaactgtcctccatagccaaccacatttccagagactactgcaggctccatcctttagcccactttgatcaggccctccctccactcactagagcttcaatgtcaaagaaaccagcaacatccctgtcacaaactccacagatgaccctagacccttaccttccctctgtctcaacagtgcttggcaattggccactccctctgcctgaaaccctctcctccctaggcttctgccatctccttgccctgtgtgtgcccttcctcagtttcccatccagcctcctcctgctttactcaccctctaaatgttgggcatcctcttgccttcacctggggcaccttctctcctctccctacactctttccccagatggtaccatcaactcacaggcattcaaagtcatctttgtaatttccaaatgtaatatgattcctctcttctgagttctggactcaattatctaccctgctgtttgacatcttctctttcaggtgtcacagacttcttaaactgaacatatccaagatggaaatcctgatttctccctagtgcagcccttagcccccagtgcagcccctcccttcccagtaaatgctaccaccagcgacttgtcattgaagccaaacactagaaggctagaaggaccctgattcctccttccattcactccacatccaattcatcatggagtcctgtccaaaatgtctttctcctctttaatttccctacttcaccaccccactagatcaggccagtgccctcttctgtcgggatggtcttttctttatcttctgaacatgattacagattgcacctgttttgttttgttttgttttgtctgtcttttatttttgcttttttttttttttgcctgtctcctcctctagactgtgttccctgattacatttattgttttacttatttacagtttccagcatagatcaggtaattaactttcattagataaataaataaatgactatggtattggcatctataatatgcagactatgagcctcatggtaaacttataagggccaagatgaaagccagggccagagcagagataataaacttagctgaaagctactcaaaaagttaaacatcgagataccatatcttgatgtgctatgaactggattgcattcccccaaaattcatatgttgaagccccagtccccagtgttatggcatttggaggtggagcctttgggagataattaggtctaatgaggtcatcataagagtggggccttatgatgggattaatgtccttgtaagaacagataccagtgagcagtgagcttgcccctcccccccacctgtctctctctctctcctctctcctctctcctctctctctctctctctctctctgccgtgtgaggacacagcaagaaggtggccatctgcaaccctggaagagagccctcaccagaaattgaccatgctgttgccttgatcttagacttcttagcctctatttctatcttgaaaacatcatgctaattgaaagaaggaagtcacaaaaagccacatattacaaaattcaatttatatgaaatgtctagaacaggcaactctatagagacagaaagtagatgagtagttgcctagggctgagaagactgggggactgggagaatgtggaatgattgccaattgatatagggtttctttcgggggtgttgaaaattttctggaattagattgcagcgatagttgcacaaatctgtgactatactagaaaccactttaaatgagtgaattctatggtatataaaacatatttcaataaaactatgaagaagaaggggggaagaggagaagtgggaaggaagggtgagagaagcgggaggaagagaaggcaaacagcagcagctcaaattagttaacctagctgagttagtctatggaatctaagttgccaccaacaaaaaagtaagccactgctttatatgccaccaagaaagaaaatatttaccaattatagccataagaagtcatgaatgatgagacacttcctgattttggagattttaaactatgaaaaaattgtatcttagaattagtaaaatacagtacacgtagctgttgtcagatctaggtaccagcttctgaaggcttctaaatttgaattacttctttaaagataatttattaaccatgaactcattcattcataagaaaaaattttatcaaatgagtattataagctggatattggctttatatatggttttgactctgtgcacatcattcatttaatcttcaacaactacccttcaagataaacattatattcctcattttatagataagggtgtgggctacagaaaggtcccatagttcttaagtggcacagccaggatcctaagccatgtctccaggtctctgctctgtccctgtgttatgaatgaacagttcagatgcagaaaccttgtgagcaaaaactgaatttttggccaggtgcaatcttaatcgctcacgcttttaatcccagcactttgggaggctgaggcgggcggatcacctgaggtcaggagattgagaccagcttggccaacatgatgaaatcccatctctactaaaaatacaaaaattagctaggcatggtggcaggtgcctgtggtcccacctactcgggaggctgaggcaggagaatcgcttgaacctagaaggtggagattgcagtgagctgagatcatgccactgcactccaacctgggtgactctgtctcaaaaaaaaaaaaagaaactaaacaaacaaacaaaaaaaaactaaatttttttctaagccaaatgtttcctctgtcagctttagagatgtagatgcccatcaatcccatcatctcaggccttacttctcacatggccaacttctcccaacatcaactggtatgtattaaaggaataggaattacagtacatttctggagaatattcttggccaccctggaatttcctgcattcaatatgttggtttgccatgaagtctccaggagctgccgaatgaaaacatggagatacttacagatgacacagacagaacaaagtggaaaatgagaaacaaaaggagaaaaaaagtggtatgaagtgcagttgcacctcaatttatgctgcagatgctttcttgaaaattatgtgtagatcaaattgatttatgaactaaaccctatcataaattcaacaaaagcattgtgatggaaacttttgtaatcagaaaaatttatttgtgctgagaatagttgattctcagcctctcttttgaatttacttgttattcttctcaaggggagcctacctgcacataaaagttcgataaccaccagggattcttgatgtgcaggaatgtcatgagaccaaaatgctttacaaaggcttaaaaatataaactatctatgccatttataatagccatttccataatactttaaatatatatctcaacataatgggagggttgagaagatccttctcagggatggaattctaggaccactattgaaggagattatttgcgtgggtggggaagttcagaggagataagtatctcccctgggtaaccaaaagccctgaacccttctctcttgacagttgagagggagggagaagttgaaggagtccagcactccatttccaaatgactcccatggcctccttgcaaattacaacgtcactagctccctggtcttccatagccaaaggttacaaaatggccacccatacaggccatttaaaccatttaaaccatttaaaccatttaaaaccatacaggttttaaaaatcaagtgttacatttcttaaaatggatttgcagaattacttgaatgaataaaagatctgcaagacatgctccatattcccactggggaataactcactggagctgggtagatgctcctgaagacgtgtctcctggtccccactacttcttaagccttgcatccagcctggctcctgcaggcattttcacttgcaccccagtagaagtctcctctgagctaagggtcaccaccacacgactcacccaatcccatgtagagcccgcaaatatccatgatcccaagagcatcctttctttaatgtggtctcatttcaaaatatatgagactgttggatttatttatttactgatttatttatttattgagacagagtctcactccatcgaccaggctggagtgcagtggtgcaatctcggctcactgcaacctccgcttcctgggttcaagtgattctcctgcctcagcctcacaagtagctgggatcacaggtgcacgccaccatatccggctaatttttgttttttgggtagagatgggatttcatcatgttggccaggctgatctcaaactgttggcctcaagtgatctgcccgcctcggcctcccaaagtgctgggattacaggcataagctactgcgcctggccttattttttttattatttaataaattttttagagctagcccaaattctttcagatcctctgttcttgaagtgccctcctggttcatttcgtctagtgacaaatatgactccatatcaccactttcccagagaatcagcacagcagccatgcctccagagcttttgcttcacagacatgcttaataaattcactttaccctttagaccacagggcttagaaaggaatgttgtttttgttgttgttgttattgttctgctttccatcagcttaatacaatcgtgacgacatgcttctaagaaggatcctaagacgttcatttctttgaagcactattaccagtggagctgacaacaaaaagttaatagacataggactcaggcactcaggctcactctgcttaaactagcggagtggggaagaagagagacgtgtacattccatatccataccagcctggggtcttgggttctaagaggggtggtggcttttccctgagccctaaacccagcagctgcagttagtgccaaagattatgagggtacagaaagtaaagaaagatcagtgttttaaagtctccacccaccatatgatttctcagaaacctcaaatgtcctttgttgttgttgttcgttttgttttgttttgtttttgagatggagttttgctctgtcgcccaggctggagtgcagtggcgcgatcttggctcactgcaagctctgcctcccgggttcaagcaattctcttgcctcagcctcccaagtagctgggactacaggcacccaccaccacacctggctaatttagcaacctcaagtcttaatccatataggaactgtaagaagactactggtttgtttctcatcactaacatggtaactcatgattgccgaacactggctgagcagtcatgctctgcccagtggcattgttttctaagaacttaagtgtatcttctcattatcctcataaaatccccattatcagctccattccacaagtggagaccttgaaacttagagagcttaaataataataataactaaaattcatgaagggtgcccttctagcccactacacataccaggcactgttctgagtgtttttatctgttgactcaattaatcctcataacaccctttttgtgttactatttatgttgtcttcatattacaaatgaagaaactgaggcacagggaagaggtgaaataagatcacttagctggtgagtaattaggcagaacttgaacttgggcagcttgacaccaaagctgtgcttttactgctaggctgatttgctcaaagtcacaccactggttaaggctggagtttgagtctactccatgtggtcagaatctagagccacaggggcagccatgtgctctgcggcctgcttagatgttcatggggtcagatttcctctgcagtggctccaacggctggcagcagggtctgggatggatgtactgcctttctcagagctaggctgggaaaaacatttccttgtcatttattttttaaatgtcaggagattttaaaacttctaggagagcagataagtgataagaagaaaatctgggtcgtttttgtgcatacaaaggggccattctaatagtggtttcaaggggtcttttctagacaaaaggggaggagattgttttagtagccctctcttcctttcctggggagtttgaaactatctagttttgaaatctaaaaatccccaagctcttggatctggtcctttttacccccttagccatatattccagtttctgctaaaaaaagtctgcctcaagatataagtgacatccaactgttggggctgttttctcttttcatagaaaccagagcttctggggttctgagatgtctctagcggtcactgacctaaccattagcaactgggttctacaaataatgtccctggggaactcaataaaattatcaatcgctagcccccacaggtcttaatagagagtggataggtggaaggtttataaatcaggatgagtcatttgattcaccaagggaaaagataaataaaccaacactccaattaattttaacctgaaaagaaactgctagtgaatggtgcgttagccaagtccgtagggtcttaacaaccttaattattcacaaatgcaaattgcttttactgcttgctaatttcttcatgtcttccatccagttcctcttcccctcaccatcctcctctctcctcacccagtctctttattcctgaagagccaaaaggaaatttctggaaatgaccttctaatcactcaagctttttctctaaaaaaatttaacgaatcttcccaagaccctaattagcttaacctgggatccaaggactgccctaggcctaaataatccatagatgcgcttcagggaccccatgagctagctgaaattatatgcaaaattgtgggggtgggtgcaaaaaaaatcagaaagaatgaataagacctactatttgatagcacaagagggtgactatagtcaatagtaacttaattgtaccttttaaaattaactgcaagagtgtaattggattgtttgcaacacaaacgataagtgctctaggggatggataccccattctccatgatgtgattattacataataagtgcctgtatcaaaacaggtcatgtatgccacagatatatacacttgctatatacccgcaaaaattaaaaattaaaaacaaacaaaaaattgtgagggtagggtacttcctggctccctgcccacccaagaggtccaattttcatcaaattctcaagaaagtctatgttctccccaaccccctaaaacagcattaagcattaaaggactagactgtacccacctaaacactgcatcacaaggaatatttatgatgcagagtgagacagcccaggcttaggagccagacagatgcaggttcaaatcccagctctgtcacttacgagctgcatgaatttagacaaatgtcaaattctctgagcctatttcatcatctgtaaaatggtgatcataactccttcagtacaggattattgggtgactatacaaaataatacgagaaagcacaaagcatttgtacatagaaagggcaaaatgaaaatcctccctacaagagagagaaaaaaaggcagatctaggctcaggagtagagacgctgctctcccatctttgggaactgcatttctggctttgctaaagatgaaggtcactgtactacaaagacaatcagattgggatcacccctgggaaatccataagaatcagattggaagagcactctttatgagcatcatattagattataaacctttttatagatcttatagtgacatgcccaatctgatttaaaataagcctctaaccctctattctcctactgtctctacctactactcccaacataatgtgataagcaaagcctaaacatttcaatcatgtacaatgtgaagttgcaccacagtaagggcactgaaatgacctcaggaagcccgcatagccagatgtctgcagtccttctgcaagatcccaatattttcaggttctacctgggtcagttcgctgctctggggtaaatatcaattagaggcttctagatcctttggctgttgggacttccagaacagcatcaatgacttcaaaaacatcctgaagtcgattaatctgctcctgttgtatgggctagattcctgattccagagaacaggccaacagaacgcaggccaagaggaccccacctttgcatttctatttctcatggcaaggttgcctcactcccagaaaaaagaactttagctttattatctgagacaggcagaggattgaagctgattgccattctctacatatctgattttatattatgattgtattgtggggcatgctactgcagagtttaactgcattgaaatcattatatcatttctctttggctataaagaattttaatttggggctgggcgtggtagctcacacatgtaatctcagcactttgggaggctgaggcaggcagatcacaaggtcaggagttcgagaccagcctggccaacatggtgaaaccccgtctctactaaaaatacaaaaacttaaccgggcatggtggcaggcacctgtagtcccagctactcgggaggctgaggcaggagaattgcttgaacccgggaggcaggggttgcagtgcgctgagatcatgccattgcactccagctctgggtgacagagcaagtttccatctcagaaaaaaaaaaaaagaattttaatttggaagccattcatagtggttgtagtttttgctcagaccatgttgtgacacacagtgtattggcttttcagatgacattaacccagccacctgctcatcttggtcctgctcagttaacctgcacatctgtatttttgtctttaaagtctttattatcaacctcactccccagctataaaagctgtttgtcccccaaacaagttgaaaagaaagtgcagaataatcagagtgtatctagaatgaataaaaaatgagaatcccatgacatccaagatgggatacagtcttgattggacatacagacagacatggtgacagaaaactcagaagccgggagggtcagagcgatggagcttactagaacacaagttcattttctcaaatgtgagtgttttgccctctctgattggcatgccttttttccttcctcaattgtggggcactgtcctctaaccacagatgacttctttacaccgcacggttgcagatagcacagtttcaaggagggtgtgcttggatctggtagaggtcatggacgaagtgaagacaaaagtgaagtcttggtggtactggttcacgcaaggaatcaaacagcccaatgagtcagagatctgctaagtatatggaagccttcatgacttaaaatatccaactgccacgagagaagttccagaacagaggagcctcttccagcatggacccagcagctacaggagggctcagattgcttgctctgccacgcctctgccatctgccccctgctgaagtcaggccagggaagaggtgctgcccatgagtcagccattctcaactgctgcttctgccttctcactttgccatatttgctccctatctgggatggtacagttccacagaccctgatacacctggggttcagcagacctaattagccttacatgtgtctgctcccaaaatagagagtcatttattccagtttctgtcctgatcagcaaggtgtgacctaggcccatggcccatagccccagactgggagaggagccacattccttctgaacagtttctaaaaaactttcagtcccaaatgagtgactttagaagtggagttttgaggatggagctgagcacgtggatttcacatcttctcctcttttcagtatagctctcaagccccctggatgcaaaggcaggaccctgatgaacttgccttttctatgacagtctttacactacaagaaaggggctgcaggacaatcccagctcccaaagacccagcccagagctcaggaaagccaggctgcttctcaccaaaactgaaaaccaggacaccttgggaacactcaggaccccactcaggcaccagctccttccggcagctcttccttaccctgctgaagtgctgaccatccctgcccttgactcactcccattgcagtgccaactcagagcatctatccccaaagccagagtttctgggattcagatcttggaggtgtcacccattccctatgtgactctgtgggagctacttagttaatctgcaccctaatgtcctcatccatcaaatgtcgatgatgacagcacccatctcacagacttgggtaaggctcagaagagctaatataaagaaaatgcttagaacgtggactagaatagtaagcactcaacatacttcccatgctgttgttggcgccgctgctcccacttgtcagataccatgtgagaccaggagccccttgaaggtgggaaactttttctgtttacttctatggtcccagcacccagcacagagcatggtgcagaaaaggctcaaaatgttttatgagtgaatgaataaagcgaatccagttggcaatgctggactatatacagcttgacttggtgatggttaccttacagactcctcccctgcaatgttctgaaagagggcagaatgtcaacgggcaggcacactggccagagagaaactgagcaatgtgagaatggccaggggagactgggcattacagcaaaaaagactggcattgaagctcaccaactgggttgtcttgagcacatccatttcctcttgggcttcagtctggccatctgtgtgtctaaacaaaggcaggaactactagaaagatggggtatcatttcagcaagaacaggtggagaggtgaaacatgactcatctttctccacctgccccaggggactcccc[450 bp omitted]ctctgagtaaacaatccaatgatgctacccacaaaggccgcagatccaagcttaggaggcatcttcccgtcaatgccctgggggcccctgttgccaagtgacatgtgtctgtgattgcagaaggccctattctcccagaatctaggggaggaagggggactttatgcagctggaaaaggcaaattctaacagtcctttgtgattttagacatggtatttaatctcttttgaaatgccaaataatattaaaagagggcatgctgcttttatgatttttcaggaagggtcatggactaataacaggttgcaaacattgcaacattgctgggagggttcttgcccttgctgtaggtacatattgctgttctatttataaccaacatgaaaacaatgtaataatcagaactaagagatgtatacatccctttagcctacctatttttcttggatctggaatattttgggcctcacttgttgatttttagcagcagttgaaaggagctgaccaaatgcacattaacgagacgacattcctgtctctttctgtcttcactgggagacgtcctatttgagccatcctggtttgagatcccagcctcccacccctcaagcatgagacagccacgagaaggccccctgcagccacaaacatttgtcagagtgatttggtgaagttcagcagtgaaagcaatttcttactcggaaaatcatttatcatggatagcctgtcgaaaacaatctcatttcaaacccttcccagggagaaaagaactgacaactggcactaagtaatctacaacagagccatgggagtcattcatctttcctttgcccagcccaggacttgatgctttcagaagagaagtggaatcaatcataactgctctgaggggcttcaggtaaaagaggagggggctaccgggacagccacatactcctgagtgcacaatgggagattgttcagtctctattttactaatagccaaaaaccagaagagtagttgtaggggtctttgagggaggtgtgcctccttcattacaaaacatgttctttttgtacttttagctcatcttaaatgccagaatcctccttcttagggagcaattaaggaaaagcttattgcttttttatataagctgacttcccctttgcctggggcagtcttttctttgccagaccatagcatggagcttgtggcatagtagataatgattctgtgcatgccatttccactgacatcaacaccctggaaacagaatatctagcaatttgaggctcatggagaaaagcagaagagggaaaatttttccccattaagttccctgcttttttaaaaatacaattagttacagataggaaaagcaattgatcactttccttactgaatgtctgattaaacccaggttctggttttgaggttcaccaagccccagaagaagctaatgaatttcagggctccatcattctcatgttttggcattaaccagtgactcagaaggtactgccagatgcaaattatgacatcaatgctatactccctgggaaccaaataaaacagaaccacctttgtagatgggtagctcccaccagttcccagaaatatttatattatggatattagtacttcattagtacttcattattataccaatcttaactcagaaataaatcaccaggtttagcacatatgatgctttaagataaaactgtcctcaaactgctttcatttctctgtcattatcaggggtctgaaatcctgactattttggaaagaagtgttatgctattttgcccaagccaaatgcaggcattaacggtaaagttctgggataaaatgctccatttgaactgaattgttcacataaaatggctaatttctattagccatttgggagtacttctgccacttcccagctgtcactttaagcaagatactttagcctctctgtgccttggtcttctcatctgtaagaagggggtaatactgctacctaccctgtaagatgttatgaggattaaatgaggtgatacttacaagggccacagcgcctgccaaaaagcaagcatttaatttaatttttttttttttttttgagacggagttttgttcttgtcgcccagactggagtgcagtggcgcaatcttggctcactggaacctccacctccagggttcaagtgattctcctgcttcagcctcctgagtagctgggattacaggcacgtgccaccacgcctggctaatttttatatttttcgtagagacggggtttcaccatgttggccaggctggtttcgaactcctgacctcaggtgatccacttgcctcggcctcccaaagtgctgggattacaggcgtgagccaccacacccggcctaatttaaaatatcttttagaaaactctcagccagagatgaattagggggtaagccaaccactcggtttcctggtagccaatctataaagtccccaggagatcactggaaaagtaacaagatggaaaaatgagattttcagggtgagcactcactatacatgatcgagaagagcactataaaaagccaggtgtgaggaggtaaagctcccataaggacaagatcagagataaacaaagagtctctgaactgctaaagaggcttgccagggtccctgagccacctctacaacagttttcttcctcctccgcttccccaacacaaaggttagtttctctgctaaataaatattgaatacttacataacaaatatcaatttgaaggcacataaaattatgagcctgcccaagtgtcttcttggcctaccatgctctgagctaactggggcactgagtgtaaacactctcccggctactgctttgctctttccctccctcattattcaccacattcagtgaacagaaattccagcttgagccacctgtagtcatgtggcattggtccaaagccctcactaccatgggcgccaaccctaaggggaggtatcctcagcactcactacgtgaaaacctactttgcttgggaccaagaaaagaataattcagcatgaatacgacatcactggaacttgttagtgttatttgaaagatgtggctgaagttttacatagggaatgtgtgcttccatcacaagtaacacagtgtatacaaaactaacaaagcagtttgtggccaagaggtttttgttttctaggatgaataagaagtccatgttcttgaaggaacttgaggaacaatgactacttcaagtccaccctgaaatatggacacgatggaaaagcaaaggtgggtcatccacctgggaatctctagttcaatggttagctcagtaaatcttcccaatttaccatgcagatccatctcccttaaccccataaactgggctaaagaataaacatattgcaatttgggtattaatttaatcaggcatgattttgcagagaagcccatggcaaaaaaaaaaaaaaaaaaaactttctataatgaggtccaataccaaaaatagtagtaacaataatttaaaagcagattgtttaaaatccatctcttcctctctgtttctatccataattgaggaggaagagcatttgttcagcctactgtctgccaggcatgtgccaggagcttcactcatctcttcaccccagtatattattgctgttgtatggatggagaaaccaagatttgcagagattatcacctgcccaaggctaccttcctgggaagagggagatctggatttgaaccccacctcggtctgagtccaaagcctgtgctcttcccacattgtgctgctggccatccctgaagctgccgctgtaggtggagcatactccctgagacgaaccaagggagtagtggctatatatatatatatatgtacacacacacaaagcaaacaaacaaaaacaaaataagttggcgaggatgtggacaaattgcaacccccgcatgttgttggtggaaatgtaaaatggtacagccattgtggaaaatagtttagtgattcatcaaaaagctaaacattgaattcctaaatgaccctgcaattccactcctatgcatataagaattgaaaacaggaattcaaacagatacttgtgcacaactgtttattggagcattattcacaatagccaaaaggtagaaacaatctacatgttcattgacaaatgaatggataaacaaaatgtgtggcagacataaaatggaatattattcagccatcaaagggaattaagtactgatacgtgctacaacgtggatgaaccttgaaagcattatgtcaatgaaggaagccagacacaaaggtcgcaaatatatgattccatttagatgaaacatctagaagaggtaaatccatagagacagaaagcagatcagtggttgtcagggcctaggaggacagaggaatggggagtgactctgatgagtatggggtttccttttgggtttacagaaatgtcttgactaaatagaagtgatggttgcataacattgtgaaggtacgaatcaccactgtatcgtacacattaaaatggctaatagttacttttatgctctgtgaattttgccaggattaagaaaacaaaagagtggtaaagttagaagatatttcacaagttctctattgcactgcattctttgtggatgaggaaaatgagctgtcagtctgtccagtgcggaattacatagctaaagtttgccggtgaagttggggttagaagtcaaccctctgtcaattaatttatcagagcttgcacccaggctcacactggggctctggaggaaaagaagaacaatattgagagaaataattctttctcaagtgtaactgagagcctcccagttcctgcctctttggctcaaagctcatattcctgggaagtcatcctcccttccactccagggaaaatggcttcctacttttatgtgaaaaggagccacaaagaattcagcatcatgaaacacccttagctctatcaatagagaaatttctgtcttcaagggaagtccacttgatttgcttctgcttgaagtgaagcagataacctcaatcaacatctgattacttctttaatttccagagcttgctcattaccgaagccacactgtctctagagaaggacctagagtaactcagattttaacacacctgggctgacaagttacttagcttgggctttaattgagaaatcagttattttacccattattttgctaacattatcaaaatcctgtgatactcaaggccctgaaatgacattttcctctcctttatcatttgtacatgtgactaggagaaaattatgtgtgatggacatgtcgaagatacataagttcttgaagagattctttcctacttgctctactcactgatccgtttccactgaacaaattgagtatcagcatgagaagtcacaaggcagggggttcattctttcttccctggcttggctttctaaagcgtgtgagttttatattgttgcttttcaagatgtgaagttgtgtgtaaatttgtgtgcatgtatgatgaatatttttccctgctaaaaggtacaatgaaattgatagtgaaactttgcaaaccaactctccgataagcttctagtgtttttcttttttttaggtttgccactaatcctcccagcatttctgcagattgtaactgaagctcagcttttctaggaggaaaatacctgttatggtcaacaacctaagagtcactcttgattcctctccattttcaactaaacagctgctctgtctgtgacgcctccagcatgtgctcacaccccaatggcctcggacctctcccaaggcagcatcctctcagttgagacctaagaaaactgcctcccaaatattttccttgcttttgtctttccctgaactctattctccacatcacagtcattatttgctaatggctttattgagttctagtttctacaccatacaattcacccatttgaggtttaaaattcaatgggacaatcaattttaaaacactttcatcacctcaaaaagaagccctgtagccttcagctatcaacccccaatctccccacaagcaaggagtcagtaatctattctctgactctatatatttgcctattcttgacattttacacaagtgaagtcatatactgtgtgatcttttgtgactagtttcttccacttagcataatgctttcaaggtacacatatgttgtggcatgtttcagttctccattcctttttatagccaaatggtattccactgcataagcacatcacattttgttaatccagtcatctgttgatgggcatttagattgtttcgctgttatgaatgttcaagcgcaagttttgtgtggacatgtattttcatttctgttgggtaaatacctaggagtggaatgtacatgtcatggtagctctgtctttcagtttttcaggaattgccaggctgttttccaaagctacagcaccattctacatcatccccacgagcagccacaagggttgcaatttatccatatccttgtcaacacttgttatgatctgtcttttcaagtatagccatccaaatgggtgtaaagtggtatctcaccatggttttgatttgcatttctctgatgactaaggtgttgaacatcttttcatgtgcttcttgactatttgtatatcttctttagagagagatgtattcataaactgaccatttttaaactgggctgtcatttcactttctttgtaatgtccttccattgaaacacaaatgtttttaattttgatgaggtccaatttatctactttttcttttgttgcttttgtgtttggtatcatatttaagaattcatggctaaatccaatgtcacaaaggtctaccccgtcttctctcctaaaagtttaaatgtttttgctctcacatgtagatctttgatctattttgagttaattgatgtgaagagtccaattttattattttgcatgtgcctatctagttatcccagcaccattttttttttttttttttgagacagggtctcactctgtcacccagactggagtgcagtggcacaatcacaactcactgcagcctccacctctcaggctcaagtgatcctctcatctcagcctctcaagtagctgggttcacaagcgtgtgccaccatacctggctaatgtttaaaaaagaaatttgtagagacagagtctcactatgttgcccacactggacagcatcattaattggaaaaactattctttcctcattaaatggtcttggtattattctcaaaaattagttgactataaaaactggatgtatttctggactctcaattctattccactgatctatatgtccagaatgactgtttaaaagtggaaattgcattattactctttctaaagtaatagcctaatgcccaatacaagtcattctctatcccaaggattcttcacttggggccatatacttccaagaggtccttgtgcagtactcagggagtccatgatttggaccaaaaaaattacatctttatttttattaacctctaattcaaatttggcatttcctttaattatgaatatagcaataaactgtagggagccaaaggcccatgggacatgaccaactcagcattccactggaggctatatgatcaaacagcaaactgtttatcgtgaatgcagaatgtgagcaaactcaggactgcgcatgcctccaggaggtttgctaagggccaggaggtttgctgggctccttaaagttatctactgggaaatctagtgcctattgtttgaagaatgcagtcttgcaagcctgctgtgattcaaactgctggccgacaaccacctgcccctttctcgttatctcttttacctaataaattcggaggaccgaaacagctcagggcccttgtccactagaggcgaggtgcccccaaccccttcttccaaatatactctcttgtctttgacttttattccccagttagccccactttgttcagtccaccagggatcatggcaggttacaagtggcaccccgaacagtgacagaatcaggtgttctacaataaattagaacagtattaatgacacttgtaactttttttagcaacagaaatctcagatatttacatataagattacaattgttacaggtatctcaaagtattacttatattaatcctactttaaaatgatggtggtatattagaattattgctggatcttcataaaaatgccctaatcaagaagcaagcagactttatcataatttgttttttataatctgataactgattttaacataatctattttcttataatccaatgtttttatattatgcctttataaataatatttttctgagaaaggggtcatagtcttcaccagactgccaaagaagtcctcagcacaaaacatttaagaaaccctgctttttccattaccagttttattttcttcccagcacatggcatcaactgaatttatcttatttacttgtcaacttgtttacggtctgtctctttctgatactggaatgtaagtgcttagggcttaaaatagtgtcaggcacataatagccattcaataaatatttattgagttaattacggaatcagcagcaattttctaaacaagagctaaatcattggcttaatgaaaataaagactactgataccaaattagtgacatgtaatccatactgaaaattattttacatttatgccatcatcatcattagatttaataaatgccagcatgtcctatgtgctgtattaagtgcttgatgcacagtatctcattcactattctccatactaacaaccaagaatatcattaaccatacttacagttaagggaactaagcctcagagaggttaatttctcactcaagttcacatagctaacaaatgacagagttgggatttgcaaccaagcctacctgccttcagagtattgatttttaactacaataaaacacttctaagagaggaggaattttcttcctgttcaactgagaaagctaagatcctgtgaagttaagaaatgtggcccagaacgcagagttcagcagagatttccaataaaatgttctttccactgttctccttatgagccacagcaggaaaaccccttagcagaactgggtgctatcaggttgcctcctacgagaagatgaattttggaagaagcataattaatactagcaggcattaactgaagcctgttcttttctttcctggggtccagtctgcttctctaaatattagggcttggcctcattcagggcattaaggacttcattaggctgaaatccaagttaatttgattgcacaattataaactgtccctggctggaggttgtctcatttgccaggttgcaagggggcagcatggctggatgacatgcttttgatccccagcttgaagtttcagtgctttctggctttgacctcatcaagttttacagaaaggaagttaaattggagcagggagacagatattctccttactaaagttgtcacgggcacacagaggaccattcatcaggtctgcaaagaaacaaggcacaggaaaagtcctggtcacccggaggtggcagcaaatgagatctaaccaaaggtccattatgcccaaggtcactcacccacatggcaagcatacatccaggctgacccctttcctctttcctgtgcctcattttccccttactggctaacaggttattcagcccgggtatgcagaggagccaagggaaggaataaatcgcttcgttttcaacagggattttgttgacattagtagaatctggaagcatccacttcatggagtagcattttcctctcctctgctattcatgcaagtgatcaaaggacccacttccagccttcctcaagagaggcctctcctccagccaacaaagtcccttcactgactatttttgtaaagacattaactttgcccaaagagaggcctggccttgtcctgagcttctgggaggcaatgtctaagcccttggagtgtcatgcctgataaaagtgtcttttccaggggtcttgggctggccagatagtaacagtgttattttgggtaggggctgaccatgccagaaagtctaacaatgtcatttatgatggaggctttgggttacatggtatccatccacctccaggggagcaggggactgaggctggccatgagggcagtcattcaagtttacatgatccagtcccagtaaaaactttgaactccgaggcccgggcgaactttctcgattgacagtactccttgcgtgtagtcacacattgatgctgggaggtaacacgatccatgactccacatggaggagataatgaaagcaccatatttggatctttcccagactctggcctatgtactttgtcctttggttgattttaatctgtatcttttccctgtaataaattgtaaccgtgagtataatagccttcagtgagctctgcagtcctatgcattatcgaacctgaaggtgacttggggaacgtgccaaacctgcagttgatgtcagagggaggatggtcttggggactgctcaccccatgcccctcttctgcagcatccaaattctacccatgccttgggacccaactctagcctgccatccttccttaaagttccctggattactgcaaccagcaagtatgctggcttctacactaaaagctagtgtttcttaaacgctttttagcaaattccacagtaagaaacagagtttacgtcacaaatcagtacatttatacagtatacatacgtttatacagtatatatacatttatacagtacatagatctatatatgtaatggaaacaaaagtttcataaaatcaaattgaacttctctagctatatttccatcttgggctgatcaatctcatgttttatttatttatgtatgtacttttagagacaaggtcccactctgtttcccaggctgatctcaaactcttggcctcaagccatactcttgactcagcctcctgagtagctgggattataggtaaaagccaccatgcccagctgtgtcatcttttttaaatgcttgtttttcctttcacaaaccatgaatgagttgagattgcagttttcagaagcacaggtctcgtccattattctgataaccgatctctttactgccttacaatacatcttattttgtttcttaacttcactgtgtttatatctcatctctctcaagacctgattaaaagtttcaaaacagacctcaaaaagaacaataccaataatatctaatactttttttggtcatgttcaagctgggcactgtactaagagcctttccatgcagtgtctaattgtttccacacactactatcaggtaggtattatccactatgacatctctcatcaccactttcaccccatgtgacaaaggaaagacttcatagcttggaaaggttaactggcttgcccaggacagctacaaagtagtagagccaagtaagccaagaaggtctggtctgattccaaaccctggtgttcaccactaggctccttcctccccactttctttttgcaaaattgtttttttaaagacagggtctcactctgtccctcaggctggaacacagtggtgcaaccagggctcacttctgcctcaaactcctgtgctgaagccatgctcccacctcaggctcttgagtagctgagactataggcacataccaccatgaccagctaatctttaaaacattttccagggcctcactacattgcccaggctggtcttgaactcctgggctcaagtgatcctcttacctcatgtgagccaccctgcccagctacattcccacccattttcattccccgccagagctgcccagcagacctttttgccccagagtggaaagggcacagatgacaaatatgaatatacaattctggcccagtgggctcaaagaggagggagttggcaatgtttcctcttcagccagcattcttttcaagcaaagctctgtgaccttctacccgaaggcagcgctctcaggcctgtctgttgcggttcccctcactcatctcaggagagtctccttccagaatgccaggcacccctgcctgcctccccactgcctcgccttccctgcaccaattaaactgtcacagtcggctggcttggaggcaggtgaggtcaggaagaaatctgaaggaagctgggaattcagatgagatgaggcctccttgtgctgaagctcctcttctgttttctgtcaaactggtctgaagactgattggatgagcccatagagatccctggcgactctctacactcacctcttcctctccaatggagggtgagaaatacggccttgtacagaagtggcagcttttgcatctgtttgggtacccagtggtccctagttcctggtgcaacagcagtgggtctcgggtggaatgattttggctggagattgtttgcatcctggaatcattgcctaaagaggaatttgtcctctacaaacaagtgctaacccacaatacacaagagaagcaaatcaaagagctcttaggcttggcctaatagatgcatcttgtcttacctaccccttttagtgttgtctgttattggaggaagaggtaggaagcccagggcctccctcccagagtttccttagcatcacctgtcattgttgagattttgaatgcattgcaggttaagggacacttgatcaagaagggaaaacacagcagagactttcacttagacatgttttgtatgtcatgcagggaaaagttcccagtcaacctctgcttaaccttcgggtttgaagatggccctctggcagtcacctgatcttcatggcagaagaaacaggagtgaatgagcagatgaatccatcttaagagaatagaaatccttagtttgggtttcattgaccaactatagggtacctggcaggcaaaatttttgcagctttcatccaattcccaaatgggtgtttgacccacaaaagaaccaccaccagtctacatggtaatatacatacattgccttctataattttacttgctgtagctgccaaatcttattcatacttcctccaagcataagcacatgcatgcacacagacacagccgccaaatgcaccctccttgtctactcctcagcctcacctcgtacctgataacagattgtactcaaaggcactggaagaccacatggctgcctggagcacctttcaattattaatgctgttctttaaaggccttgccttattatttctactcatgctattatgaagagggcaaactccttaatgcactcctgtgccacttcctcccactgctagaggaaaagcacatgctaggtacagtcatctaatagcatccacgttattttcaccttctctgcacactgtccctgcagttctctctggggcctcaagatcaattgtatctcaaactgggccatgggttcattttctgcattttctggcatggagtgagggtagcgggtgtatggaaattccagctctcaaattacaaggtggcaggtctctgcatgggtgtgatgagcaacatgagataggtatccttgttaaggacaactgcattctagtagattccaccatcagaggtcctggagccctacctactatttcttcctgagagtgtcctgataggtaaaaggtggtgtgagtgtcttccacggggaaaagagactgatgaggcagctctactgaaatggcagttgatattaatagggccatctacttcctactttgaaaatatctgagctataagctcagacgctacctatcactaactgccaaatttccatgaaaaagggtcagtgatgaagttgtagcctagacttgggaccatgtctcaggggaaaagtctaagtatgcctccgattttgttttggaagggacgacaccgtaagaatttcatcagtaaatattaaatacaaagttcagcaaattgtgaactttagggttcatgaaaactaaagccaggatttatccatgtcaacctgtaccttatacctacatatgctagaaactaaatcaagtttcatacaatgtgcccatttagctaagtaagtcagaggatagtttccaataattactaacacttacacacttagtataatcaactcttctttggtcaagttaatatcctggcagaacagacagatttgggcctctcttcttataaaaaaagaatctgacaatttaaggggcatatgttcacttccatttatgtcctggaaaatatgccctgtgacttagcaaccatgttttaaaagctcttgcagttcttaaacaaacagagtgtatgtttatgagcttctaacaacgttattttcagagatgatgtagagttagtgatatgtagctctggggcttacagtaagctgtagatgatttattggtgtggcatacagtatttgcctcgagaaaaatggaaatttaagcagtgtttgaaaatgtgttagatggcaaacgacccggggcaccctgagaccaaaggcttcccatcttagagagagaaggggtcctttttggcagatggaggagcaagggttaagaacgtttcctggcactcagggagcacagccaattcaagaccagaaagagagacagtttagaatagaggctgaaaacaggaggcccaaatctggcctgcagaggtgttttgcttggcctgcaagtactttaagagttttggatttgaggccaatattttaaaattggagattcaacataaaatgcagtattctgtctcctctttgaaacacaggaagatctggccactagagcctgcatttctgcataggaacaatcagctggacctgggaagccacttcaggtgaggcttcagctctcattgcagtcctcaccagatccgcctcactcatttccaatgtctgcccttccctgtccagatgaatttgcaaacatcagatgaaaaaaatgttattttgtactgttgcactctcagcgaacagatctcttaaaccagtaagactcattgtcagataaaagaatggaaaaggcacatgtttttccaaaactcgggagaaaagcaagactattaagttgtcttaaaatttttgttgtatccattgttttgaatgctgggttgctgaagttcctatttcccaaagccaagttatcagacagggcttaaaataaaatgcttattttaattttctcatttgaaacaattagaccacattgaaggggtttagtataaggcatctgtctctgagcatgttttcttatctgtgaaaatttccagaaggatggggctgttggaaagggagaaataaagtcaatttctccagcaggcagtgcaggcacagtgcctgaggccactgtacttatgggacacaaaaaagtctaaattttaacttctttaaaatcagaagaaaataaatataataataaatgacgaataataacaacgaatccaggctgggcacagtggctcacgcctgcaatgccaacactttgggaagctgaggtgggaggactgctagagcacaggagcttaaaaccagtctgggcaacacagtgagacccccccatctctacaataattttttttaattagctgggcatgatggtgcccagctgtagtcccagctactcggaaagctaaggcaggaagattacttgagccctggaggcagaggttgttgtgagccatgattgcaccactgcactccagtctgggaaacagagtgagaccctgtctcaaagaaaaaaaaaaaatttgccagccatggtggtgcattcctgtaatcccaactactcaggagactgagactgaaggatcacttgagccaaagaggtcaaggttacagtgagctatgatcatgtcagtacacttcagcctgggtgacagagtgagaccgtgtctctaaaaataatagtaataataacaacaataataaatccagcctggattatattcattcttataccaatgcagccgcaaaatataatatttaatattcttatggaagaattggctcaacaaagccaacgtacctagagtccatggaaatcacagcacggagctggaggcaaatgctggtcttcaggccaacaaccatgcccacactgtggcctgtttgcgagcagcacaagctcattttactgcagactctcctccccatcatgcccctgtgatgctctgtatgtggcaagttcgtaacaagacccctgcaaagcacgtcgcacactgacctcagtttcaaaaagatggagtggatgccattcagatgcttctggaaatttccaaataaaaatttccaaaagttttaatcatctatcattggacaacaggtattactgccactggatagagtccgcttctctgattattttatgccgtccctgaagcattctcaatccctaatctcagtagctgatttcaaggcaaggttttgcttgactttagcgtatactgaaaatcacaaagcccgagtacaggccataatgagagtcttctcttgtggactcctagagttgagggcagactgagttttctgtctattcaactcaaaatctcccctacagccaaaacatgttatagcatccagctatcttttcaactcctcaaccttcagcacttactgtgtgcaatgctcatattagtcattgatatattgcttagcgatgccttacttgttcttgttttgttatcttatttttcctttatatatggctggacttcctgccccttgtaaaaatatgtataatttaaatgtcttaatggaaaagatctagcattatacataagtactcaaaattccccagtacctagcaaaatgccttatacacagtttgtactcagtggagagctattatctgattggtacctttaaggccacaggtacacagacagctctcagcctcatctctgctactgtgatgagcctggtggccaattcccccatgctcttcttctccacttaatttttaggcaggacataattgtttcctacacacacacacacacacacacacacacacacacacacacagagtctttctctccctctctctcttttctcccaaattctatgaacaaagacatatgcatcaaaaagtcccaagggcattgttgctttgagagttctatttttaagccacaaatgactcatcaccaaccagggtctccccaaagctacatgtgtcaggctgtcaggtcaaaagacaaggggtaaaagacaaggaagagttcacatctcctccagcccatgaaccccatgataaagctgtaaaagctgccaccactccacacaccacaccacacccctaccacagttgtgttaggcacaagcactgcccttgtgtttggattaaactgttctgagctataacatttcgctccagctggctcctatcctgatctctcagcagtctctgaatgcatgtcagcctgtgactatagggaaaggcccagtgccatgtgacagggaggagatgcagccctcttgcggtataaactcaggcttgttgtagaggacagaagtaactagtgggctagtgggtctgaaagggaatgcatttcttcatttgccctgaaacaattattcttttaaaaagaataagagagggctgagagagtgccaggttgtccaaagcattctttttaagttttggagagtggcgagaagggaagaaataattcatcctaattttggaaggcaaagtagatagggatgtatagacatagttatcagatagtgtttccacaggggaaacaagtgagcaattgggcaaaatgtcctcaaaagttatgcataacaaattccaaacaggccaaaacaatgtgttcagctcttcaatgcgttcagccctgtgttacccttccacagtggagctgaactcttaactcttacccatccccaactccatgctgaaacagtacaaaaaagagagggagacagtggggagggagagagagagattagtaggagggtcataaaatcaaggaattcaaggcctctcaccagtgaggatgaaataaactaatcccacgcagccacctggctggatttgatcttttccacctgggattatctttgttctttcccatggccctaaagtttcccccatgataagggcctagaagtccagaattggcataaaaagacaatatatactttgctattcaatgagtaggttatcatgtctttgttcatttctgtatttagtagaaagaacccaggagatcaagtagaaaaggactgggagagaaaagttctatcttccagctccagctctgcccctggctggtcggatgaccttgaggaggtccctcatcctcattcctcaggaaaggatgctgaggctcagagaacagtggcaccagttgggatccaatgcctctttgactctaatactatattctacagttgtcttttgtggcagacctgaaaggttcagctcagtcctcctgtcctttcctagcatagtccctgatttccccaatgaaagccaaagataagcagttcccttaatgcttctagatgccattgcctacgatgcctaggtaccacttgtgcaatgacaaataagcaaggaagacaagatttcctcaccaatgtggaagggagaaggaggaagggtgctaatgctctgaactttgacgtaaatgaaaccaatctgtttgacaaccaaagaacagatcctgtccccaaaatctacctatatggagacaaggacatataaagaagttgactctgttccttggcatactctccacctgtcttctctaccaggctttcactcgattcctgaacaaatggcaatatggaaggtcagatgagctaggaaggctgagttagagttactctcatatcagagcaccaagtgttgctattaaagggtacattctgaagggagacaagacttcccattggagttatttacagcctctttgccctgaaggcatcttctcttccaccatccctgagtgggctcggctcctctaccatctgacattccattctttcaacagctgctggctctcctgttgtgttcccttcacagatgtgcagtgccgttctgaacatcctgcccttgaactttccctacccataattttccaaaccaaagcctggcaataaaaatgtcagtgagggatggagaaaactggggggagtattttaaaaggaaaaaaaaaaacagggaggtgctttgcacacagtgatttgtgttgacttcttcaacaaaggttaaatgcatgccgtgacttctcaaaaaagggcatgaaggcagacagctggagctaattttccagaacactacctagaaaggctgtatttcataaaggaactggttacagagtaggctggtgagcttccttttccatgtcacaggctgcccatctcatcatgctgcaggatggggtacactaaaggggatagtgaaagctggtatacacagtcctttacagtttaaaatgcgctgtcatgaatgggatgggatctgtgctgtcctcacagctctcccaggtgcctgtcttggggctgagcacaggagaggcagtgggtctacacctgtgcctagtcagtttgaacaaggctggagaaggaagccagatactttatgacatttcaaagacctccatcctatgtggctccattctttggggccaaattttcctgaagtccattagtttgataataccaactctctgggcatataaacattgcataacataatgcaaaactataacaaatcaactaattctgtaactctctaaaagagataaaagaatgtatctcatggggaaacagcatttctcatatctatttcagtatgccaaatcacaaggacagattaggtaaggataggaaggccaaagagtctttctacttggaaagacacccctaggtggtggaagctaatgaggaacaatcagctctccttgttttttgttcatttgatcctatctcattgcaaaatgctgccactccactgagataacagagaagctggtctcatcaagccattattaggaagaactgaatcaaggcccaaacagacatcagacagcacctgacccagggcagtgtcttacatggaaggcctgtgataggagcctcctacgtacccacaactgcacacttggttctcagggtgagaaatggagaaagggagaacaaaagagaaaacaagaccagtgcattggcaggatgaggtgatgcaacttcccattcttgcaacatctcattaaaccccatcagttacttacacaatctggaaatttacttcttgacacttagaagagagatggctttagaatgagccatgctggaatctaatcctggctctactgcttactagctacatagcttgggctatgcctgcagcttcagcctcctcatctgtaagtgggaatagtaatacctatcctaagaagttgttaggggaattcaatgaggttgcatgtgctatttttggtaaagtgcctagctctgtagctcacagacagtacataatcagtgaatgttagttccctccaacgacttgccctctcttcccttttgaaacagaatttctaggccaagggatgagagaccaggctatgtgaagacaggggagggagaaactactgggcaactaaaccagttctgctaaagctctggacatccccaatacatcaatggtgccagttttattttcagagactatgaaaacaatctggtcaatttctatcgcaatcttaaagatagttttccttaaccataagcaattttactgcctggaaaatattcagcattatcacatttgaagatgttacaaactaataaatgaatacaaaatgaataaatgggtgagtggatgcaaaagtaacattttaaaagactggggagaggccattttccaatcgtaaccccactgttgccttggcaattgtgcccttggatgagatgctctacaaaatttgtgctgccatttcctgctccttcctaacgtccatatccccaaaacagcagtgctgataccagaagccaagagcaaagactggcaaaatcagcaagtgcccccattgtgtgccagccattttggagcagataaagtcattaaggaaacatttaacaacgtataacctttcagctttactctgcaaacagcaggtagcttccctttcagagacaagagcctgcattgaagtcaccagtgagcaggacttgaccttcattttcagtatacgccacattaaatattcataatccgcgtaaccgtagcataagaagtagcagcgtttaaacatgaatcaaaggaataaatatcttcacacatgtgagtcatcctttcccagaatgcccctggtgaaaatgcaaatacccagagctctgggcctctgtctcttccaactttctcttgaaattctgaaagctacagggactgctgcattatgcaatccatgaatctcgctctcatgctgacactggtgggtctttgttttttttccttatctgttagataagaattgctgttcttgtgtcaaagggaggaaatagacaaggatggaagcagcaatggtgacattagcacccacagggcgtctgcaggcactcttgacttggttgtacaatttctaaaaaatctttgcttcacaaggatcagaatatgtgggaggacagggttggcgttggtgtcgggagacatcagaattaggaactaaagtgacgtgtgacataaattgggcaggagtccttttaaaaagaatgcaaaagaaagggagctttttgtacacaatccacctcgtgtggctaattggagatctttggggagatggtgtgtggagggctcaatgcttgtctgtgcttgttaaggcactaacatgatgtctgaccaaagactcagtccagaggcatcttcctctgcttgggtgtttctagagagtctactgctgggatgataaagcataattttagtaaggtttaacgtaattatctttggttttcaattccaggagctctgaggacaatctgtcttagccagatagtaatcacttgcagctacacaaatgagtcttccctcacaaccaccctaggttcattaagatcagacccaaagaaaacgccctatgctgggatctgtctttgcctaatggccaaaaatgaaaggtgtgcagctgtctttggaagtgacttatccatcacctctggatagtaaaaagagctttaaaaggttaaaaagatcataaaccaccaatgatgacctttctctgagctgtattgctaatggacagaagtaaaataactacctagcctgcttgtccacttgcacaactggagctggcctgcctcgagacatagctggtccagcagacctagggagcctgttttatacattaatcggcattccttgcacttttcaaagggctgggtgcagagagcctggaatctcaaacttgtgctacaggatagtcctcagcattctggaggggaggggcagctctggctaaaattcactgagacaagccatttcacgcatgtctgttggtttagattcacttgtgggaaagcctatagactgtcccctgattcatttatttgaagggtgtaaatactagctacaattcatctggagaattctgggtgctttttttccagggtgatgatttagtataacttccacgagaagtttaaagctgtctttccaaaatacccagatggccagccaaaccatgaatgtgtaaaactggtaacagttttgaatgaaagacatggattttaagaatgtacattctactttctcactttctttccatttgcatcttatatgtggatagaacttcatttttttttctcattcactaagctcgattataattttttaataggtttcactgtgttttattcctggaaatctatggacttaccatagagatggctttagagattctacactaattctctcccaaactaaaactgagcttgcttgccgtctttcccaaggaagatggaaaactcccttgtgctgaatccactgattgggcctgccaccggacagaatcttcggatatgctctcagaacaaaatgaagtcatgaaaatgaaaagtttctatataaataaccagaaggtcttcttataaacaaagccttgctatgccaaatcacacagtttagcaacagagaagaaaggctaaagctgggatgaggctacgacagtcctcaggcagaatgggaatagccttgtttctaaccttatgggcatttttgccaggaaaaggtgaggacaggactgaagttccatccttgggatagactatttgcaagttcataaaagaaaccagaatcagagaggactcccagtgccatcttcgccaaggcctagaaggatcacaattaaagccaaaggacattgagatggtgtaggacattaggggaagagggtgcattggggaatttcattccttttcatcttctcacacggaaacagagaacaccaggatctacagaacaaaagactgcctcatagtagactgtaaaaaaagacacaatccaaatccatctaaagagcattttatttctgagaaatacagagggacaaaaggttaaaaaaataaaaaaaataaaaaaacgaaaagggaaggaaggtgctggctgaggcatctggacttctaacccatcaacacactcacctccacattagggttttctttctctgggacatacaagcttcaagcccaaacctctttcctgagtctcagcatggaagttggcagggtctgcaccccacgacatgtaagaacacccctggagagagattggagaaataagaccaggggctttagaggatcttcagttcaatacaaataggatccagaatcattaacagtaaatatttaaaagggggcttaccttcaatgacatgccaatgggagtcttccaaacttaaacaagctcttctctttcttggctcgggagagctgatggagggagcatgtggaatcttgtctcctgacagcgtttaaaggactctccatctgagatgggtgagggcagcccagcctcgcatgtggggtgggctgaaggacctctgataggcttaaacttggctgattcccagagacaggttattaaaggagatatttgctttgttttccctgactgacattttggcctctccacccaaatgcacaaaatccttggccggtgaccagatggctctgagaaattctgagtttagctgtgcatgaaattaccaccatcccaagccacaggaaaggagcactaagctcagaattcaggcacaccagagtctgagccaacaggcacaccaagcaggtttcctagtatcaaagtctagtagccaaccatgccagggatagagtttaaagttcaaaacactcacacagtggacaataaaggcaacaagctcaaggccattgtcaccagagttgccaagttcacgccacaacagaaaatgagttagactccagcttgtttcccagatgccatcaacttcatgatttgcaatagtatagttggaacaaattatttcctcagggttggcacctgcaggaatcagggcagaactggctgcaacattgcagttctagtctgtgccctcttcatccttctgcaaggtctttatcatctgtcacccaggctcactctggagcaccagtccattcggctggcacccaaggagtctgcatgagtgtccactctagaagtcctcaaatggccagggcctccacctctgggggtcatgatgaactcctccatccatctccttaccttcacaagtcaagaagcaccagcgtgcaatgcttcagctgaatacccgattggcaggtgaaaggatagcatcatgctttctaatctgacctccagtaagatcaaagcattggaaacccaattgagaaaaggatcctacaaccatagcaagaatggctcagaccctcatctgtgggaaactgtcaccctcccagaagttgcaaattcccatcaagtcatcttaactacttgacatcttcagtgcaaatacatcattaggaaacagctctttaaaaataagtaatacccagcaagaagacttgacctcatatacctcaccctcctatgccagcagactcaaaatagccttccttctgagaactttctttcccatttagaaaatcagtacagtacagcactagcttcctccaaaatcttctgcactcagaaggtcttgcaaaggttggtgtcaaggtaaataaatggatcaatgtaaaggctcatgattgtttatgaaacgagggcaagaaagtatatttgaatactcactttgatgaatctatgaagtatattacaagtgcaccgatgctgagagcaaagactaagacaacctgtaaaagaagaggagaatgccatcacttaagagttggacctcaggatgtttgggttttttgacacataccgaagcagctttgaaatacggtgcccattgcccttggggacctgcttggaaatctcaccctcatccccagccccccattactgcttcaggtttggctcttcatacagcaatgggcagcaacctcgctccttgccaataggggtcagggtagccttttatgtctcagggcactgggtttttatctgaccctgttatctcgaagtccagcttctctgcaattgtagttgataaacttcagtgggaaaaaagcaggtgaaaatttagggtgatacaatttttaatattatatgtagtctaggatctgcaggaactccaatagaggaatatcaactttaacagcttcattgaggcataatttacataccacaatattcacccatttaaaaagtacaattcatcaatgactttagtaaatctactaagttatgcaatcatcactgtaatccagtttcagaacattttcatcatcccagtaagatccctcatgcctgttaaatcaatcccctttcccatttccaagccccagaccacactaatctactttctgtcactacataagagataccaatttgaagatcacaaatttgctcgtacaaatgtccgtgtgtgtatgtgtggacatacataaagatatattcactgcatgtatgatctatatgattagaacacttctgaaatatttaggaaagtagttccagttcaggaagtcaattaggcaatccattaggccagttatgtgacaatccttgtcctactttacactcttcactcaaaattaatctccatggatggaagacagttttggcatctccttcagtggatacctgtcatgctaaggtccatagaatgaatatgtagcagattaggctgacactgacacttctgtcctcagtacacattctactttctttaatctttcacagaggagactattaatgcaaataaaggatagtcagaaataaagaagatgctttcagccaacaattaagcctgagaataaaaagtaagcaccaccattacacacaatgcctggctgctaggtcaacctttccaggtatgctaataccctgaagagactgcaggctgaagggcattggaagtcagtctcctcagtgtccatctattgacatctctcaggccttggctggtgggtagagaggaatcccaatttatgtaaagactaagcatgatcaagctttgtgtgtgtgtgtgtgtgtgtgtgtgtgtgtgcgggcacgtgtgcctgtgtatgtatgagagacagaatctctctcttttacacccacccacacacacacacactcctgtattttttatgtgtgccaaagtggctgacagaaaatgaaatctgcatgagatactcatttaaagcattgcaaaactgcatggagctcctggggcagaatggtggcttgcacagcccagaaaatgaccattaaaaacaattggacactgtaaaaggaatatgcagtttcatagcaactgataaaatctccatataaagggaggtgctaaaacaatacaccactgaggtttatttcattctgccatttaaaaaaaaaaacaactaaaacatgctccaattgaatgctgcagtctatcagtaattatcacccgcccagcactaatccctcttagctgcctcacctcaacccctcccatcacacatattcattcatatgttcctttcaaaggtacacacaaaaacaagcaaacaaaaacatgagcaggccttcgctttttcctctattatctaaaggaggcagcaaaacaaaaagcttaagattaattttgatctgtgctgctatttctgaggcataagcagttagatcctggccctgacctcattctcaaaaagctgcaaagagaaggggtgtggccagaacccaggagaagggcctcttctccattcataaacagctgatttaagactaatccctgtccatttggctccctgtgtgtgtatctgtgaatgctgagcatctgtcagagctggctatataggcctatgccacccaaagccactgttgcagaaaaggactggaaagaagcccttgcaaatggcatctacatcattctgtaaggaactcaaaatctaagacccctgcaatggcaatgatttcgcagcatccagatggccaatgtagctgatcctaatttgctccagctgcctccacttggagtcagtgatggggactaatgcattccttatttaagcaaatcagccagtgacaggaggaggccaggaatcctgctaccctctgaagatgaaaactcaaatatcagcatctctctgatagggtaagagagggaagaaatccaggagggaaataacctccacagctccctggccctgaagactctgttgaatggacatgcatttgggtccacgtattcagctggaaggcctcctctcaatgagatacaggataggcaaactgccccatgatgtacgatgaaatgctccctggggagatgatctgcctctcagtattaaggtaactgtgcacgtagtcttgaaacttgctaaatgcctctttatcgtgtcaggcttgatcacattgtcagcccagatccaggtgctgcagaaaacacatcaatactttggatgtggccatgaaaatagaatccccatcagagacttgtcttctctaggcccctagcaaagccaccttagaagtgtcagtttagtctctctctttctctatctctctaacaaatccccattgtctgagaactctaagtttgaaaacacaaaatgattacattttagtctgcatggtaatggtattattatagagcaccccaaatagtcacctaagtatttaacatatcctatacataaggcccaagaaaaacagaagatgggaggccacttggagtcatgaaatatactcttttttttttttttttagacagatcctcgttctgtcgcccaggctggagtgcagtggcgcgatctcagttcactgcaacctctgcctcccaggttcaagcaattatcttgcctcagcctcccaagtagctgggactacaggtgcctgccaccatacccggctaattttttgtatttttagtagagagggggtttcaccatgttggccaggctggtctcaaactcctgacctcaagtgaaccacctggctcagcctccccaagtgttgggattacaggcatgagccactgcacctggcaaaatatactcttttttatagagtcattcttctgtagattaatcccatgctattatgcaattagtgataaatcatatagtacaggtttagccaatataaaatgaactattgcctagatggatcattagtaactgggtaaagatagaaaaagtagggcccttatctcaatatcctctcctttcccaaaatgtccttcctttctacatagtaccactactctaatatctcttcacgaagggctgaggccattgggaatccttttgcaagcttctatagtttcagggacaaggaggacagaagcccaagggacatggtaaaatgaggccaaggaaagcacagtaccccagaaagcaaagcatccctgccctacagcagctgagtcatagaataagacaataaccaagcatgtaacaaagcattgtcccacacaagggcttgggggcagcagtgtgatacacagataatttgagcattgcctcttagggcacttctgctagcttgcttgagagcctgtcctggttgctaaacttgccatagtctgagctcaacaaattacctcagccatcttggacagtatgaattgtcaccttctcagatttactgaaaacacccatatactgtgtggagatattgagtactcggtgtgccagattcctaaaaacaaaagcaatttgataaatgtcattggaacaatggtgtttgagtcatctattttcaaaactccaagatcaaacaagacatgtgtttgcacaaaagaatgccaggaacacacatacacggtgtatttttttttaagggcagggtgcagtggctcatgcctgtaatcccagcactttgggaggccatgacaggtggatcacttgaggccaggagttctagaccagcctgtccaacacagtgaaaccctggctctaccaaaaaatgcaaaaattagcagttgtggtggtgcacacctgtagtcccagctacttgggaagttgaaacaggagaatcacttgaaccctggaggcagaggttgcagtgagccaagagtatgccactacactccagcctggacaacgaagtgagactctgtctccaaaaaaagcaaaataaaaaaatataaaagtgggctgggcatggtggctcacacctgtaatcccagcactttgggaggccgaggtggggggatcacgaggtcaggagttcgagaccagcctggccaatatggtgaaaccctgtctctactaaaaatataaaaagttagccaggcatggtggcgctcacctgtattcccagctactcaggaggatgaggcagaagaatctcttgaacttgggaggcagaggttgcagttagccgagatggtgccattgcactccagcctgggcaacagagtgagactccatctcaaaaaaaaaaaaaaaaaaatctgtccctaacacctgatgcaaagaaggagcctggtgcaaaatggggaggagagaggggaagtccatagccatctcgctagatgaaaatcccggtggaccatgaagatctttcaaatgtctgacaaggttcatgaaagttcatgaaaatggacaatagcacagccaagcatagactattccccctcaggtgatggagcacttcaggaaaaaggcagattcagtgatgtgagtatagaggtgattgagttgggaaagctggctcttagaaatatttcctgttctagaacctggactggagttgctgcaattaggcccatatgctttcagcgggtgtgtgaggcttcacggccttgggaggcagattcagagccaaggctcacaaaggtggctaccaccagaatccagtcacctgaggagctttccttccaaagcagagatgccctcatcccaccctagggccagcaaatcatgagctgggggaggggaagtctgggcacctctttttaacaagctcctccagtgaatctgacaatgggagtcactgaattaaagccattaggagaaaccacttagctcaagtcagagattaatctacaaatgtcgccttaacaattagcccattagaacatatgtatgaggcctgcaggcttagagaatcgtgctaggagtactagaaaaagtacagagaggaggatgaattaattctctcctgagcaggttttacacattcttctcagctcacagcagaacaaatgaccctaattaatgattctgcatgtttgatcagggtttatctgcctactgaaggcagagacccttctcagaaaatggacaattttctatatatgatcccaaaggcataggactttttaaattgaagtatataatttacatataataaaatccactatattaaaaaatacactttgggaggccaaggcaggaagattgcttgagctcaggagttcgagaccagcctgggcaacatagagagaccatatctctacaaaaaaaactttaaaaaaattatccaggcatgatagcatgtgcctataatcccagctactccagagggtgagtcaggaggatcgcttgagcctgggaggtggaagctgcagttgagctgtgatcaaaccactacactccaacgtgggtgacaaggcaagaccctgtctcacacacacaaaaaagaaaaaaatagatgtgagaactcccaaggcaaaacaatctggtgacattttgttttttgagagataatatcattccaacatctaaattataatgtttttgtcctggtgaatttattaataacaatgccaacaaacatttattgaacacctatgcacaagggccagagtgagagacagagaaatgcaaaactgaaacagttaagtctggcctggcctttgccctcagggagcatgggatctagaagtttaaattactcaagagtcccttctgaatgtaagaagcgctacacatatcaacagtcatctccaggatataaaggaaggatcagatcaggcagagaagcaacaccaccctcatttcagactcccaaagtggaacggggagagaaagtgagaaatggaaaaccaaggaaaaaggaagaagaatttttgacattccaagtccacctggctgttctaggaaaggacagacaccagtgatatggtttggctgtgtccccacccaaatcttatcttgaactgtcgctctcacaattcccacgtgttgtgggagggacctggtgggaggtaattgaatcatgggggcgggtctttcccatgctgttcctgtgatagtgaataagtctcacaagatcagatggttttataaaggggagtttccctgcacaagctctctctcttccctgccaacatgtaagatgtgacttgctcctccttgccttccgccatgattgttaggcctccccagccacgtggaactgtgagtccattaaacctctttttctttataaattacacagtattgggtatgtctttatcagcagtgtgaaaacggactaatataaccaggcacacaggatgagtgatgtggagaaggaagagcacaggacacagaagacctgggtgtgaatctccactctgcccctataagcaacatgctcttaagcacgtcacctaatctctctgggtctaagtttcccaatctgtgaaataatgagattgaaacagatgattatgagatgggaccttggtaggaactaaaaacttttggcttgaaaaggtagccctcacttatgctaactgtaaaccatgtatacataagtctgattcaacatgctgacaatatgcctgtccctaaatctgtatgcaggagacttgtttcataagatcacaagaataaactccatagacactcagattcatagtttgtgtttccagcagcacaatcaattgctcatgcagaatgtcatcccacaaaactaacacaagacatagaagggccatggatcagctttctcctgagtctgggtctcagctctgccatcactacagaaaattgagtggtggtctgacccatcgcctccctctccttgcctctgtgagctttgaaaagcccatgtttttgcaggctttagccttccagaagctcagactgagtctcagtgttttcctaagggaaaaagaaaatgatttttttctctttactgtttagcaagtatagttgatatgttcttgtcattcctaagtcatgaatggttctcaatagaagaagatataggccaggtgcggtggctcatgcctataatcccaacactttgggaggctgaggcgggtggattacttgagatcaggagctcaagaccagcctggccaatacggtgaaaccccatctctactaaaaatacagaaattagctgggtgtggtggcacacacctgtaatcccagctactcaggaggctgaggcaggagaattgcttgaacccaggaaacggaggtttcagcaagccgagataacgccactgcactgcagcctgggcaacagagcgagactctgtctcaaaaaaatatatatataatatataatcttgccaccaaaaaaggatttttgttatcatacatttaaaaatatctgtaatatttctgcagagccatttaatcatccataggtcccctaaattaccaagctagcactatgaaacatcacatttgacttatggaagcacatgcacaaaaatgctgtaaattgattcactggaaaccaagactccaaacaacggattaagtagagatgtattcaagatgaaagaaaggaagaagaaagaggggctttgtagttggtatttgggattatagcattaaaataaaatgcatgggattgccagataagagtaaaactgatttgttcacatgtaaggaaacctagtaaaaatctctatgattttacaggcattaggatctggtgcttccaaaagtgcaatactatgaagccatactctgtgtgcaatggactgaattcttaggacacacatgtaaatcggagagaatccctccttaaatcacctcaaatgtcctccataacttttggtatgaagaaaaaaaaaatccttgacagagtccacaaggccctgaaagctctggtcttttcctcctctctggctttatttcacatgcttccacatctagactccaggaatctaacttgcagttattctcattctccatttgcctcctcccaccccaaccaccacagagccttcgcacaagcactttcctcctcccagaagcctcacctgctcacatgggatgcccatccttcagaaatcagctctgctgtcacttccctgcccacaggtattctgttttgtgtagcagttagcaaagcagcaattttacatgtctttgtgcaatcattttgatcaattgctctcctctttcctttgctggatggcaagttctatgaaggccgggtgtgtgtccatttttagttatcacgaaattccaagaaagtagcaaagtgtctcaatcagtatttgttaaataaataaatatgtggagaaaaggctggagaattagtttgaagactgagtgtagtggaagcaaaagagaggtgggagaaacatggattaccctcactgagtgagaccctgaagtttataacccggaataaaggtgagatgcagttccaggtaatggcagcatccaggggatccctggtgaaagtggagcaggaagaagagcaccgcggtggtagaggtcgagggtctgagacacacacagggatagcaaggacagtcctgcacacagactcaaaggggatggggggagctgaggttgagaatagaagaggacagggccatccctgaatagggggaggggcctggacttagatgggtgacagcatcaggaaggacagagagaggaaggatttggtcggatggcaggagcctggagaaaacaggtttctacaagaacagaagggcaatgaagggccagagtgtccagcactcctgggttacaaagatggcccggcatggtggctcatgtctgtaatcccagtactttgggaggtggaggcaggtgggtcacctgaggtcaggagttcaagaccagcctgggcaacatggtgaaaacccatctctactaaaagtacaaaaattagttgggcgtggtgctgtgcacctctattcccagctactggggaggctgaggcatgaaaattgcttgaaccccagtggtggaggttgcagtgagctgagatcataccactgtactccagcctgggcaacagagcgagactccatctcaaaaaacaaacaaacaaacaaaaaacaaacaaaaacagaaacagcaacctccagagagaggagtgagggaaacaactatgtctctaggaaaaacagattcaactgaggtggcagatatagggagcattacgtgaagaagcagagaattcagatttgaatcaggactaggaatctgtgaaaacagatgtcataagaaagtgagatggagaggcataaaataatggaaatgccaacgttccaataataagtgaatatatttgtgtgtatttgtatgcacacaaacacgctgcaaggggcacagagacaaactgtgattcctctaatcagaaagaccgggtctctgtcagtatttattaaccacctgggggtctctatcagtatttattaaccacctgcatgccccccagcagtttgtctctgtccattttcaaatcaggtcacttcaaagtgactataaatacatacgaaaccctgggaaacaacagggttccctcttactataagtttactataaatcatgcatccatcagtatatagacaaagttaactgcaatcatggacttttttttgagagggcagaagaaaacttgactcatgcagatagacacagtgtctgaattctcattttttaatgctccccaaagaagaatctgggacatgattactacaagccaattgcccaatctcttcccttctgaggcctgtgacataactatagggccagagttatgtgaacttctgcaggttcgtgttccccaaacatcgcaggagtgttgtcctacatcctggattttgttgatgatgttcatctcattttgcccaaattaaaaatacagaaaagttcaatatattcctcctagggcttaatttattataactgaaatgagggaaagcagttgtaacaggaagtcagaaaactttccctaaaacctgtgtccttcctgcaagccgaggtttaatgacactgaaatcttacatcattgcatcataaaacttaaaaggttgctttttgcataattttaccaatgacattaaaaccgatgcactggcaagcatgataaaatcttccatttgaggtctaaagttggaagacctttcctgtccaagtattgaaaaacctaggggaaaaagttccatctgctggtggagcgctcaagtttgcagctaatgagctttttaagaaattgtctgacttaagtgcatgtgggtttggccaactggatttttaatttaattaggtttatgagatgagaaatcttctgtagcgtagtcaggtcagaagttgccactcactgtcaccaaggactaaatttgtggctatctttgccctacttctcaaaccctgccagttgttaaattacattaaaggcaaaactggaatttaaagctgggactcaaacaaatacttatatgcccatgtttgttgcagccaaaaggtagaagcaacccaaagtgtccatggacagatgaatggataaacaagatgagatctctccatacaatggaatactattcagtgttaataaagaaggaaattctggtccatactacgacgtgaatgacccttgaagacattatgctaagtgaaataagctatacataaaaggacaaatattgtgtgaatctacctaaaggaggtaactagagtagtcacattcattgagacaggaagtagaatgatggttccttggaagtgggagagagggagaagtggggaattattgtttaatgggtacagagtttctgttttgtaagatgaaaacagttctggatatggatggtgatatggtttggatgtcttccctcctccaaatatcctgttgaaacatgacccccagtgttggaggtgaggcctgatgggaggcgttttggtcatgggggtggatccctcatgaatggcttggtgtccttccagtggtaatgagttagtgagagatatgattgtttaaaagagtctgggacctctgcacttctttcttgtccccttgctcctgctccctctcttgccatgtgatacaccagctctccctttgccttccgccatgattgtaagcttcctgaagtccttaccagaagccaagcagaagtgggtgccatgcttgtacagcctgcagaaccatgaaccaagataaatctcttttctttataaattacccatcttcaggtattcctttatggcaatgcaaataactagtacagatagtgatgatgattgcacaatgtgaatgtactaaaagccactgaattgtacccttacaaatggctgaaatggtaaatcttatgcatattttactgcaatttacaaaatggaaggaaaattctgagaacccacaagtagaattcagaagcatatgtatatttaaaaactcaaacatcataaccctcccacaggaatactgacatctctcaattcaatggcagtgggtatctccaagaaacttgtattacatgcaagtgactcttccctctctagagcattgatcttaccccctaggatgctggaatttctcctttcatttccagaatctatccccatgtagccacagagatgttatgtgtgtcccgcctttcccttgcactgcactctagtctacaaccaatgcccaaagttggctatgatttttttagagaccttattttgtctttcggtaactgtagctaaagtccaagatataattaggaactttaaaagagtgttcccttcatcctataaccactttacaaacactcaacaatttcctctggaagataatgaaacacacagagggcatctggtccctaagactaaacctcaaggtcaagcttggttgtagctcctcagtggcttaatggaacattgaaagcacccctagaaataacataaaattttcatcttctacagcaaggattttggcaccaaggtcttactttgtaaaaggcttatgtaaaaggcttatcagtgcatcccagaaagcaatgccatctaagccctatagtgtcaagggagttggccaaaattgctaaatgaccattcagctgacgatatgacaccaacatcggctgtgcaggtgcatgctcacattcctggcaccaaacatgtcacactccattttctcctctgcagaatcgaatctgaccataacaatggactgggcttgctaagaatgatactagcatgcctctttgttaagactttcagtgggttgaaatccaggtctccaaagagaaagccctaacctgtctacttctgacatctctccttcctgccctcacctcagaaataaatggtatttttgtatttacaattgaattcttacagacaaactacccttcccgaatgaagtagaaagtttcacaagatagcatccctcatgctcaataaattcccactcctacagcctggaaagttggaaggcagagtcagcagcataaacctctgcatgtgtattcgcgcaagtttcgaaagcctggcccacagcccctgattccaccttgcttcctacaatggtctcaccattctccctctcacccagtgaggactgggtgataataatgcctctgtgccccctctagcacaggggacctagagctctggctcactggagataaacagtcagaaaaccacatcctctacatgtgtggggcatttgtttgagggtgggtggatgagaatgtggtcaggtaacccaagctttccttcctccttcagcctcacacttttgcaaacaaaagagaagaaatggagtctgtctgtagaatgtcacttgttatcttctcaaggtcatttttaaaaaggaagatcatgtgtatgatgttcgagtatgcttcatagttcagcagaccaggcacaccaggtacacagtgaaagaattggcaagacaagggccagaaaatgcgtggagatctttcattgcacagttttaagagctttgacatagttatcaggaagaaatcagaattgaggtgggctcccttaagcttactgcatggtttttccatgtgtcaaatttatatgtgaggagaaccttcatcctttcagggtttacggtctcttgctgtcataacccgcctgcatatttcagcacagccccagcctgatcaccaatttccatccctcatccactccatcagaagatctttatgtgctagaataaatttctcttaacctcccacaccagcctacaagtcattcattcattcattcagtgcacaaagttgctgagtatccactacaggttcagagttgacctggcaggggacacaaaactgaagaatgccctttttttctggaactggaactggaattttcattctcgggcaaagcaggatgccagaagccagatgatgttcatagcatcaaaagactcttttttttttttcctgagacagggtttcactctattgcccaggctagagtgcagtggcacaatctcatctcactgcaacttctgcctcccaggttcaagtgattctcctgtctcagcctcccaagtacctgggattacaggtgtgcaccaccacgcccagctaagttttgtattttaagtagagacggggtttcaccatgttggccaagctggtctcaaactcctgacctcaaatgatccaaccgccttggtctcccaaagtgctgggattacaggcgtgagccactgcaccctgccagaatgtgcatttctaataagtttcaggtgatgctgatgctgctggttcagagaccacattttgagaattactgcttttaaccttatttataaaagataaaaagtttattctttcaagatattctttttctttgaacatgggtataaaaacattttaaactgtttaggtatgtgccatttggacaaaatctctttaatatatctataaaaatatactttgaaggcttccaaaggggagaaaaccggctggagctctttatcttgaattattgttcaaaatcattttcagagtctagttcattgggctggacaatgccagcaaggtgtttggtttttaattaaagttgaaatatcatctccattgaaaggtacctcatgaatttaaccatgatgccatggctgctaaaaacaaaacaaaacaaaacaaaacaaaaatacataggcttaggctgggtgctgtggctcatgcctataatcccagcactttgggaggccgagatgggcagttcacttgagctcaggagttcaagaccagcctgggcaacatggtgaaatcccatttctataaaaaatacaaaaattagccaggtgcagtggtgggcacctgtaatccctgctattcaggaggctgaggcaagagaatcccttgagcctgggaggcggaggttgcagtgagctgagatagcaccactgcactccaacctgggcaatgagagtgaaaacctgccaaaaaaaaaaaaaatacctcgtaggcttagatttctgaaaacatgcttccacccagaaccataaaacttgtaaaggtgtggctgaggagactttgggttccaaagaaagcattcagaaagcaccacaaatgaaaaataggagttcatcaatatactgtttcctttatcattagaaagaaacagtgctaaaaaagaagaatgtccacatgacttccaaaaacaaaggaacccagggtcatgactctgtctgtttttcccagctatatctaagacttagaggggagagaacagctccctttgtccaggttccacccactgcaagaactttttggcaataatatgacttctcttgtgtgctctgtgccagccaaacttcgtaagaatgctggccagcttggcgcaccctctccagcattacctatgtttgttatttgaagttgccatgctagattttactttaaatgacatttcaagtacacagggtagttgaataggtttaagtcttgttgtttcttttcttttcttctattgaataatcaatccattcaggcacagaaagatcaactcttaggcttccctaattaccctgaatctgctacttcacccaagggacctcttgaaagaccccaaggatgctttaaacaaagcacttcttactctttattgtagtcatgagttttcttctgagtctcttgtctgtgatctcctccttgaggatggaaagggtatcaatcatggctgtggccccaccattcactcattcatttattcaatcaatgtatatttattaaatgactgctgtataccaagctttgtgctaagcctgaatatgcagcagaggaccaaagagccacagcccttgccctcatgaaccttacagtctgaagtagggacagacactcaacaaatgaccccactagtgagtaaaatttgcacatgaattaggaggactctccagagaaggggcaatgagctttgcaggctgtggagtctaggggtgttccatggaaggaggatgagaaggagtgaagaagatgaagactaacattgctctcacagaacccagtgcatctaaagctccttaatgcttcccccatggatgcttgttgagtgactggatggacctaggcagagttttgcactcaatgtgacagactggggaggagctctgtgtggagcaagcgatgaagtcccactgaattcaattgagggaggacccactgtcttcaaaaaggaagaggcatctccattctaaaggtggagcaactgaggcccagagagcttaaatgccctgtataagaggcagagcttagtctcaaatccaggtcggactccctgcctttgttcttttaatccatgactccaaagctccttcctgaattggtgggtataaatcctcctgtctctcagaaacttcttctccactttcccttgtgaaactctgtttcatctcatcagctttccagagttatttggtgaaagagcatccaaggcaggaagatttttcttggatcgctgtgatggctgcaccctccaaaaatgggttcacaaagggtaagcatcggccccactcattttcccaaaccatagcaaccctctctttctctccaagaaaattttaagttgcctgcatcactgtacatattattagcatattttccaatctcatatcagaaaagtcttctaatgagtcccaatctaatgtgacaatcatccaacaatagaatggctgctgcatgtggcactgagctttcagtccctggggacatttaagttgacacaggagatcacctgccaagaataccataaaaggaattccctgttatatcagaatgctgactgatttctgatggcattttaataagccaagaatagacgcttcttgacagtagaccctgccaagtgaatatgcctaaggagactctacttcccagtttgcttgatgtcctggaataattattaagagcacctcctttccactctcacaagtgccctgagtagatgccaaagaatatggtcatccaatttaagttgcacttgggtccttggagagaggcctaatacatcctgacacactggctgccaaacatccaggagaagatggggaagcacagttgagaatctgcagtgctcctgtagccactctaggagagtttctagttctctgtttagtaacctgatataccagcaggcgaacgacaatgtctaaaacctccatagttctgtgcctacacacaggcacacacacactaaaacacacacacacagacactcatgctgttcgcagagtataggagattctccgagagaagccagtagcatttccatgctgctagtggtctgctgatgagtaagtgttgtttttttaaggccttgtctggcattgaacatgattaataaattgctggagatgatggggactgctctactgtgattgagttactggaggcttacaaggatgaaaacagggatctctagatttcagatcaaaagcagtccataaaacacagcccctcaggtcatgggaagtggcatccgcaggcttctcaagatcgcttcccggtgaaaagagtaaaccagcctctgatcccatactgaactctaactcacatggggttcgaatgtgtcatatgctctctgtacctcaagtaataaagcagggagtagtgggagcccatcgcttatggctacttttctcaggaaaacttaagaccatgcaggatgggctggctcaattttgacagagagggtgtctctgcactgctaccttagtgcgcacagtgatttaatgaatacacgcctcagtagtgactgaacaaaagcagtctccaggagacgctgcaccaatgcaaagaaacacaatccaagcatcttgtggcagaagtcccagcagtccccagcctgggaccaaaggaggcctggccaagccttgatataagctgctttcccactgcacaagggcagagtccccaagtgaagaactgccccagttctggctcaaggagttggtggtcactccttgtcttcatttcaggggcttctagaagaccccctttccccgaaaagtattctctatctaagagcctgaaatttcaccattagagattacttcctttcaattttaccttaactctctttcttggacttcttaaaaagcacaaggaataaggagcaaatccatactgagttgttaatgatttcacagggtgatgttgaaatggcagcctactgaatatccacttgggctgtaggttacaagtgcatttccaaatattctgattccaaaggtctgatgaacagcttagaactctgcattttcaacaggcaccctgcacccccatctgctgtaattctgaagcactttgagaaagttcatttcaatgcaccatatcctctcagggaaagataacttcattcagagtttttaaaacctggattgtcaggttacaccccagagcaattacatcagcatctctgtggggaagaccaggtatcagtatttttctgatgtattagaaaaagaaagctccccaagtaattccagtgtgcagtcagggccgtggccacctgaacagccaatgggtgggatcttaatgctaacacagcagagcaaatggaacatgtgactatctccagggatctgggctgcctgggactcaggtctctgcactggcgaagtgggcagctacctggtcttcaatgtccccacttgagtgaccctggaggagtcttcagttgactcagttatggaggagccccatctcccctatacaaacccacacctctccttgaaaccacggtgatagggaggctgccccaagctgtacctctgaggagatacaggtaagtagaggctgggacagagccagacccagacaatgattggccatttgctgccacttggatttcagtagcctgagttgctttggcaggctgttccctggctctgtggggtccctcaagcaagcacagccctctcacctcctgcttttgggcacctctgggaccaggtgcaggatttggccctcaagcattgtgctgggtggatagctgcttcctgccagtggcaatgcaggcctcattccttgtcaaggaacaggcaagggcagaaggcagaagtcacatatggttgagagactctctaactccaactaaatccacaccatttttgagcaaaatgggggttgtgttcatgtatgagttcccaccaatctctatccatgtggcaattccatctgcaaaacccaagaaatagtggtgcatgttggtcccggggaactgggaactggagtgagctcagcaagagcccagaagtccgggagaactggtgcttaggatgatggctcaatgtccacccaaaacacagccgttatttcctctttgttcaagctctctttctttcctttctttcctttctttcttttcttttcttttctctctctctctctttcttttttttttttccagggtcttgctctgttgcccaggctagagtgcggtagtgcaatgtcagctcactgcaacctctgcctcctgggttccagcggttctcatgccacagccactcaagtagctgggactacaggtgcacaccaccacacctagctaattttttttttttttcagtagagttggggtttcactaagtgattggcctgcctcggcctcccaaagtgctgggattacaggcgttgaggcaccgtgcctggcccaagcgctctttttagaggcttgagggtaaacttcatcccagctccctctaatagaaatattcaaagattcaagccacatttgtaattttgaatgtcccagttagccacatttcaaaaaaaagaaacatataatattagtgtgtaaagtgtttcatatttaacccaatatatccagaatatttttacttcaacatgtcattaatattaaaaattcctaatgagatactagaaatacttcatgcacctgacacccccactgaaatataacagtgtttcatgtgttgcaacaattgttgcatcttgtgaaaattagtcctaccaaaacaacaaagtattgtttaacagacaaacattttatattccttcagtttttaggtttatatttttgttaattaaagttaaacacaaattaaaaactcagttcctcagttgcactggctacactgaagtgcccaatgggcacatgttgcaagtgggtaccatactgggcagactgagaatgtttccatcagggtggaaagtccttagatcccttaaataattagaaaaggtcccaactctcattctgctggtccaggctagagacacttagaagtgtcctgagtgacatgggtgctctctcgtctcacaaaaaagaagcacaagagttaagggctagaacagcataactagaacacctcccagagatgtggcctagagcaggtaactctcaaggctcagttcctgcctctgacagaggagccgaagatgagcatctaccacaaagaggtgtaaggattgagtaagttaatatgtttgtaaaacactcaaaacagtgcctggcacatagcaagctctctagaagtaagtgctaaataaatccccagttcaatggctgccagttggttgccagacactctgacatctttcatcccagaatggccttactggaagatgcaaaaaaaatctctcattgtgaacagctcccagccttctggctgccaaaattatacattgattcacctgagccttacctgatgcaaaacaccacaaccccacaccctgggggaaaaaaaaagctcagatactctgaaatgttctagaatgtctgtccctttcctatcctccaaaccatatcttcctgaccctccaaggtgaggacagaatgccatcccttctccaggttatttctccttattcaggtctgagtccaggccagctcctcctacaaggcctttcctgactatcctttctaaagcacgactgagttgtgagcaagcaagtacatgcagttaggtgcacacagcactggcctgtcccctcacactgtttcatttccttcattggcttatcattccctgaaatcacattgttgacttacttcttacttgtctattgcttgcctaacctcaaaagaaaataaattctgtaaggacacagacctggtctgttcagtccttgctgtatctctagcacccaggtgtgagtacctagaacacagtacatgctttatatacaattgttgaatgaatgaatgaataccctccttaaagtataggttcctatttccccttgcttgatattccaaagcactttccatctttcatattttgaaggcagtcaattccataatacttgatacatacagttaactatttttgtgtatatgtcttatctccccaactagacaataagcccctttgatggtatgtcttgaatgtacatccctcctgaggtcctcttgcatcctcaatgaatacttgttgatgaatgactgggaagaataaagcacaaatcttaaattaattttcttggtcacacatactagactatttctacaaataataatttttaaaatgaagtaaatatatatatatatacacatgcatctatatatgtgtattatgtttctcatcctaattaaatgaagctatttttgcaactgttttccagtccaagtgtaaaactgtaaagaataatgctaaatgttagatcattaagttggttttctttaattatatggcagtgtttcaaaaaggctttgagtcacctttaagattccttgccaggggtacagcacactacatttaaaatggcacttatcttagtaaacacatttctattgcaaatgatttgttccaataagcaatcccttggcaaagagctgctatttcttctagaccccctaccaaaacatggacctattataagcgccagagaagagaaagcttaaaaagcttcctttatcagaagttaccaagatacattccctaaagcagaagcatctattcatctacccttttctctgatttcaaaacctatagcacttactttttgtaaatatcttctataaggtagctgtaaataagtcctcaaaacctattgtgaagtaagctatagatgtaaatatacattcatcttttttctctctctcattttctttcctcctgcctctctcttattctccctttgtttctgtttttctaaaacaaaaatcagtaggttggtcacaggcaaatacaagttcaatttctaccagaaagctgagttcttgagtgattaagcatacaaaccaatcatttgaagggaaaaaaaatccagtaaaggctaaattattttctgaagtacttattacattacatgaagagcttattatgataagctattatacttgcaagatgaattgaattcacattcaggcaactcatctattcctagagaaacacagataaaaaattttatagcaacctgaaaaggtttgtggaatggatataaaagagatcaatactataagattttaatgtcaaattgaaacaatagaaaacatggtccaaaacaaggtctcaatttccaataaaaaggaaaagaagagataactggtgagcagaggagaggacagtccttcaggcaggagtggctggggaaggacctggtggaagtgtaattaagctgtaaaggaatcatggatagaatttggagggtggaaagcagtccacctgtaagttcatttattccacgtgtatttgttgatttcttactatatgctgggcaccattcccagcacaggggctatcacagagaacacatgacaaagaccccttattcagatgatattctagtggggaaggcaccacttctagaaattagttatgaaaaagcaggcacccttttatgtttacgtgtacatacatggaaaggaggcattcatgtttttgttttctactgcccttctcttgagcctggaaggttttcctttgtactgatggctagcattcctcttagctttgtggagatttgccttgcaaacaaagagttccctctcttccctcttgccactgtttaccatggggatgcagttaaggatcatgacaagccataaaagatttctcctaactctttcaagtatgactatcctgattatagcctccagatatggccagccagaatcacacactatttataggcttaacccacaggcagaattagtcatgtatcacacatgactaaaatgcaagactctcccagacctagggtcctaaacaaatcccctctccttccctaaaccttccaaagaagggcagtgaggatgcccccacaatgttcttcctacagacatgtttatttaagatctcctccccatcccctaatcaaggaaactacacaactgagctaatcatttaaatgatgctactgagaaacgaagccattttccttgttaaaaatgtgcttgccaccctatccatttatctatttccttggcagtgctcactgttaatttattgcccaataaagcacagacactagcagagctgctgaaccatgcctagtggaagccccactatttcatcccagcaaaggcaactgacaagcccaaagcacaaacacaaacacattggatgccacaaagccgggctggctaaccccgactccatttgtcatcccagagacacagaagggagggcggtttacagccttctggagaatgtaggtgattaataactatcgattgtcagaggaaatggagtaagtttggtcggttagccaactgccatgggttttctttctattggatggtaaacctcactgccgcagaagccatctcatggtgagttttgtggggagagaaactgagaagggaagtgatgaagaccgagatggggcagccttggctggccatggtgtccaccattcgggcagattgcctcctgttgcctcctgcagctaacacacagccatcactcataaagtcccaggcagatgtgtgcttttagtgcaaaaccttggcaatcattatcttgagtgtggaggggcttttcttttcagagtctccttcatgggcaactggatcaaccacacagaaggcagatccttcttatttggacagcttagacctcagagagcctataccaactgaatatttgtgaggtaggatctgaaagcacaaccctgagcttcaggatactctttctgatgtcttgactagctccagtttgcctggaggtttaaaggaaaatgtacccagaaaacctgggctcttactccagtatctgtctaatacaggaggaggaagccttctcaaagccaaaagaacagaacaccaagaggggttccaaagattgggttcaaaaaagtcattgaatgttactttgagaaggaagcaaggtcacctagtcgtaagcctgtattttagaggagaaaactgggacccagagaggaattgacttgtccaacgccctattgtgtgttatggacagaagcaaaattaggaggatgggtgaaaaagaaggaagttccaaaagcccacagggtctgccttccattgccatagtcccaattgttgctcccctagtgagggcacagctggcctaaccactcacaggcaaaagacataagactacaacagaccccacaaaacacatgcacatcatccactcctgcaggaagttgtgagcaggttgccctgctccaccatcactgctcagcaggaggtagagaggtagatgagaggagcacaggacctgagaaccaggagaaaaggatggcaagggaggcccagccccagccaaggcccagcccagttatgtaatccaccctgggaggttatgcccgctgctttccatccacggattttgcaggatgggtcttcactaggaagatgggggaaatgtcccagagggaatcctcaccagccctgtcccatgtcaagttctttatgcctctgaaccttcctcaaacggtgtccccccttccttgcccttgccccacctctccacattcacagggcatcttaattccctaagctgagtcaacatgagtaccacagtcctctccgcttaaccaggctgctgcatctcagagtgagcctcacagacacgcacagaatcagcacctgctgggcattttcatgtaatttgatgatcacctctgtaataagactcctcaggagctgagaccatccttcgtctaccttctagcattgtgtctccattgggccattgaggccatctgctctggaagttcctgcaggggcctgctaacaggtagatgcctaggcctaatccctgacttgcaaactcagaatcttgagccagttcaggaataactgcctagagtgcctcccacagcaaagggcatactgcagacatcaggaaacactcattgatcacagagaggggcttggcgtcaggggacctaattttaaccttgctgtgtggccctgcggaagtcacttaaccctctggtattcaacttcttcacctctaaaataaatgtcagacatttgtggatcatggatgtgaagttaccaacacagatccaggctcagcaggtactcaattcgagatgtctgtattatgcgtgaggtttgttcatacacagattgacccagtaactaccctgaaccagatccccagggagtgggtttctaaaggctggggactgggcctggcttgagaatatactaatcacacaatatatttataatagccaaacacactacataacctatcatattataaatgaataatactataaaatattaatagcaaacaaaatatggtacatattttgtgccaggcactattctaaatattttacttatatttccccatttaatccccacaaaaaatttagaagatagttctattattattatccccactttatagctgaggaaactgaggcccagggctgttaggtaattctcccaatgtcctgtagccagtaaatgacacacagcggggattcttcaaactcccacaccttcctgagatgtcagctggctgtgtggttcatgccttctcttcattgtctctgccctgagatgtgctcagcaagtggtcgttgccttaagagagctttgccttcccagcatggttgggggaagctctccctccttcaagggaggagaagaaggggtgaggagccactaacagggctcacctgcaaagttttcaggaccatacctccaggccaaactctaatgagaaggagcattcctgggcctcagctccctggggttcagacttggccccttaccataaagaggtcaactaatgcaaaatgcagaggctgcaccatgatagcttttccacgatgggtctgggccaggattgagggcactgtccagcaagctgatgcatttttaaaacttccgaatcattgatactacctccccagggaaaggaagacctcagcagtttctccaacacccagtccacatgccaacctgccagagaagctgggacggaccacagcaaaagcaccagcacccaagctctgccacagacaactgactttcagggacatgaatgacctcctcactgaaaatgaccttccccagggggcttattctctgaacttctggaatcaccaatcacttctccatgtaactgactctacatcaaagtcgatgcaacagatcacatttctcaccactcccactgccccaacctggatgcaaagtgtcatggtctttcaccagattattacaataacctcctaagtggtctccctgcttctacacttgaccccaagtaccacaattggagaaggatgatctccaaagctgcctgggaagtctgcagttacgcctttggacatggactgttgggacttttcagtttctaagagttcaaagaaaaaagaatgctagagatgttttctttccatccaaacaactaaaggcttgtatctttccattaatcaataccaagagctgttcatgcagctcaaatccaaaaatgagcatgctgagtttctcaagtctgtcctctgatgatatgtatataatcagcatgctctgttgtagacctttgtgacaatctgtgtcacttagtacaagtttacccaatgtcatttgcatttaagcaaatggaaaagaattttctcagaccctactatgactctggccacctgataggtgctatagaggacaaaacagaaatataaaatatgattctctcctttaaggaatgtattttttctgatggagagacaaaataaatgcccaacagatagacaaacaaccatatcagaccatttaaccatttccatatggttaaatggaaatatcagtaggaaagatattaaacaccttgggaattcagaagcagatgatcagtttggctagaatggctgggaagataatctatcaaaagtaagaaaagtgataaatgtgtgaagtgtaaatgagttgtagtattgcatcccaacaggcaacaaatatttcgtgcactggattgaactgctgctaatactactttcctctctcctgcatttggaaaaaaacaaggtggtctccgaaatccagcctcaacccaggactatggaaatttgtaatggcagtgaagacaaaaaatattttctctgccatatgcggtcaccaaaagcaaagcaaaaattaaagcaaagtatataggatttggtatggtaaaagtgaagaatcacatgacgattcgttaaagaatataacctccacccaaggggacagttgagggatagcaaagtcattaaagcgtcacagctaaaaggaaaaataagtctttcagctactattatccatccctctgctattcagtttcatgaagtgaagctactggagtagacactgtattacatcacaaatttgttacagacattcctgtaaaagtggctttttcctcatagactgaaaatacacctgaagatcccctcatgatgaataggaatagtccattttagatgagtagattttggaagtgtttccacacttttttttgtttttaggtttttggggggtgtgttgttgttggaagctccagcattttcctcttcaccacctgcagcactgggacagcaaagctgaagaatctcattaagcttcgacaagaccaattttttatttttagccagtcttttaagacaatgtgaactctactacatttagaataattattccatcaactatttacttaaacattttagaggaaaggaaagaaactgggagatgtttaaggctttttataacagattgtttcaagggtaaatagaaaaatccaaatgcagctgctgaaaacacgtaagcccatggcagggtgcccacttgctgcagcggaagtgaatggtgagaagagatgaaagatgtggaagacaaatgtacccagggcatccaatcccagcaagcggacaaagggcagattcataacactactttgtggttaactggtaactttcatcagggaacctcaacacactttacaaataacacttattttcctgtctcacagaagcagggagataaatgccaagcccaaacgtcacacagcaagggtgtgatgattttaagaataaaatccagaccttatttcccagttggtggcctaccaggtgtcttgatatggtttggctatatccccacccagatctcatcttgaattgcagctcccacaattcccacatgtcatgggaggaacccaatgggaggtaattaaatcatggggcaggtctttcccatgctgttctcatgataaggaataagtctcatgagatctgatggttttataaggaggggtttccctgcacaagttctttcttgcctgctgccatataagacttgccttttgctttctgtcatgattgtgaggcctccccagccacatggaactgtgagtctgttaaacctctttttctttataaatttcccagtctcagttatatctttatcagcagcaagaaaacagactaacacatgcctcccttcgaacccacagtacatccccaccatttgctctttccataaaccagtttcctttgaaaacttccagatccttcctcctctaatagagaacaccaacataccaaagactacttcagacatgaaagaaatggtgtgcttatcttgaaatctcaagtggaatggtaaaaacttacctaggttcatcaatgcgctagaaacaccacaaattaccaatgcaggggaaaatgaagtatgctgctacaagggatgcattgacagactccagagaacgccactcttggtaagctgattctgaccatatagaagttattttataattctgtaaattgtacataagtgacagcaatgcaaataattcctgtccatggacatgaaaattctgtcctgtccaagagaagttccattgacttctctcctgcctttgtggaaaaaaacagttttgcctctgtttccacattcatttaaatattactgacctgtaagtgtctgttcttttcttttttgtttatgtttgtgtctttgtttcttcaagacagggtcttgctttgttgccctttgttgcccagactggagtgcagtggcacaatcatggctcactgcagcctctacctcctaggctcaagggctcctcccacctcagcctcctgagtagctgggactacagacaggcatcaccatgcctggcttttttttttttttttcaggtataggcagagtcttactatgttgcccaggctggtctcgaattcctgggctcaagtgatcctttcaccttggcatcccaaagtgctgggattacaggtgtgagccaccatgtcctgcctgtcctcaactggttataacatctgcctggtcccctcattgaataggagtagaataaaatctttaacacatattcattttgatatctgaaagtcatgattttcttcttttgtgaaaattaatttttaataccaattcaatctcagaaatgctcaacctcaaagttagaaacacagatgggaacagcaagagatgttagaactcacaagaggactgatggagaaaataggggtgtagatctccgaacacaaattggaaaagattttcttatgagaacaaatccataaatcagaaaatatctgtgattttatcctctatcttcctaccacttcaatcttgttaactcaaatataagacatgttaactggatccaggacctgagccctggcaagtgccacagacaacagcatgctatccaaaggactgcccttaggaagcccttaggaagccttgaatgcattagaaaaaaagtactctcccctctggctgacacagcaccattctggagcctctggcttagcaaaaggggtacaggttgcatttgagtgctttcttgtaccttcttcagctgggcacctttgtgcagtactcaacctatacaactgtacatggtggccatgaatggaaggaccactcatgacccaggacccaaaaccataacagggatatatagctagagaacagctgctgctaagcagggcatgagagaaactgagagggctgtgtccgggctgactttatctagaccactgagatccaatacgattgaggaaaatcactaactctatggcaccctgctccagccatgcctgggaaccggtgactgccttatgatgggatgcccttttcagggagtcaagaagtgcctgactggtaataaaaaggaatgaactactgatacctgctacaacatggaggaaccttacaatcattatgctgcatacaaaaaagccagacataaaggattacatactgtatgagttaatttgtattaaatgctcagaatagaaaaatctatagaaacctaaaaataggttcacacaaagtagattagtggtttcctacagctgcggtggttggggagcggactgaagggatttccccagacactccaatccatgtgtctgggtgttacgataaccatgataataaaagccagggagacctcagtttgggttaacagggaggttaacctcattttcatgctttgtttttcaacccttattactgactggttctgccacgatccttaaaacatgctcttagcaaattttatttttagtaactatcacttagtctttctccccagctttttcccactttcctcccatcccttagatcccatctctcacatctgtatgttttacccaacaggatggaaagagaacaatgtgtgggggcagatttggtacctgtcatggccttgacctctggcatcaggcttcctctccctaaacaccccagccaggctgcactttcctccatgactcaggtgaaccttcctctgtgccaccacgtggactttgcaaattctgtttctcctatctgcaacattctctcccattctcctcccaccagtcttctttcatcatggatgaaggatgactcttattcttcctcctaatctcaagccaagcattcttctcggaagcctttgttgatctttaatcccttggctctcatagcagaatgtgtgcagggcaggtatattagaatttctgtaggttaaactcataaactgtgggactttgttgactaggtgacatcaagggaaacagaggcaggcttcttctgtggaataattgtgcatccttcctgcccttctaggggtcctgactatctccccagcccccagcctcccaggctccaatctgcaacaacaaagagatagaagctctgataagaaacacaggtggctgggcgggtggtgtgctctgtagtcccagctactcacaaggatccccttgagcccaggagttcaaattcagccggggcaacatagcaagaccccatctctaaaacaaacaatcaaaacagaatttctttgctaattacttttgacataaaaaaacaaaagaaagaaacacaagtgattgtagcaccaggacccctgaagctagctgaatatgttcctgcctctggcagagtaaatgttctctacttttgagtcagaccagtgaaggccaaccttcgtcttaggaagaagttgtggtgccaacataagctttggagccaaacagacttagttcaactaccagcctttacctagtttttggtgctcccattgactagtctgcggcaacagatgagttaaaggagatgttgggtgtgtatcctaacacactgcacaggctgtgttgcagaatagtcagtaaatgtccattttctttcttcacatacaccttcttctttctgcaccaataatttaagtaagaactttctattttctcctctaccaatctcagaactgtctagatagaagttaaaaccacctcactctggctcgaggaggagggagaaggaggcagggtttcatttcaagatcagtcagcccattgcagctggctgtcctgcagcttcaggagaaacaccagtggtcccacagctaaccaagatggtgcctgtcaggcacaacagcttgatagggacagccgcattccctgtcagattcttgataaagtacagcacatgccaggaattctgtgggcccttcaggcacttgtgctgttgacacccctatggctcaaaatcagaagctgtctctgaatttgatgaggtggtagagttggatcctttggcattgagggaagaatggcagaacgtgggtgtttacaaacacttctgtccacttatgtatactgcagatacttaatggagtgctcatcctgtgctgggatagaactgagacaaaaaacagatagtagctgctttcagggaacttaacaatgtcagttaatgggggagacaggtatccattcataatcatccccaatgaatgtgaacccaaaatgaaataagggcatggaagaacataacacaattctagaagagctgctcacaaaagatcaaggtgaaaagaagtttctcaagaaagtcgcactggagctggcatctgaagaatgagtaggtgctatttgggtgaaaggcgtgtgctgtgggaaagggatgggaagaagaggagaaagagagaacagcatgtgcaaacagagggaacagcacatgcaaagcccagtggcaagaaagactatggcgtggtgaaaaattgggctaaagacaatatgaccagggctggacactgagggtgagagtgaaatgcagcattggggaagagaaagtcaattcctaattgttcaggaaaggtgactgggtgataggcatgaccagaagaagagaggtttcctatgaaactctgtactggaaatagagctgccacaataggcaacaagaactaaggtacctagaacaaaatgctctgtcattttgttccctgggagagtagagtaaaattcaattgaacagaggttgagacagcctattgataatttaaagaaaaaaaatttaatgggctaggtcatcatacaggcatattaaaatgtaaaacagcagaaccaaatcaaatttctctttgacaggcttgccctggttttataatccctctttcaggggagactctgttgttgttattattattattattattgctcaagatggtgtctctctatgttgcccaggctggagtgcagtggcacgatctcgactcactgcaacctccacctcccaggttcaagcgattctcttgcctcaacctcccaagtagccgggattacaggcacatggcatcacacccagctaatttttgtatttttagtagagatggggtttcaccacattggccaggctggtcgtgaactcctgacctcaggtgatcctcccaccttggcctcccaaagtgctaggattacaggtgtgaaccaccgcgcccaacgagactctgttaagctgaaaatattgagctaaatgccagtgtcattcttctgtaaatatatgtaattgccatttaaagaactctcaaattaaggttataacagctagtgataaacattccttcatttctcacaatattataatagagaagaggaccagcattaacaaactggcttttcctgttctcccgaaacagtcttaagtgatctcatttatcatgaatttctgtaagcattaacagtttgtaaaatgagttaattatgttctttggaggtttaataaaatctaccaagttaagtaatatcccgatgctcttgaaatttacccagaaaactttaaagaaagaaataaatgcattcgactgagcagaacatcatgtatatttttagaaagcatacattatctcacaatacttatgctaaatatgtaagaaaatttctgatagactctaaatcaagtctagttgtaaaaggatctctcctctaaagttttttttttaatcttcgtatcaatgtataaatattggcatctatgcaagccaaatatattccaaatccaaaagctttggcaatccaaactttgagagaaagaataataaaatctaacctttaatgagaaaaagtaggaatttcaagaacatgcatctattttctacaggcagtggtatgagagaaatagaacagacactgaaacaggtgaaaattaagatgttacatagggatggcatatgggactcattaagtttaggatggtgttttgcccttctttaaaatgtgtttttcttttcccccaccataaactcaatttgccccaggtagtaaactgaaatgactggaattttctctgattagatttctctggggctgttactgggtgttaccacatggcataggggtgaggtgccaggctctggagtcaaattgcctgtgctcaaatgctgcctctgccccttactggccatgtatttttggaaaagccagttactatctctaagttccagcttcctcatctttaaaggaagaggtttgttattatgcatacctcatgggttgttcagatgattagatgagatgtgtgaaaagtacttacttagcacagtgcctctgtaaaggacagcgatcagtattcccctggtggaaacagtggccatgtttacaagatgaaggaggaaccagtccttactgcctccctgtgtaatcaaagtagtcattatctcctattgccagggtttccttatctctatcactcatgtcctgtcctgacaacatatttataatgggactctacctacacaattaattgtgtaattttttttctttaaatctcattctttaaagttcaatttttaaattgaactttatttcactaccacaaatggaaagcccatctcacttgctataactagaaggtaattctaaacatacagcaaaaaagaaaacccagatcatttaaacgccacctcgatcttgtcaccccaacaaagactcagagcctgagagcggaggctgattgccaaagtttagagaggtgttaaagacctggtagaacctagggaagacattctctctgtgttaaagagaatgtaaaagaaaacataaccctctcctcattggagtctgtgtcatcctatgctgggtcaggccaccacctaaaattacgccatatgcccctggtaatacccatctctcacgttgttatctagagtgatttccattgtagtttatggagttttatgcataaacagacagtgttctgtgatacctaagaatacttccaaaattcccatggaaggaggctcccaattaattccagtccattcatttttaaaattgctgagtgaggcattagaattcatagaatttgcagacctgtgaattcccctagccagcagcaatcttattagcatatccgtaagtctttgcaaatttgactagggacggtgtgtgtgtgtgtgcggggggggggggggggttccattcttactttatgcatcctcatttatacaccctcctctctcttgaggttgagtttctaagctgatagatcataccttccatctctgtccataaatgcctttgacccaaatatcatgcaagtccaatggtacacatgtcctctaaaacaccctaagtggaaagcattgcctgttgaggattagagtagacatataatcacgtttcatactgagctatggccttcatccaatacaaatgccacattcacttaggaagggtgtgtatacatgggaaacagcaggggaatcaaggacaacttcctgaatcagcctgctcagcaaatccaaactcattcagccacaaacccagttcattcatgcatcagggtttgcactgctctaataagatgaatggaaatgcaaagacaacacttggagggagtcctctccgtgcactgagacccttgtctgaaaatacaagcaactgctgctgcttcacactcaaagagccaaacattttgcatggataattcagaagcagtacgtcactgccccatacacaatcctcatgttaagggagcctgcatcaggaaagcacagactatctacctacacaaagaggtcattgcaaattcctcctctccttcctgttgcattcactttagcaattttattacagaagagactgtctagtccagaagcttgctcagtgatgaaagaagccaatttgggatcctaaatttgactatagagcattcatatggacaactgggaattacctggtttgtgaactaagcaaaagccaaaactctaaacaccttctgagcatctatgaaaaagtatttccaaatcacaagcattcattttttagatgggagttggcatgaggatctcctgcaaagagagagagagaggtttcctggcatgggatggggagtgctgagcaccaagacacatgtgcaagctgaaagcacaccaagtgctcttctctgcatccagcacctcacacacattaactcaaagggctgacaagtccctggatcactcagcaggcaggcagcaaactctcagagcaaacagagttactgctgccttatcttgagctccactattaacacacttgtcatcactaagccaggttgttagtctctggaacaatttgatggaaagggcaaacaccagagaaaaacaagttgacccagatgggctggcagaggggatcaagtggcaataaactccgttatcactcctggttggcaaacaaaaagctctgcctacgcatgcattccagttaactatggacttcccctcatacatgcatggaaggccattatgcagagaaatgggcacagcaaatcacactaaacactgaaactctgctgaagtgactccagtgacttggagttgttgatctaaaaattgcttattcttgccttgacaataaaatcagagtccaagttaataaagatttctagttagcaaagtccccaagagcaaacagtttattcagatcaccagctttctgctttgcagtgtgaagagattaagggtccagggacactcctagttctggttctgcctgtgtacatcactgagcctttgtagacctcagctttattccctgtgagacttagactgatcagcagttctcaatctgaatgtgatgacagagtagcagaggtggccgaatatagaatcctcaaaattaacttacaaccaaaggctggtatctgtcagtagctttacatgtattgactaatttaatcttcacaataaacctgtgaaggaggtactattatcatccctattttaccagtggggtaaccaaggctcagaaaggctgacaacatgcaagggtcacccagccagccaggtgcagaggtgagactaggaatcatgtggtctgtctccagaaatgctgcttttaactactcaactcttcataatctagtgcctctcaataatggttaataatagctatcagtatggccaattgatggcctgattagaggagatctgaggcttgaaataaaaggctactgatactcgcattttaacaagctttttttgagagacaaagaagtggagtttcataacataacctggagtttgcatctcaaaagtgaacaccatccacaaggccaggcaagaagaaaggttggcactggctgaccacacaatgtggttggttccacctcacttagccatggagtctatgattccttggtgctatgagaaagaatgctgcaatctgctcactctcattttgggaggaccaaagccctgcctagcagcaatgacaatcctggccctaacacagctgggagcctcttgacaggcttatctcctccagctccccaggaagtctcccattggctgtcagatcaagatcaccaaacccattctcctaattagctccttggcaggcaaaccacacaggagcagttccctttccaccttgaacccagcagacagtcccactccccagcatcagccagccccaaaggcacagggctcccctaaggcctgcatgccctaagtgtctgagaggaccccatgactacagcacatgtcactaagtccctaacattccaatcatcagcaggcatctgtaactccagccggcgtccctccaggtatgcaaatgccatctgcccttacatgagggaaatggacagcagcggaagttaccaagggcccacaaggtgtcagcatctgggacagaaatgaagttccctccctatcaccaacttctcttttaaagaaccactcaaaccctgccaagcttgtacaagaggagtaaataacaaaatgacacagatgacccataaaggatgtatatttgcttaaatgaaataatagagtacttcacaagtgcctggtccatgtaagacttttgttttgttttgttttaatggctatttcaatataacactaatttaatagatatagtttaaatataagggactgtaaatagagtcttcaaaatagtacatcaaaaatttccttcatgatgaaatagatggcctactatgcttatccagagttattcttgcaaatttctacctgtagatattgttcggcaaataggcaagttcaattgattgttgattttaaataaaagttctaactgagaaaaaaaaagtaagcccataagagaaaccagtttcaaaaggccacatcctgtggattctccttatttgacattcttgaaaagataaagctatggtgatgaaaaacagatccctggctgccaggggttagagatggaaggaggcggttcgatgcggtaaaggcacagttccactgattatagtggtggttacacgcctccatacatttgtgaaaattcatagacctacacaccaaatttttttaaaaagtcaattttattttatgattacctaaaaaataaaaatgtttacaaggcccatgaattgggttgtctctaaaagatgacttttcttcatatttcttccaaattggttcatatttagagcactattgattatctaacaaaattttaaatggaaatagttgcagtggagattaaatgaaataacatattaaactgcttttgaaataaaaagggcatggaggatgtcatagaagtagcggtgcttgcagtaagaagtcagatcagactttacaaccttgttaaatgagggactgaaggcctggggtccccaccactccttcccgtgagccagtgcccttcgtactccactttccttatgtgtgaaaaggggcacctgaggaagggttgtatcttcaagcactttaatcccattacccaattattcacgtgcacagacccataattgggagttagatgttttccttcagtgctcaaaatagagcaagtttgtccctcaaaaccaaaagtactcaggtcatgaatgaaggctgaagaaattctgatctggcgggaaattccactttctgacaaccctgatggtacctctgaaaaaaacaaacacaatgactgcttttgaagggcaggagacagaaagacttaaccagtacttttcaaagggaggaaaattctgtgtcatcgtaagcttgaataaacccagtgctgtgaattgccaaaggagaggttaactgttttgaaagctgtggcatttttctcatcagtgtctcatgaggctggccaggaggggcagttggaaagaaggctcggagatttgatattcaggaagtccaccagacatgcagcattcttgacaagatgcctttcacctaatgtcatattagcaattcagacagaaacccaggaaagttagcacacacatatgccccacgctacacatgagccctcctcccaaaccacagcttcccgtgcctctcttccccatgaatttagtaccagcctccaagggtttctgccttcctttctgcaagtcaattgaagtaacttccagaaatgccttaattacaggccagtatcactgtcattagaggtttaaataaaaagtccccggattctaacctgctgagatttcttgtatgaaatgtacttacggaactttgataaagtaccagtcaactctaacacttaaatgggaaaaactgttgcagctcaaaattcaactctcatgcaaaactccagggatgaggcagcaaaggtaccacctcagcaagaagaaaaaggaagagagaaaaaagaaaaacaggtactccataaattacccacataaatcagtttaggcagactacaattttttttaacacagaaaacgcttaaaggaaaattcacagaaaatccatgattactcctttagcagggcgaaatgtcccaataagaaggagatgtattaatgggtggccaaccacctcttttgctccagtcgccttccgtggagaataatcaacagaaggaaatctaaaaatcaacatagagaggctgcggtgagctgcttcatgggtcctgggatagggggcatctgaactatttcccagcgtctgggggaaaaggagtgaacattttcaagtgcctcatatgtgctggtgctttacttgggctgtttatttcattttttcatgttctttcaaggtgttcttaattctgccttacagaccagtggaggctccagtatgttagataaattccccaggggcaccagttaaggatcactaggaatgcggaattcccctccagctcagctctgccctgaacatcttgatgccaggagtaaattcagggctctgagaagggtcccaaatgttacaaactttaaaattgaactaagggatgaaagtttaaaattgtcttcaaaggaattcctcaagtaacataaccctgcacatataaaagtgtcagcaggctcagattaaagggctcatgaaagagggttatttccagagataagaatccttcatcctcctctgggcagggcagcagagatagaaggcacagccggctgagaccccgccgggcctcaggaagtctccactgttaaacccagcctgcaaagcccttccctcttagggatccactccattagagttgacctgaaagctgactcctttggagtggtgcgttccattaattcatccatccaacaattgcttgctgaggacctagtatgtgtcaagacagctggagatagagcaaggcaccagtcatttcagtgttttcagatgaattccccacctattgcctgctctattcttaatcacaggggcggcccccactatgttttctggcactgttgccaactggatcatactggatttggccagtggaagcactgggcaaagcccagagggcggaaggaagggagaagttggaacctgtccctctcctgtctgttcttcagccatgattaggtctcctccatgataccacctcctctttttgtccttccaggccccagctcctttctcttgtcaacctccgggttgccctacagtgacctacttagccattccactcttctgatgctagggtaatagttccctacattaaatatactctcttgagccactttgttttcctggctgggttctgacctctacaagcattgaatctgactaaccagatccctgccctcttagaacttacattccagtgggcaggaatacaataagcaagtaagcattcaaatacatgaataagaacagttcctgatcatgttaggattatgaaggaaattagcatcgaggtggcaggatttggggatggagagctatatcagctggtaaggggatatctctgctgagatctgaagaacgcaatggatctacctttgaaaggccaggagaagagcatggcaggcagagggaacagtaggtcaaaggtctcccaggaagaactagcttggtgtgcttcaagagcctccagaagccaatgtggccaatgcatctgagcaatgggggatgtgtcaggggccaatgccatgggaaggagtttggaacttacaattgatttcatttacatttaaaaagatcactttggccaatgtatagggaattttcctcattgtttataaagagagacccttaatgcctcaccctgtccaggcatatccccatcttgaaggtctaagagagagctacccctcctaatgagtttgcacaacaagaatgggggggacaaccatagctcctaaagcatggttctgagggagaaacggtggttcccttgatatcagctctaccatgttctgaggccatggtacagaagaggtaaccattcatgtgcatgacagccctgactctaaggggcattgtgggttcctttcttaaccattctggaaggttcctggtgaaaggactgatgcacatccacatagccttgcattccaaggtgatccactggaccgtctagacttttatctctggaccctgggagttgcagacactgtatcagaacctccaaccttccccttggcctgccagaaagctgaaagtttccatgcctctgctttccagctctttctctgctacatcagagagcccctttctcatgtcctcaaagtgacaaatgtatgctgccaagcaaggctgagggaaagaaggaaatagaaatgcagtccccatcatgcattctttcccaaaatgcgactaatctggcatttaggttgtttgctcctttaatcagaatgccattaagaaatctctgccgggtttctgtacacagtttttctctaatgaagcatcaaatctctttcacaaacaatagctgtgtcacatccaagcaccctggccccagccggtgtggctgcagtctctgctaaatgtgctgcctctttcaggtctgttcctcccagaatagcccgccactgcggtactcaaatcaaagtctcgacactgtctagctccagcaacgtggacagacaaaagaaatcagaggttttcaagaagacatagtgctgtgtccctagaatttgacagaatagcttggaatatgatgtttaatgaatagcctttctagtgaacatgtttgtcctggcttcaactctgggcccaggtttgcagtggctcacccaatgggtgtacttatcatccttgacttaacccccaactagtgagctatttcctggagggtggaccttgtcagaggcagaactataatgagatgtccccagagctattagtgaataacatggcagagccctgctgagcatggtgtttgaccaggcccaggtgccatggtctctaagcatatgttcatatatacatcttggaaggcaatgcagcaacaactatcattatttaaggtgcacataacctgggacccaaaaatgccattcataggagtttaccccatagatacactggcacatgtgtgcaaagaccaatgtaagaatgcatttgctgttacattgtttattacagcacaagattagaaacaatgttacaatcagggccaggcacagtgactcacgcctgtaatcccagcactttggaaggctgaggtgggcgggtcatctgaggtcaggagttcgaggccaggcttgccaacatggtgaaaccttgtctctactaaaaatacaaaaactagccaggcctggtgccacacgcctgtaatcccctctacttgggaggctgaagcaggagaatctcttgaacccaggaggtggaggttgcagtcagccgagattgtgccactgcactccagcctggacaacagagcaagactctgtctcaaaaaaaagaaaagaaacaatctattgataaggggctcccaattacatatatttggatacaccaatgcaaagtaaaaatatgttgtagctgtttttaaaggcaggtatataggtctgatgtgaatagatcattaagaaatagtgtgaggccgggtgtggtggctcaggactgtaatcccagcactttgggaagccaaggtgggcagatcacctgaggacaggagttcaagaccagcctggccaacatggtgaaaccctgtctctactaaaaatacaaaaattagccagcaaggtggtgcatgcctataatcccagctactccagaggctgaagcaggagaatcacttgaatcccggaggcagaggttgcagtgagccgagatcatgccactgcactctagcctggacaacaagagtgaaactcggtctcaaaaaaaaaaaagagagtagtgtgaaagtgcaccatcattttttaaatgggaaaattatacatagacacgcatatatgtgtgcacatacgcttgtatgtgcatagattctcactgaaagtgtacactagagattgttaataaacagttttcaggccgggcgcggtggctcacgcctgtaatcccagcactttgggaggccgaggcgggtggatcatgaggtcaggagatcgagaccattctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccacagtccggcctgggcgacagagcgagactccgtctcaaaaaaaaaaaaaaaaaaaaaaaaaaaaaacagttttcagctctgggaaggaaaaatggggcattagaaactggggatgaagagatattttaaagtatatgatttcaaacaaattaacttttttttatttttacaagtacatacttaatctctttaaaagtaattttgtaaaagggcaaaatgcagtgctccctgaggctctggtaaataaaccgagaaatcactgactggaagttgtggtagataaaataatgaccctcaaagatgccagtatcttaatcccaagaacccatgaatatgtgaccttacatggcaaaaggggtttgctggtgtgattaagttaaggatcttgaaatggggagattgtccttgattatccaggtgggcccactgtaatcactaggtctttataaaagggaggtagagggtcagaatcagagaagaagatgtgccaacagaagcaaaagtaagaagtgatgtgaggaaggggccatggaccaaaaagtgtaggcagtctctagaggctagaaaaggaaaggaagcagagtcttcccagagccagcctccagtcctgctgacactttgactttagcccagtgagatgatttgggattctgaccccccaaatctgtaagacaataaatttatattgttgcagccactaagtttgtggtaatttgttacagcagcaacagggaactaatatggaggtaaaccttttaaaaccaactaattcatgtgtcagaagggggaccatcagccatgcttacccaagtggaggctcatcacccttgattgatcattctgctggggacaggacagattttccataacactatcagttccaatgaaagctgatgtatgaaaaacatctcccttagttggtctgatggtagcagtctcctggatagaactgccatcccagacccacactggggtgagcttggcagccatctggcctcatcactatgctcttcacagaatgctatctccactctagcatgtgtctgtctcatttatcaagctgatgacatggcggtatgaaaaaaacagatgagaggtcctacctgccgatctgctccaaagagattataaaatctaagaggaatgcctgggtgtgtgggcgggggggcggtgggggaatgtagagaagaacaaagttccttctggagctttgggaaagccgtttgtgagcctggacttcccccagcctttgaatcattaatctggttgtacccaagacatccaacagggtgcagacttgcctcattgctccagaagctgagaccacccccgtaacttgtgaggacggaggtcctaccccctgtgaagaaggctgagacacagagaaaactgagagattaaatttataatcataaccttcctctggcttccagagaactacaaaacaaggacacattcccactgtctcttgtcccaagagtagagccaaaccaaatagcctcaccatacccaacattatgcaacttgaagcccaatcaattggctccacccacatttcatctacaggacattgttgccaaacttcttaggtatcttcaatatgagatttttaaagagctaaagatataacagaaaaagcctcaatggaaattttacggctattttcttttgcggctcagggaacataagcttttatcattttccttcattcaagtaacagctttgccctagctccatggttgtcatgcatggtccatggtgctgctttgatgatttataaccagctgagtcatcatctcactaagtcaaaagagattagtatgtgaacctatttggtaaactgtaaggcactacacacgtctggtggcaaggcttgtaaagctctaaatacacgcataattaatgtgactactccccaagacagatggtataaaggagacgacctctacctatgaaaggaaggggagaagaaaagatcaaaaccacctccttctccagccaagctatgtttgctctcccattcctctccttactcccaagatctaaacatgacaggagtggagaagggaagatgtctttaatttcctggttaatttctcctgcctggattccaagatggagacccaaagggagacctgtgtgataactggccctcaaaggagtgcacacagtagacccaggagcaacagcaaaagttgctgactaaacctggggacagcaattggtatccatccctcaggcatttactttgccttttcctcaccagtcaacttcaaggcccttgaagttgtcaagaaactggcaacctagacatttatatccaaaccagatccaagaattgtatcgtaagaatggaacaataattgaaccttgtgtcccctgctaaaccagagagagcttgtcaacaaaaaggactgagagaagaatcctggggaacgggctaatgagaaaggctacctgaaccttcagaaatacctggggagcttattttatttatttatttattttgagacagaggttcactctcaacgcccaggctggagtgcagtggtgtgatctcggctcactgcaacctccacctcctgggctcaagcgattctcctgcctcagcgtcccgagtagctgggctacaggcattcaccaccacgctcagctaatctttgtacttttagcagagacagggtttcgtcatgttggccaggctcgtctcgaactcctgacctcaggtgatccacccaacttggcctcccaaagtgctgggattacaggtgtgagccaccgtgcccaaacttgcagcttattttaaatggatgtctgggctgcactgcagatctatggtgataaggcaggagggggcaccctaactgaaaaaaaaatctccagatgattccaatacccagctgagtttaggtcctaccacattaggtgacctcccaaaggtcccctcatttgatttccctcccacttccacactgaacaccagcaagtccagagagaaatggccctcggcatccagcagagttctttccagtgcccgccagagtgatggccaccaaaccttcctccagactggctcccattgtgtgcagggcaggcaggacagtctgtaagagatcatcactgtggacaatcggggaaggagctggcctgggcagagactgccctgaacattcatgggacctgcgccccagagcatcagatgggcctctctgctgaaggaataataaatatgtcttttgaacaactgattttgttgttgttgtgtttccacacatatatgttcaccagtgctggtttcatagtagttcagtcgtactgcacaggtgagctagggggctttcttaaaagccagaagactatttaaatttagatttgcatgctgaaatggagcaacttttggcatgtgataaagatggggaaagttgaagaccacaccctgcaacgccctccctgacttactactaccacccatcatctcccattaaaagaaacaaaacaaaacatcattctaatgccagttaaacgttgcatgtattgattaagccttccctcccatctgaaattctccctaaggagtaacattttaaagcttgcagtgagggtcctaaggaggctgctgctttgacagcctgcatgagcagcagaagggaccttgctccctaggccagcatctggatttcccatctggcccacgcctgcagctgcgtaaccctctggcccccctccaacgtgcctcaaaatgttatttcacattttgggtccaaatggacactttctgagaagtcggtgtaacctatcaagctttggaaacaagtttaagttgtttttgtactttccattacccaggttgttctggaacgcagctctaagaggttcagcttgccaccacgtcaaggaatttgagaaaagggaaaaacaaagagggggaaagcctgcacaagaagaccgagggtctggaaatcagaacctggtgttttccaaaggtcctgttcagcctacactccccttttccatttctgccatgctgttggggcaaactggcatgggaagtaggggcttttgtcctaaaggcatagcatcaaggtccccagagctacaaggctctccaattccttctccctggtcccgtatcatcagacaaacccaatagagtgattctctaacatgctgtgctcagaaaggtgaaagaaccaccaggcgtggtagggaggctgtgtccactgttcagcccagtcagtgtggcttctctccctgggctgggctccatcagctcatgctgagcctctgtggcattagaaaaaataatcccttggcctcagggcctgctaagggacttcaagccagatttcattcccattcacttcctaagccaggtaccctgtgcagggcatgagagccagtggacaggacgcccctgcacttgggagattcggtaccctgattaagggaaagccacctccctggctctggggaaggtaagagacctgagaaagcaacagccttggatctcactacattttgtgggctacttctgaaaaccacactttgaattccagtcccatcactgaccagctctggactacctgtgactttgaataagctattcaatctgtgcctcaactccctcccccatacaatggggaggatgttagcatctatctcacaggtagagttgttgtgaggactaggcagagtaatccatataaggcactctatcattatgttgttagatcagtttcaagaagcacattttccaacataaaatgatttgtgaaactgagatcttataatcagtccatatgttaatacatacttaatagagttttctcccaccgcatcctccaaaacagcaggtattaaatcaatggtgcatctttctcatcaacgtatttgagttaagaaaatatggtcttttaattaccatttcatgcatagtaatggctgcaatgttaaagactcacttcttcctgggtaattttgcagcatagtctctaccagcacccctggggatgtaggtgcctaccaagccaccatctcctttcttctccagcccctctggactccttcaggtgctctcaaacctaaactcataaaatccttgccagatccttagggagcatccaacaagtggttctgagcccgagctgctcacagaaatcctagggcactcgctggccccacaggttctgattccattaatggaagtgaggcccgggcatcagcatttttaaaagctccccagatggttgtaacatgcagtggaatcaagaactctggctccagtctgtccccacctccatctgatgcctgaaatcccctcaatccctgcagctaatgagtagctggccagcctcttccaggagaatcaaaacttcactgacttaggttgcagaacaccataataaagcagaggttcttcctcaggcagtgtctttgttgttctgagataaagaaaaagaccttgaaggcaattctaagctgggaaatgagaaaacctgcctcaaatggagtccttcttcccagccatcttaagctcagatacctggaatttatttattttgaactttgtagaaatcttttgacttacaaatgacctaattctctaaactagctatgctgagaatgcaagataacttttatgctggcttgattccataagaaatagtgactcataaggatcatcatcagaaataaatttctcaaaacttttaagtaaatctgtttctaggtaaacttgatggacttttgaaggattatatttcccccttctttttcctcttgcatccataccaagctcttttctttatggcagaccttgtttcctctccatcttctactttcatagatacagtccatcaaatcatacacatgactcatttcaccaaccacgaagattctaccatgcactggagaattagtgagttggcttcaactgcacttcaattgacgccccggaggtgggtaagcatacatttccacatgtatgcagatagaaaaatatctgattgggcactaaatgtttaattctctgagaaattggcaatccagtgagaaagctacgctaggcatcctagatgcttttagatcacagtaatggaagcatctcacaacagcctaatgttttcaacccatcagaaagcagagtcccagagagcctatggggactcaaaacaaacccaactaaagccaggtggagtgacctctcatctcagactccaaggcttgggagtaggaatgggcaaagtggagacaagctgccaaatattaggggtgcgccatgtcctacatgttggatgggccctttacacatgccatctcctttaacttccttctcacagtaagtggggagacagagattagaatcaggctcgcataaggtcacaaagatagtaaacagcagacctaggacttagccctggtccctctgatttccaagcttccttccaccaaatggtggagtaacttgctcccaatccatggatccagacctgggaaaggggctgcttctctgagctccaggagctattggttgagaatcctctcttttttgcatccctgggttgctgcccacccccatactgctccttaagcacttaattaatggtgtcctgtggccagtcctgatgatgcagtttttcttggtcactctgtgggccacagacttgcagctgccaattccccctacaagcattgctcgggtccaggcccactgtaggagacaccctgactactccggtgcagatctcacagctaccatgactgtttgttcagcccccacattctccagggtcccaatttcttgtcccacattcaaaaagaatgaggttatgctgccagccagtgggtgagcaaggtgaaaagttttattaactgatgaaacagctgtcagcagagaggggacgtgagaattgtctaccacccaaagtcaggtagtctctgtgtcccagtgtggctgagtccagggtttttatgggctcagaaaggggatggatactgattggtctgtgagtatgcaaaaaaaggcaacagtgtaaaaaccaattggggaagggtgggtataggtgaagaggtgggggttaatcagaggaaagcatgccaaatgggaagagaggttctcaatccagtctgtggatttatccaagacttgtagcttggctttcagactttaaactggctttggtttgcaggggggggtttcactggggactcacctgtgtttgcctagggatttgtctacctcctgctgtatcactgagttcaaatccccattctaccacttgccagctgtgtagccttgggaaaattactaacctctctggcctcagtttctccatgtttgaggtggaaataataatacctactctgctctgaacactaaatgagctcatttacgatggcatttagaagagtggacagaagtgaatgttccttctcccattattcatattgactccaccagtactgtctcacagggtcactgtatcatggcatccatctttccatgggtacatgtcttgtatagtccttaggggaaggtcttgttcttctctcctctcctcagggtccactcacttatgcattatctcataaaggatactgaagcccattgagggcatttcctaatctgaaggggcctctgatagacttctactacttaagtctcccatcactttcccacccttaaccccattctagaaaaacccataggtaaacagagtatacctgattttctaatacccattgaatattttatatttgtttttatactttgcaatgaagaatgtttcagtaaatttcctaaaggaaacaaaaaactcatagatgatataagtaagccatgtcacccctgggcttcctccaccttccactgtgtactacaggcagcacagtccctcccatgctgtgctctgaccttgcctgaccttgccaccctgagtgtgacctgcagaccagcagcatcagcatacccaggaagtcagttagaaatgtgaattcttgggccacagacttaaagactcagaatttgagcccatggattcttgcttcagggtctgtgctcttcgccaccacactacactgtttctctttatcagcaatgaaattgagaacagactcattgcaagacgctcattgtcagctccgtcctctactgacttcaaaacatcatcagcttttcacattaaatttgtttatcacccgtctcagatactatctttgatatcagaggtaagactggcattgtggacagatgttttcatgccttgacccaaaagggtaacaaacatggatactgcaggccaacacgaaggaattgtgttgatgggccataagaaccacaatgggtcccttaaaccacacctcagctacctgatttcctgcacatagggccagaaatatactaaggggaaaatggtagaagggaaaatgagaacaagaaagaatgagataccctgcaggtgtcttcctctactagggaggcccctgagaaatgactgaatgtttttagcaaaagattagaagaataatattatcttgccatctgttattgcttatagagagccaataagtgtgtcttagagattctgagttccagggatgatcccactcaggttccctgacccactgtgagtcatacctccatagcagaggggcccctaaccccaggatttccatgccttctgcaagctggtcttttagatttcatcagcagtcagtcctgtggccatggaacggggaatgatcgatgacagcccactgaaggaggaccttcttcttgtttgcttggttctggggaatgcatctcctaggcaggagcaacacgtgccataatggtaaaataatttgggaaaaaatggcaaaaaatatttgcttttgccttaaatctaccaaaagtggatcacaggttgaaaactgcctgatcttggtcgttcgaagcccctgagtggctcagtatttgaactcagtgcagccctgagcaaccaattaatatttgcccagtgggcaggattgacttcagttacctaaagatgttactactgctcttctggttgcccagagattcccacaccccgtgtgcagcacagatccagcagagactccttgccaaaggccattgcggtccaagaccccaaagaggaaggctccagaggtgactgctgcttgggaagtcaatatcggacatgagtgctagaaccaaggtaatgcttcccagacttcactatgcccaccagagacctggagagcttgttaaaattttgactgctgggccaagagagctggggctgaacctgagaatctacatttctaacaagtctccaggggatggtggtcgatggaccacactgagaagcaccatgtctgaaaatcttttgagccaaacattttatttcaccaatgaagaatttgggaccagagaggctaactagtatgtccaaaatcacccagcacatcagtgacagggttgggaccaggtgccctgactcctagtttccactgtgttcccactctatcagcttaccttaaaacagcaatcgtcatagtcattttatgaactataactcattttgagtaccaaatgcttttcctatttcctcttctttatctttataatcaccctttgaggttgagggcatgggtctcaacttatagagaaagaaacgaaggttgaaaaaagtaacaacaacaatgaaaattggctctagatcacaagccaaggagtagagctggattctacccagttctctctgaccttgtgctgttcctctttacatctcttcaggttctcagaggggagctctctctaccaaaggtttaatgcaagacccacatagtcacctagcttacggaaaggacaggcctgaagactagggtaaaattaagatgataaaacagtgaacaaatattttaaaactatgtccaggaggaaagctagaggaaagagccctaagccccagctgctccataggctacctgtcattctctttccaaaacctttcaggggtttaagacctagaaccacgtgtctgacaccacagccctgtaaattctgtccccaagagtcctgaggctctgcgcaaacaaaattaatagcctgcaaactctaaatgggtgattacaatctataaagcagcccataaaatgacatcatggggattcatatttattttctcccactgatttccactataaatttgcttggtttatgagtagaaacagtttcttctgctacgtgcctgggcataaagctcacctaaagatggaaacctaaagatgtctggggctcacttcacccccagtggtgctctggtcaatgggacacacagaagaaacctcccaaggaagctctggaaaccccaaagcagccactgcctctacaaacatgccctgagagcctgctgagctgcaggcttctgtgctaggtcttgagcagtagccaacaaaatgggggtggtctctgccctcagggaccttgcaagggtccctgaaagggaaagaggagacagacactaaacagaaaactacatggataacacatgggggttcattagggaatgcaaagggaaagtacagcaagctatgagctgtggaacaggagcagctaacctgatctggtaggggtgatgcccaagaaggatgagtaagtggaggctaagcaaaaggtggggaaagggagaagaggagagacattccaagtagagggatccacatgggtagagcccagctgtttgctgctgttgcagttgagccacatgagtatcaaataaagaatgacaaaaattctgggtcagacaacacatataggatataataagattaggttttcttccaagtgcaatagaaataaatgaagagttttaagaaaagaattaacatgatcagaaaaccatcttagaaagattctaccagccgcagttagaagaatggatttgacagagagggggtgtttaggagggaatgtcagcagatttgtaggacactattgcagttgtctacacaagaagtgatggtggcctgaactaggtaagaataaatgggccacagtgctatctaggaggtaggaccgattagggctgtcagacccagcttacgcaaaaagggcagggcatttaggaggtgcacagtagataatggtgatcactgacctactggcacttgcaaatgctttgaatccaatctcattagccaaggtcaatacctggaagccactcagaagccagtattggtacgaggtcaagtgaccacctcaccagtgcaacatagcacacgcagctcaagtcatccccagaccagttgacactctcaacttgcaaaagaacacatgaggtagaatccctttcctttaatttaacccaagctctactactgcctcagttcaaaggtcatcaattgcaagatcagcagaaggggcatggctccctgaatcccaacaaggctacaagggttttggttttacatagctcatccaaagccagtctcttctggccttcagaaatttctccctcttccaagctccaagggcatttatatcatccctgtacatgcagacacagtccccaacttacaatggctcaacttatgattttttgagtttacaatactccaaaagcaatgggtattcagaagaagctgtacttcaagtacccatacgaccattttgtttcctactttaagtgcaatattcaataaattacatgcaatgttcaacgcttatcacaaaataggtgttgggttagataattttgcccaactatgagctaatgtaagtgttctgagcacatttaaggtttaaggctaggctaagccatgatgttcagtagatggagtctcgttccgtcacccaggctggagtgcagtggcgcgatcttggctcactgcaagctccacctcccaggttcaggccattctcctgcctcagcctcccaagtagctgggactacaggcgcgcaccaccacgcccagctaatttttttgtatttttttagtagagacggggtttcaccgtgttagccaggatggtctcgatctcctgacctcgtgatccaccctcctcggcctcccaaagggctgggattacaggcatgagccactgcacccggcctaaacacatttttaacttatgatattttcaacttatgatgggctatcaggatgtaacaccattgtacgttgagaagcatctcattctaccttgcttagattcaatttggaatcacaacttaggctgccattgttgtctaataattgcatgttcattaacctgttttccaaaaagactttaagccaccttaagataagcacagcatacccagcgacaaggtgctgtagatgagcacctactaaatatcagagaaagaagtgaattgactgggcccagaagagaggaaaatgccagtctggtgatgccagaccaacagagaggagtgagtgggaggacaggctcagcactgaactatctagagttgcccttgagtcctagccaagatggctgtcactccccaggtgcccagagatggtggctttcttgagcaattgatctgaaaataggtcccctaagcagaccttgtcactgaagttcacacactgcccaagctgagtgccatgctgagcatagcccagatgaaatgattgctcatcttgagggcaacatcccagacaaaccagtcccttttatgtctcactcactatggagggaaagcccctgctctcttgccctcaaacattagatgggcttacagaaatgcattcccatttcataatgcctgctgtgattccaggtaattcctctaagtgcactattaaatcccagcagctgttccagataacagcaaagtcgacaattccagctgccgccttgtcaggaaatgaagcaaagcagctgtaagtttcctaacactgagacatgaccaaaatggcagcatgagggatcactcatgtgcaggtttctccaccgccatgcagataatgtgtgtccaccatcacacatacattacctgccctgagtctactctgatgtctgaggctggaggactcaaaactgtgggccatattcccctgagatacccagctacagttatctttgagatcctcatgagaaagaatcccaaattaacactgagcccctacccataaagcatgctcaaggtgctggagaattgcttaaggccacacagctaaaatggccgccaagtcaggatttgaactctgatcctgtgagctccaaagcatcaagcttctctatccttcactgttccctactgctcttaaagccctgtatttcccttacccaaaggagcccggccatctcaacagtattttcgccatctgggccaaccacgtgccggcagagtgcataaataccacttttgtgaccaaaactgtatttcctcggttgatccaacatcagcatctttgcacctgcaactttccttaagaagaatttttccatgatgtgatgacagaatttgcagccagcaaaggggatcatagacatacatgtacacacgagcccacaaccatctacttcaaagcctcccagcctgaagtacgctctccagatgtctctatataccaggtgcttcgaggctggccagcatctccctgacagcagaacaagttagtataaggaatttctatttaaaagccaagttctacaaaagctaagccaagcaaggttctaataaacagtaaaaccgccacgttgtgacacatggcttaaagttggtcactcacctaggtgggtcagaaagacaccaatgcttttcattttccccagcacctcaaccctggttagtgctagggtgggatccctggtgggagactccacccacactgaacctggctggcttcacttttccagactggtgtgttctccaggcaaatatatattttccccctacccacctccctccgtgtgactcagcaagcaagtgctgggtaggaggagtgctggtagggtgggggacgactctgttctcattccaggctcaaggaacagcctcagtcatggacaagaagtataggcagagagtcaggagaccaaggctctagacctgttgttgatgactaagatggcctgggatgagtcccacagcctctctggtctcagttcctcatctataatttgcaggttgaatgatacctgaggctctgtgattgcttgagtcagccaacagctcaatcagccacacagaaacaacctctcctcttctctcttccagcctggataaagcttgtggggcatgagatttatgggtttggtgctgaattgcatcatgtatgaggcagaatttgagttggattttcatgggttgggaggatttgtaaaggcattgaaggcatggggggacatgagtggcataaacaaagaagtggagtcaggaatgtgcttagcgtctttgaaggaaccactagggatgataatttagacagcgtgcactagtacaactaaaccagtctctcaaatattgaaaccttttgtaccggctggtaaacagccaatggccttgacttaggagtgccccctcagctgcccctgctgctgcagtgcctatcccccatcccaaccccatgatccaacaaccaaagggttaatttctgagatctcgatccaaaaggtgcccataccatggtgatcctagtcagcccaaagccacaccacacatctaacaagcattcctgtgtgccagataccatcttaggcacattaacatatgttactttttctccccttcacactaacctcttcagattaaggaactgaggcttggagcagttatgtgacttgttcaaggatgcaataacagtatttgaacaaagaccattaaatccaagtccagagctcacttcttaaaaccccagctgcctctgagcagccttggcccgcagacagacgagctttggaggaaataggaggaatttctccctgctatggagattgttttaagatcatgaattgttagcggaacaagttgtcgtggcagcttatgaaatcaccctcttctgcgatttttataagtaagaggggttagaataggcccagagacagagggagagatgaaatgacctaataaaaccctttccaaccctggaacacttcagccccacatgaacagaaaagtctatttattttcaaagccccattttaactcctgaagtacttaggagacttaaatatgtctgaaggcaaaacaagttccctctttttcctcttttcctaccactccaactcttcattgcagattttcttcctgcaggtctgacaaacaccatttttggccacagctgctgtcagttcaaaagtttggctctggggtctgaagaccaaagtctgtccaaggctgatcaccttctgagaaagactcttaaattctgtgaagagtctccagcagaggagaaattggtttaaaaaagcaagaagaatcaccacaatgcatgcccactccacattaccaagcctgcacaactcatgttaggggatgtctgctgctcctccagctttctcccctggcaaatacagtggtggtccctgagtccccattagggcccaacagcaggaccagtagcagcccctgtcagagaaaccacagccagttggggagagcgaactcatactataggcttgtttccatggcaacagatgctccctcctccctgcttctcggcaccagggaaggacaaggaaacccatgagaagacagtggcaactagggggaggaggaatggcagcaagtcccctttctttgaaacccaggcagctgctgccccacatgttgatggttacagctctcagtgaccttggacaagttatgccccagctctgaactttgtttttatcatttaaaaaaataaataaataaaaaagatcaagagattgagagagagagcaagcgagctgggccagagatgatccaataaagctatttcagctctgatgtcccagaatccaatgatttgtctaacctggccagtgattgggaatgggttcacctcttcttgcagccctctgcaggagcatgacattccgcaaggctggagtggatctgcctctcagggacctaagccttatccattcccccagtcatgctgcctccctcacaatggtctgctgtcatttctctgaaatcatctcaggagatctatcccatgctttcctaagggtgcacgggtttcctggggctcacacaagccatccaacatgacaggtgagccagaatgtcatggcaccgcacccagccacttgcctcccacctcactgatgttgttggattcaacctgcaattcagatgcacacagcccactaggcgctagcctgctatgactgcgcaagcgaaggaactccagggagaacacccagaaaggtcattttgtttggtatgaagagtgctagggtgaggtgaggggcagggagtgggacagaagcttcccaggaaaaggggaaaccatgcacagcagccaggagccatggactccaataccccaaggtttggaaaagtacttgtaattttggctgattgaccaaaagtggaaagaggagtgtagcatgagagaagggaagagaggaaggacagaaaagtggacaaagaattccaggagatggccggccgcggtggctcatgcccgtaatcccagcactttgggaggccaaggcaggcggatcacctgaggtcaggagttcgagaccagcctggccaacatggtgaaaccccatctctactaaagatacaaaaaataactgggaatggtgatgcacatttgtaatcccagctacttgggaggctgagagaggaggactgcttgaacttgggagacggagattgtagtgagctgaaatcgtgacactgcactccagtttgggcaacagagcgagattctgtctcaaaaaataaagaatgccaagaggcataaaaacacggcaatgcttccagggctggatttaggggagaaaagggagtactcattgttggaagtacaagccacatgcccagtgctagcttttatgggagtagcaggggatagctgagggccaggttagtcactgagccctccacatgagcctggtgggggtgtacttgtttccattgtatgcatgaagaagcagcaactcagaactacagcatgatttcacctagtaggtcagctaccccttttctggagtatacaatcttgctgggggacaaaataaacaatcatggacaaattaccacatgatttaaaaattgacacacggccactctcacaaccatcctcagaaatccagaagttcagggaggaacaacaacaaattggacttctgaggacttcctgttgccagtggactttaagaaacgttcagcctctccagcgcaattcacccctaacctatcagactccgcgttggtctgtgatggctcatctctggctcggaaatggttaaacagttcatttctgtgcttgaatcaggagcttccttaaacgctagcataaagctggtctacacataagaaatctgattagctcccagcattgggcaatcccaattattatgccctgcaagttgctctgcaggattagcggtctgcggaagaaaggaatcaatatacaacagtaattagggctcctgatgccggtaagaggagcacttctcttccccttaagccactcacgacagagtccatgaggggacagggccttcacagcactgccagtctctgttttctagcatatgttcattttgactttggtttttatttactgaaggatgtgaaattctctgctactgggccaagactttagggctacatacgtcacccaagaacagcgaacaggatgtgtcatgcatgggaccttccttccaaggaaactcagggaaagcagatgctaggatcctggcaaccccaggaaacctaatcagtgtccctgtaaccaagagctctttgagaacaggggctgtgtcttatttaccttatatcaatgtggcctagcacagtacctggcacatggtaagtaatgaacgggatggatgaggaagtgaatcaatgagtaagtgaattaataacacatggttttcagtttgtcaaaaactttatctgtgagcctgctgtgcacagaattttgtaccctaatactgtagtagcaatttacattggactcacaggatttgggggttaaagggaatttgaatataacccaatctggtatttttaaaatcacaggttgcaacctattagtggaccatgagatcagtttcatgagtcctgaccgtcattttataaatgaaatgagaatggaatgaaatgaagtggagtggagtgggatggaatgagatggaactagcaggaaataatagaatattccagaatagaaactatcaaagtacatcacatgtagtaaaggtgagtacaggaaaattaggcttgtacttgcagggcatgagtgtgtgtctattgggtgtacagtgtcttaaggccaaaagccactgatgaatctaaccattcatccagtgattttcactgccctcagaggccacatcagggacaaataattttcctttttgatcccctcttgttacaggaaatgaatttcatccagaagcagcctgtttcacttacagactgtctggctgcaggaattagggcaaatcagagatgttatagaaagaaaaagaaaatgtttcctagatcaaaacacccatctaagtgctggggccatagagatgagatcgattccattttccacatgacaaacattcaaagattttagaatgtcaattgcgcccctgctgaatggcttggagaagagcaggaatagttctagttatcctaacaattgctcctaagatgttgctttgtacctgctcgttatccatcttgattgtgtttatgtaagttccagcccattcatgacccctggtgtgtggcatgaagaccatcacatttgagtctggtctgaagcttgtctgggtgatggctgaggtgaacccatgttagctcctggtgctcaccaactctcttcctaaaagctctcacattatctgttcaaaagcctgcatccacctagcagggtaatttcatcatccctgccctctcgtctgtgaataaacagcttgaactaatagtatttttcaaatgtttttgaccacaaccctcaggaagaaatgtactttacaacatggttcagaagacaccaccacacccccaacacacacacacacacacacacacacacacacacacacacacacgaagcaatgtttacctttactatatataatgggatgtactatgatgttttattctattctgcttcatttcttatgatgttggtgatgacccattaaatagatttcacaagctactgatggaccatgacccacagtgacactgaactagatagtacctaataatctgaaaaggcagggaagggcatctgggaagaatttcacaccaagcccatttcttttcattatgtttatttagccatgtgcctacgtttggttgtgtgtaaaggaagacaatggcttagtgagctgcagccaggctgttttggggactcacaaaggaatggtcacagtttcctgcctgtctcttattgccccccaggcaagctcattgagaaaagacagtgtgagtctcgtacagagcatgctgataactattacagatacgtgattattctcggttctgttgatgataacaacatagctgccatcttgtgtttgtttcctcttaggattagaaagcaaaagcaatctgaagattgaaagtcagaagcaaagttagaatggtgatttttttcccccaacccaacttggaagaatttgtctttggagaaccaacctaatcaaataaagtagcatcaatttactggagacataatccaacttgcataattgtcctggctggtttacaccacagctgttcatatgacatggttcattaaataataaagtcttcatcaggctctcctgcactgggctgcaattcttttcccccacaccaccaaagaagtgctgcctttattagaatgcagtgccacccattggcagtgggataatcaggggatttgtttttatgtgacattctattaaccaaacatcataaactgcatcaagtaaaagccactgcattttccccagtggaggatcccatcaccacataatcattctagactgtgggttctctgtgggcagggaccacatcccttcatctttatattcccagtgctaagcaaagtactcagcattggtgggcgcaagataaacatctattgaattaagaggaaaatatctccagtgtgggattcagaagagcaatgcttagaaacctggaggctccctggttgcaatgagcatttagtgtcttgaatactgtgtccctttcctttctggtttattaattttccacttgactggaccaaattttccaagtccacgtgatagcagacaggactctcaaaatcccctctggccaacagaaggttcaacaacaccaattttgctgtcttcaagctcaggagccctgctgggcagcagggaacctgtgccaatctcagtcttcctaaagaatcccacagttaaaagaggccacctgaaaatgggctgctgagaggtaacgatgaccttggaaatgtcctcaggtttgggaagtcagcaatttggtttacaaagcatgaaaaggaagactcgttgtaaaatacagaagatttaccagcttaagtagtttagaccaactcaaacttgagcttgagcctgcacgggactctcctggagggattgttcaagcacagagggttggcttcaccctcagagtttctgattcaggaatctgcacctctaagatccaggtaacgctgctcctccaggcaccccactttgagaagcattggtttagcctgcttattacaagcaaggctctagagctggctatctatgctggaaccctgaacccaccacctcagccaataattttaggcaagtcatttaaactttcccatccccaagatgcaagtgtcaaaccaaagcaccaagaggatctttctcacgagattgttatgaaggtcaaaggaggacacccactgcttaggggtgtgcttggtaggtagaaagagcttaattaaagttaaccacataaaggaaagtagggatatggtctgggggaaagactgctggtcagagaagccagatatgcattctagctctagccctgcgaccctgacttgctgtgtgaccctggacaagtgacttctttctgggtcatgccctcattcataaaatggggacactggacattctataatggactgaaggtgccttggcgctagaagcttccaaagctccttgctcctgactctatcacacagcgtcacgtacctgtagtgccttcccaatcaccccctaccacttagactgccaactgccaggccccagcaggataactcaagactgccttgaagacattgtctggttccttggccttgaagggtctttccacttggccacaggtgaccacctgactcaccgaatgtagtctaaggaacccacttccacctgggaagtgcaacctgggatccttcttgctgaaaccctattgcactccaccaagattttgttcacgtttcatttgtagccagctccactcatgcctctcattgatattcttttgtggttacattccagactggaagataagggaattcattgaagtgtttagaagggacaagtgtggtttcatcgggagtgttatgctcagatgagtattggaggattagttggggagagaatccacactcgcagagggagatgaggttctgaaatttattatcatagcctggttgtggggaagggagcctcaggaggagggttggaagcccaaattcctaattgaagatgcgaagcccattttcatcttatatttttattagccccatagcagcccactgcactggctttctgctaacagccgatggcagggagaggatgcttgttggcacaaggccgctgtacatttcatttttgtcagatgctggcaaaatttcctcatcagggaagataaattcgaggtgatattaataaacctctgaatgcagcaatcagatctggctggcactcttaatgattccaccagcagtgagccatttccagcctgaggagcttagagattcacggttttgtttaaggcatcccaaaaactagaaattgtttgcttgactcctgggttgagcccgcatcttcaacctggatactcccaggtgccccaagtgaggcagtagtgatggaagagaggcatttacaaaataaagtcttgggtaaatgttactcactattgttttgtacccagaaagtgctaagtgtctcatactatctcgtgtaattaccataggctcagtgatggaggtactatttttaggtgaggtcactccaacttagaaaggttatcattaacaatattggcatcatcatattgcaatattgactgacactaagtgctttctatgtgactgagcttaggattttacctgcattttcacttttcatttgcacaacaagttatcaattaagcactgtgatcgccaatttacagagttgaaaatagaggcttagagaggttaaacgtgaggctcaagatcagactcaagatgcatagccagtgatggaatccatgtgtgttggattctgaagctcatgccgccatggactgtgcttgttacggctcacaccaccatggactctactgtggaggcacaaccagagggccccatgggtctccacttgtagaaggcggttcacctatcatcctaccttctagtatgaaagcagcttgcactcataggcaagcttacagaagggtgcagccccagctcttgacatagaaccaagcacctggtaggcaccctttcaatgtttgataaataaatgaattgatggtcagtccctactcacgtcctagaagatttgtgaaaggacagttgaaattagtctcctatgctgctgtccacctcttggtatcttggtggacctattcaccaagggccaaatgtccctaagcacaggtgagaagagttgaggaaggtttttgtatcctactctgagagcagttggagacttcgttccttggcttagaagtcaagattggatgcagaactaggcaagttgcttttctgagcaaagagagtgctggcccaccccacatcctcccctggctgctggcccgctgcaagccttggcacacaagagaaggaggcagaagtgcatttgtttattcattcacccacaaacatgcctcaagcaattgagcacctactgaggccagagtagttttgggctctgcggagaacatacatataaataagaaaccatccttgaccttgaggaatttataagctaggaggaaaaataacaggtacattaactcaggtgtcagctgtctctggcttctccagtgcctaggcccatgtatacagcatcttgttttgccctgaataactttcatcctgaaggttacacttttttgagcttctccctcttgtccctcatcccaccccatcaccaccccatgccattgctccagatacaagcaaaaaggaacaacacagactgttgaagatttcacaggtaaggcagaaaaggaatttaaatcacatatctcatggcaaatgctctaacagattttgagtttgccttagttccttccaggccaaagcacaaccaaggatttccttccctgaccttttcccacagagttccttgaggtagaaaggtggctccaagaagcccaagtccttcactcgccctccaaaagcctcaccttttcactagagcagtcttcaccccttgtagatgtcattaaggatattcacaaatactcctattacgtcctctttctgggcaattgtaggattgcactttctagtttcctaaagttaagtgtggctgagtgctgagtggtttgctctagccaatgtaacatgagccacatgatgcgtgacacttctggatggaagctcttagccagagcagttcaccactgcctcctgccaagacggtgctggaagcaaagaccaagaggaagtttccatcaatctggtttgctgagtgactctgatgaacagcctccaccctcctactggcctcctaccttcatgactgatatatactgtattgagcaagaaataaacctttcttgtgttatgccactgtgggggctgtctgttactgtagcagagcatggcctcacttgactgatactgccctcttcgaagcagaacaattctgctttgctctgacctacagtcagactttcacactaaaccaaggtgggcactcaccaaacaaaagattctccaggtaacacaatctacactctgtggatggaaagttatggcatcttttgatggtggagcattttccttgaggtcttaccccttactccatgagactcatcaacatattttttctaaacaaaatggtggagaagaattctggggaaagaattctggggaaagagtgtctggcacaaaagaaatatgctctgggaagtgcatgaaaaaggtaagtgtcaaaacagtggagacacaggaaatagtagcattaatttggacataagatgtcttcaagaagaaagtgaagtcccccaaactttcatgcaggtttctctgcaaggaaggaaggggctactcccctaagaacctaattggaatgtggctctgggtgccaaagctgaggctgagaccctaggcacactcaaagaaggaagagggagcttctgtggctctcggtgctctgcttctctgggtcaaacccttcttgccacacaggtgtgggagcctgagcaggccagtccactcctgccctcctttcagcccactccctgggccaggatgcacacaggtatgtattccccaatttgagccctgcctcacttcttcctcgttgttacctgccagcaccaccacacttgagaacagcagacacattgaactaaatatgatatgatgtaactctagcctaggagttacagaaaaaaacccaagcacatttctaaaatattcgagaatcctgtgttgaatgttaaagaaaccaaccacataggatctttataacacaccaaggcaggcactcacggcctgtcctgaacaaatccaaatcttttatccctggaacctacgtcattgtccacctccaggaatctgtgctgttgagctgacggctcctccactacaatgttctgctcattcaagactctgtcctcagtggttcatctccctcattcacatcccccatcaaaatatgtctgacttgtatcctattctttcagggcctttctaagaaaattccaaatgtactctagcagcttaatattttgccttccctaggcaagatgtttatatttaatcaaacaacttctgggaatgatgtatgtttagtgtaaagatatgcattactcagagtggaaattttcagtatgcaacagatcataatggacagaaggctctttgtggagtccgtggcttcaccctacatgccattctataatatataccacatgtgccaaataaatcccctaaatacagctccaaaaataacatatcagtatccattctcaagtaagcgacttctgccatacccagaggagaaagcatcagattaggtaactctgcttagtggtaacattctctaaagatgaaagcacttttcccactgacagaagcatggctccaagaagcccaagtcctgaggatattgtcagtaaaaccacacacacaggtcacagcttgttattaatcaattaattctcagcttgctttgtcccaagtcatccagcagacagaacaagaagagatttacaagctgtgtgcatttaaattaatatttttaaatggcatgagtgtgcaattaatactttcgaagaacatgtccacaccagatcaggcagtgtcggtttttttttcccctgtccatatgagtctatttttaattcctttcttggggaaagacaacagtcctagatttgttttgttttgtgtttttcttctgagactcaaaataaccatgttctttctgcttcagtaaatcattactgcagcttgaaagggttcctagaaagttctagttccattcagtttttaggaggaaaagcaacccaaacacgccaagaactagaagctttatccacaagggagtacgcttcaggatgataccaactgcattaatcaggatagacaaggttatgctgcagtaacaactaaaacctaaaattccaaaggcataacacttaaacatttacttctcactcaggaaaagtcactttgggtctggtgactctccaacacagcttcctttaaagagatgactcagggattcaagctgattgtatcttgtggtctacaatctcaatgcatggcctctgcaatcaccatgaaaggccaagggagagcatggagaagcaggtagaggcattttactgactcggactaggagggacatatattatttctgtgcacaatccactcaacaacaaggggccttggaagcatgggagagtccacaagtatttgatggttattaaatctctctttacacgggttatctcatagtgatgttaagagacttcatgatgttgttactctacttagaaactcttggatttcagcccttgaagaccatgctccaacttcatcatcaaatcctcaccagaaaagacaagaggatacagaacactgagcaactcacaagatgtgtgctgcagatgtgtttatcagaactcaaaagtttcctctcttttctctgtcctatgactattccaggagtgccagacagaactagttcttacgctctgcgaagaaaagagtggactggaggtgggtcacattgacattttggtaagagccctactccttagaaacagaatgaaagttgtcaatgaggggaagggagtaaggactggctaagagtagccatgctgggaagatttcattgcaaattttcctctacctgggagctggcagataaaccagatcattgttcccaaacactggaaggaggaccgactgttaaaaaaaaaatacccatgctggagcctaaatactctatgctagagcctggctattgacatattagcaagcatccctgggcaatccaatgcacagtcatattttgcagtcattgcactaaaggaatatccaaggtccccaccaacactaggatttcacaatttatgagcattttgaaagaatttacccctgaggattgacttattcagcatttaaatgggaactaagaccacgtaattgactgggaccaaaccaagatcagaattcataacctcacagctgttcctcatgtcaactctttctattctaacacactgccatcctcattttaaaaaagggaatgtggccttgatattcccatagattgctggatgcatacttccctgtcaccttccagtagggacacaggcattctattagctcagcagaatacagggctcccatccacatctgatggaaggcaaaggagatgaaactggtctccatgttgaggacagactggtacattaaagaagcaataggtcccctcatttgtacaccaagactcaagagttgaatctttcctttagtgacaagtggaagtccatggaagaatatttacaggcatggaagagtgagtttgaagtggggggcaaattctaaagagtaaagcctttaccaatggtaaactgtgccctttctatccatgccagcttgggaacccagttgagagtctgaaggagcaggacttagctttggacctgtgagatttcctctgtccccatcccaactgtgctcaggcccatcactttgcaggagcataattttatggcaagaggttcaccacatacctattgagctgcaagaggagtgatatcaatgtgcatatagttagggagagcaaagagtgctaatttagtaactgaagataagttacattgtatatgagatgtatttatatgcattttctacttctctctcctgcctcctgtatcactataaaccctagcagtcaagttccatgtcaggcctgttggatctttttcctgccatagagggagggacctgggagatggggagggattcagggatgacagtgttccagagtttgaactgggcataaagatatagaaccatccactggccaaggctgtcataggtaaatcctgcctggaggcaatttctagacagaacattctgtgagcttctaaatgatcctgaggtcggtatgcagatgctgacttaccagatctaatttgggaaaaagaagagggtaagaagttatatcttctgtggggattctggtggtaaggatgggcacagaagcaaaagagtgtttcctccttctccagaacatctggcttcattgcaagccactgtgggctactggagtagatggagagcagacagcatggcaccaactgaacactgtgcccactctccagacctgtccatgcaacccacagtagtggagtggccactccagggtcaggtagatatggcttccttcccagctctgccaattcccagctgaaaacattcttaaacttttccagtgtcctgtaaaatgggaaaaccagacctgtcccattgtatcctagtgagaattacatgatgtcatgccattaaagtacccagtaccaagcctggtacattataaacatccaagagcctaggtcttagcttcttcacctagcatgacacctctcccacccagcttactataccactgtgagatgataaaagcacacaagccctgtcaatgctaaaatatttatgaagctatagagaatatttttttaaattttcaacctgaatgtctgatttttttcttctgtatagagacagggtatcactatgctgcccagactggactcaaactcccataattctccaaccttagcctccagagtagctgggtgccaccatgcccagcttgtgtaagagcttttctgtcacgttctcagcattcctagatgcatgcatcaggacttcaattcatgcttcttcttgcctacaagtgggttctgttggtagctggaaagccaggctatggtggaggcaacagaaggaatacaggggtcccctttccaaacctccaagttatctgggttgggatactacaattttaagagtatcaaggaaggagctggagagaggaacttctggacactcagtatagctctagactctctctctctctctctctctctctctctctgtgtgtgtgtgtgtgtgtgtgtgtgtgtgtgtgtgtgtgtcagagaaagagagtgagattgattttttattttgaactgactaggtgccaccccttcattaccatgctgatttaaactgtcaagactgcagcctggcctgaccactgaggagcaaagacaataggaaaacagaaggcgactcaggatgcaaatgcctcattgttacagaacaataaacagattcacccttttgctaaatgtcaggttaatatcctcttggcaccagctgtgcctctcccctccttccctgccacagtgagtccaggctcctggaagtctgcccttcaccagccacctaggctcagcactgggcgtcgaggagagcaggtgtggctggcacagtaaatgcaaacacaaccagtccaaccgcaaagtggaatcagcctttgcatggagtgatatcctgggacagcctcaagctctgactttggggagctctgggctttgggctacagcttgggtagctgactaagccaggggatggcactaacacatgttctccgtgtacttactcacaagccaagaacaggtaggcaaggagggaggatgaccttcaaggccagttaccaacaggctccaaatgcatttcccatggatgcccactgggcccatccccattcctccctccaccaagtccctatccattctaacttctcatgatcgcttctttctgccttatctctgcattgacattgacactgttgttgctggggggctttgctgtgcttgcctctgctgccccaacaggtctccttgtcgccataccattctccacagtatctgcagagtctccccagttagatgatctggccaggtcactccttaactcagaatacttctgtagctccctctggcttttaatgtaaagccaaacccttagcaagccactgaggaatgagtttgaccccattcctctgaactcacatggtcctttgagtttaccctttgcccaacccttattatccaggatgggggttgactgttttggtttcttcccccccatttctaaggacaggaaccatgcctcttacctctgcacaccctgtgccttacatggggtatggaacaggaaatgtgctcagtagtgattggaagccattcattccttactcagacctctctacaaattgtccctgagtctaacccacaacttccctcactgcaaaaatccttcagattgctcctgacaggactgtcttcctcatctcatctgttttctctgtcctaatcactctctggagcttagctcaggttcccccacaagtctcaccaccatgaagcctctacactgttttgtcttctctaactgcatcccccacgtggaacttcataacggtaggctttgtaatagttactttacacctctgaacctcatctacaaggatggttcacaatagatttgccataaattttaaattatgatgcaatataaataaagcacatagcacagaatctggcacacagtaagtgctgaaaatagatttgtctgatggtgaggacgagcgtggtggtggtggtggtggtggtgacagtgataatgatgatgatatctctgttttatattgcaagacccagaatgtcaattccttctttgagggaaagggccactgcttatagtggtcttgacaaacttcaaaacatatggcccaatgcttatttctggtggaagctttactgaccatattaatgctattgataatattttcatgttattggtattaatcacgttaccagggaaagagcattggattcaaagtcaaatgcagactttcagtcctgtttttccactttgggcctcagcttccttagctataaataaatgagttttccagagttttccagaatgatctgtagtcctttctagcaatgataattacgtggttattagtgagactagtccacaccaaagtgagcctacactccatccatatgggtcatccctccccagtatacctgggccccaaaatgcaagcacaccatggggaaatggaagaaattgggacttatgtcatccaaccaacagaacgccagtcctcacttcaacacacaaatgttttctgttttaaaatctactccagcagcactacaattggcattccccctcctagcagtgggttagcagcagatgttacagcaaaatgatccagactgggggtgattattaacccttctgcacagcatacccatttttgcttctgggtccacacttgcacacctaagacaagttcacccgccatccctgtcatcaagagcttcaccaccttcttgtctagacaagcttgaatcccaagcagaagaggagactgagcaccatatctttgctgctgtttttgttgttattgttgttgttgttgtttgagatggagtctcgctctgtcacacccaggctggaatgcagtggtgcaatctcagctcactgcaacctctgcctcctgggttcaagcgattctcctacctcagcctcctaggtagctgagattacaggtgcccaccatcacatcctgctaatgttttatatttttagtagagatggggtttcaccatattagccaggctggtctcgaactcttgacctcaggtgatctgcctgcctcagcctctcaaagtgctaggattacaggtgtgagccacctcgcctgaccagtatcaaatcttatcaagtatcaaccacatcctcctataaggtgagaaaccagaccccactgtaaggtaggactgcccacaatggtgtaaagagccatctgggaaataaatagtaaatagcccactgcaaaaaaaaaaagtttcaagacagacaaacctggcttctctatgtatagtctgtgcgatcttaggtaagccacttaaatgctctctcagtttcctctactataaagtggggatttttatgtcaacacaaccccaggaaataggctttgagtataataatattcacaaagcacacaaataggcactctgaagaggtcagcccctccctttccaccctgaggaccttgtgggagtgcacacaacgtgacctcaaggtaaagtgggactctgctccactgtttatgacataactgggttgtcttgcacattttaaatatctgtctgtgtctcattttcttcatctaaaactattcatatccccaagatttgttgttgggaattaaacaaaacaatacatgcaaaacagtacttggcgcacagtaagcactcaataaatatgtaattgtcatcacccatgttatcattatcatttaatgatgctgaagaacaagtaagtgcttatcacttcctttaaatcttggcaccaaccacactaaaatctcaggcaggcaggtcaaactgcaagtcagagggccagtactgtcaagtcccaacgaggccacaggaccagttacccatccgcagattatccttggaaaatgtttaaagcatcatccactctgatgtcagcaggtgtgtgctcaggcagtgctagtgtgacatcctataaaagtcagaaaaaaggcctcaaagaagataacctgagccaagaacacaggcgtagcttaactaaaatgtttgtctactcagacaccttggcccctgtccgtggtcctgaaagagacaagtggacaaagactgacgggtggtcatgacttttctttttcccttttgcaaatagttgaagacctcttctgatgcaaatggtatcaacaaaagataacagaagaaaacatatatgggaggtcatgacttctgagacatttccaaggagaaaacagaaagactcttcgacatcaagttcaaataaacaaaattattgagaataaatatatatctatattttttgtttttgtttttgttttattttgtttttttaagatggagtcttgcactgtcacccaggctggagtgcagtggcatgatctcggctcactgcaagcttcacctcctcagttcatgccattctcctgcctcagcctcccgagtagctgggactacaggcgcctgccaccatgcccggctaattttttgtatttttagtatggacagggtttcaccatgttaaccaggatggtctcgatctcctgaccttgtgatccccctgcctcggcctcccaaagtgctggaattacaggtgtgagccactgcgcccggtcaatatatatctatatttttagtcattgggcttccccacctcttataccctgactctaaaatcatcaaaaaacccttcataatgcataccagaaataacacaaatcacttgtgtggtctttggctactgctatggtctgaatgttttgtcccctcaaaatccatatattgaaatcctgtcatccaatgtgatattaggaggcaaagcctttggaagctaactaggtcatgagaaggatctctcatgaatgagactactgtctttaaaaaagagattccagagggccctcttgtttcttctgccaggtgaggacacagtcagaggactgccatctatgaaccagaaagcaggccatcaccaggcatggcatcagttagcaccttgatcttggattgcccagttttcagaactgtaaaaagtgtttttgtgtcaaccacacagtctaggtatttttgttacagcagctcaaatgaactaaaacacctcccctctgttggtctggataataagaaattgaacaacacgaatgtcctatcctgaaaataatttaattcttctattccctcatttattgcaaagacatgacagaaaatatttagtaggagcaaggctctgagatttcaatcctaacctctgattccagtcctaaatccatcactaatcaggataagaccttgggcaaattgcttcacctctttgtccctcagtttattcatctataaaaatgataacaaaaataatacttagttcataaggttattataaaaattaaatgagataatgcacccgaatagcttaaaaagtgcttgccacattgtacaaccccagtaaggataaatgttaatattataattagttttattgttattattattgttgttgttccaaattagacgtaaccacatattggtttgcacaggtgccctttctttgtactgtttctaatatctaaccccttctatcctctgcctgagaaaactgtggacatatcacgtaagatctgaagaaagtttgttcactcacccacccacccactgagttcaccataaaaagaattcagaaatttcttacaatgggagatagtaaaaacataatggccacaattcccaaaaagctgcagagagcttatacaccctcagtccacatcacaacagagccactctccactcccttacccagccatgcttggggccactcctactcacttcctcatcattctgtcaattttagaggagcccacggggctcacacaagctgtgcagatcaccaaggttagtatctccattgccttgctccttggaagaatgttcaatattagttcagtgttcccagcccacaacctaaagcctccaggagtcaggatgaaatacaaacaatggcaatgacccctccttatctggaactcacaataatttcgtaaatactgctatgcaccttggttccttcaatcttcttaacatccctccaaagcaggcggttagtgatctcccgattatacagaaaggtagctgaggcctagagattgacatgacttgctaaaattcacacagctatcagtgaatggcaaaatcagaacagcccaggatggctcttcaggcagcaaagtttagtgggaaaagcagccagggagaactcaagttcaagggagaacttgaatcttaacacttattacctatatgacctcaataaagtcacttaacctgtgaggactcagtttcctcacatgtaaaatgaaaatagtattttccattcaggatgctggggcatgcaataatgtgggagagcactgagccaagtgtttggcacagagatgggattaaataggagggtcctattgttattattactatggttaggggagccccattccctctccaacgtacagagccacacggaatctaaactaaggaggccataaaacacactggctccagtctaagtccagtgtctttctccctgccccccatgtacctgccagccacatgcctgaacagcagagagagagctcaatcatcacatgtggcttatctagagaacttttaaatcccacgctggcctgacccaccccagctggcatactctcaggcctctgacactggcagcaggtctgagcatgaggaatacagtatctaatctgagcaataacttgcttatccttatatttaatttatacaaaagtgctttatgatatatggcatgatggcaaccatgggtcagtgaaacatatgaatttccattaaacatatccacttccataaacaaccattcctgttttgagtaggtagagccagtaaggatgaaatgatgctgaagaggaaggcagtggagggtattttataaatatcaatattcaaataccacttaagtcctcatatttacttaataaatatgacaatgggccaggcacagtggctcacacctgtaatcccagaactttggaaggccaaggcaggaagatcacttgagcccaggagttcaagaccagcatgggcctgtctctacaaaacctttaaaaaaaaaaaaaaaatcagctgggtatggtggtgcatgcctgtggttccagctgcttgggatgctgagatgtgaagatcccttgagtccgggaggtcgaggctgcagggagctatgattgcacctctatactccagcctgggcaacagagccagacctcatctctaatatatgtatatatatataaaataggtaacctgtcccctgtcccaaattgccctggggagcactgcaaagccttaaagaaatacattggggattatctgcttgtttggttacccaagctgctacttcctttttgtctataattaatgaaattagaccatgcacatagatgagatccactcaagtctacaaatattgacagcactagatatacattttgaggccatgaaaatgcaatgaggaacaagacacaacccctgttgttacgagggcacagcccattgtgggagacagattacatagcatttacagtacgataggctgagtacgcaggggtaagggaacacagaggaggaacatgtttcctgaatttggggcccaaagctgagacctaaagcgtgcacaggagttggccaggggatgagagggaaaaaaaggagagagagttgctctgagttaaggaaacatttgagcaaaaaatccatttgtaaacagagcttggggacctcagtgctgccactgagtgacaattcataaatgcagcaactctcagccacccacccaacattattctgtgcttgatcaagagctgaagcagcctccagctgctgccaccttctgccagcagtgttagttccatgagggctgttctgcccatggatcattgatgatctgttgtcccctgcatgcacagaccagaaaccccacctccccacctgctgctgttaccctagttgacctcctgcctcactgggtggcagaatggacagccctgccatctgcttccctccccagagcaccaggcatggaacactggggatttatggggtcaccaggcagagctaggagggttttgcagtggtagggaactagcagtacacttgaacacatccatgggatcacagcaaggaggccaaatgagataggatagggattcaaaggagaaaaacagaaccacagaagtacacagctctcagatgaaagccacttaatcagcctcatcccattttccaaaattcagacaaatgcagagaaacactgggcttatttagcagtatctatactctaacacacacatacatgcacctgtgtgttaatctaattagacagcttttctagttctaaaggtgaaatgcacgaagagcaagttcttaggttattttctctttaagcaagggggactcttacatccaacacatgcaacagctatttagtaaaacaaacacatgttttcattctgcttcctgcttggagctccagaatggcctcatctggtcaaggaaggtctcggttctgccagcccattcgagaaggcaaatagcaatggtatagatggcatagagcaggatgtgagtcctataccttggattgccctggacagagggcctattgtctcctctatttttggaccaaatgggtgagaaacagcttatatcaagaatggcctggcacatgcctgtaagtccagtactttgggaggattgaacccaggagtttgagaccagcctgtgcaacatagagagacccatgtctaccaaaaaaaaaaaaaagaaaaaagaaagaaagagagaaagaaagaaagaaagaaaagaaaagaaaagaaaagaaagagaagaaaagaaaagagaagaaaagaaaagaaaaggaaaaagaatggcctggcaaataacccaaagtcctctcaaagctacattactataaacgagtcgcatgcttataattcaaaaataacatttgtgcctaaattcaaactaacacattttaatggaatggcaacatttttaggcctcaactcattctgggctcaaaataataactagaacttcatagcatttgcttgtggaacccatattccttgagcagtatctccctaggcaacagctccagtatatcctgcattagaggatatttcagatgagatgcacttgtgttgcctcagactactacggagtgactccgcagctgctgaagtgttgcctaattgaggatctactttagaaacgatgtgagtgtgatgggtaattggcacgttttcctgcttctgagagtaagctgtgcgctccttgggaggtgaaacccacttccttgtctcaccatggcttgaatgacataataggatttcagtatatgcaattgttgagtgaataaatgaataaagaaacatattagctgaattattgaaacaataagatcaagtaagcccacatagatttgttcaccttcttcacatgccccctgcctgccccaaccacacctcctttcctttgccttgtttgattttccaccaggctgcttattatactatcggacatgtaagcactttacttggaaatgtgtttattttcacatgctgtgtaaagtccaaagggcatggatttttatctcattcgctcaccgctctactcccaccacctagaactggtccctagcaagagttcactgagcattttgtgggggagttcattgtaagactctttaagaatcactctatctctaaacagaaatgatggaagatgtttttgttctgtgtatcaagggtctttatatatgtaaattaatcaaaaattaaggtgtatttgagggcgcttggtcttaaaaatgtaaccattccaccttgcactgttttcttacaaaaatctttgtaatttggccccaacataccatttgagctttattacatcatcttcttcattaccacaatcatcactaccatcactgttatcattcacaattacagaaaacatttaccaactgcctgctgagtacaaggcattttgaaaataggtgtttgggggccagaaaatgaatgggatgctgaggtctctgttctcaaactgcccatctaatgcaagcgttgagacatatttacacatgaaacatacactcagtgtcaaacaacgggttgaaccagttctgtctgacagaaatataataatgagagctatatagctaatttaaatttgtctattactcatattaaaaaatgaaaaataaacaagtaaagttaattttgatactattttgcataacccaatatatgtaatatattataatttcaacatgtatccaatatttttaaagttttattaatgagattatttttcttacttagttttggaacatgtatgacacagcacatctcaattcaggctagccatattcaagtgtctaacagccatatgtggctactggccacatattggaccctcagggttagactaaaggattttcagagtacagaggaggggacacatctcagcaggcacaggagtgtggagaaggtcccatgagaaaagcctctccccttccctccttttcctgctctttccttccccatcttcctcctcctcccgtcctcatccttatggaagcacaagcggtatagttgcaggggtaaataggtgtcccaagatgaaaacaaagggaaaccttgggcttacccactgagagtccctgttccacactgcctcttcttctctttctcctaggcacagccaaggaaggttaaatcccattccatcactaatgagagatctgcccacaagcactaaaataagattcctctgatcttaaaagaaaagtgtttttggactttaggcaaccctggggacttagagttgttctcaaccctagcatccatcagactcacctagagaaaattttaaaagtaaagatgccacaagtatacactcccagattctgatttaattggtctagagtgaggcctagggatgtttgcaccttttttaaaggctcctaggtgattctaatgtgtaactagacctgagaactgctgggctggggtgcagaaattgcagagtggaggagaggaaagagtggccagttggctatgatgccattaaccacagcactcagcatcactttatgtaccctttctcgttggatccatatgataaccctgtgtgacaggtaccactaacctcattttgcaagtgagaaaaccaaggctctaggaggttaagcaacttttccagggtcacacagttagcaactgggaaaggaagaaactcaagcccggtcaggtctgactccaagacccatgctcctcacttcatatcaccccttgtccctcctcttcatcaaccttgccctccatttccactccaccaatcttggttcaaggtgagaaactgggatgggaatgagaggatgaagaaaactaggtaagatgcagggacaggttgggaaaaaatagtaatgcatacagcagatgcagggggaagttgggaaaaaaatagtaatggacacagcagcaagggagaaacctccttcatagatggccagcatctcccagatatttttttaagtgctagatagattaagtgttgaaaggacacatgcaggggagggtgctgatattgactacgagacttgtttggcatcatgacaaggaagaagtgatgagaaaaggtgtcccagaaaattaaccattacctagcttccacagaggatcctgccctaaccaacagataggctagaaagaaggctacagaacagaagacaaagaataaaagagctgtacacaaagatatgttctttttctgaggtttcatacactgtgaaatttccaagtagtgaaaaattaactcaatgcttaaaaaaaaaaaagaagatgaatgcaaagaaagaaaaaaaaaagaaaaatctggcaatgttggaagagaaatcagtcttgcctgacagtatttaaattgaatgtctgtgagcatggcccacaatttttagtgaaagtagaagctattaaaaagtcgatgcacaagattaaaatttagaatgctattttaataataccaaattctactcaatttcaaatggctgtcatttttaagctccaccaatttgataacacttgactgatggcattgggagctgagtgatgggaagattgaattcggcaggtccagctcagctgacacagccagagagatgaatactcatcctcaaagaactaagcagaccaggctgatggacctcttagaatctgttttcccatctgtaaaatgggactaacaatatctgccctactgaaaggaacaagtgtgatggagggtgaatgaaccattgtcaaaagcattgtgaaggtcaagaatgcattgtgctcccgctgtgggtagagcctgtgctaggtcacaggtcacctctttctggaagcttcccacatctcccaattctaacttagagaatcaacaagtagttggactagtcagtgctgggatgagaacatgctcaggatgttccagaactcggagacaagtcatctgtcacgtcattagatccaccaccttgtaggactgggagtttgctctgtgtacctagcactgtgcctggtatacagtgagtggatcctcaataagtatttgtagttccctcattcaacaggatcttgtccctaatgttttgactttagatgggaagacaaatatttaccaagcataatataagtactgatgcagagaccatcagagcattacagaggaagaagaaacactaggccgggcatggtggctcatgcctgtaatcccagcactttgagaggcccaatgccaaggctaaggcaggcgggtcatttgaggtcgagttccagacctgcatgggcaacatagtgaaaccccttctctactaaaaaatacaaaaattagctgggtgtggtgctgcacacctgaaatcccagctactcgggaggttgaggcaggagactcgcttgagcccgagaggcggaggttgtagtgagccaagattgcaccactgcactccagcctgggtgacagagtgagactctgtgtcaaaaaaagaaaagaaacagaaaaatcatttcaactggatattgaaaaatcatttattataatcactgtggtcatgtttaatgctgttgacaaatatttcctgctcttcacatcctaggcatgcagcaggattacattaccctgcaccctctgaagttaggctaagccatgggtcctacactggccaatgaaacatcagcagaagtggcatatgtcccattttggcagaaactttaggagctgtgcagttctccatgttttcttcctgcagtatggcaaatggaaggacatgttaaaatgaagaatcttgggggaaaatggctccagaagcaggggtttcagtacaacctatacagaacatgaaggacaagcaagaaatacacctttgttgcagaatccgactgagatttgggggccatttgttattggcgcctctctttactaatacaatcatgtcaggaggagctccagcaaagtatctgtaagggaaggggtgagtgagcctgaaggctcttgagagtgaaaaggaaacaggactcaagcctctctttggtcacagactcagctaccttctttcggagatttcctccacagggatacactgaaaatgccactcaggtttcagaagcctctgagtgaggagccccagactcctgccttttatatacccatctcccgccctcatgccttctggaaatggtgctaagtatagctgggttggatccctggctcaattactacatcacaaccagagactgaggaataaacatgccagggtggggctttttctctttgcccgggatggctctgcctccatctctctcagctctcagcgaaaatcctcccctgcagccagaggcccttacagaccctaagcctctgctcctgctcttctccagcaggtgctgcctccccttctcatctctgcatctgtctgtcctgcagagctcagttcacaccccatctcctccagggaggaccactacagactccagcctattctgtgctcatcctacgagctttgaacccatctgacactcaaccatgccctgtcatcagaatagtgctagcttgttcatctgggcaggttggatctcttcaaaggagggaggaacccctaaatcttgatgatgtcatttgtgaaatgaggcccctgctctgaccactcagaactgccattgggcatcaggtgagttgtcagatctaaagcccctgtcttggtgccaaatacctaacaggtgctcaagaaatgtaagactcttctcaattccctttgtctacaagacagtttgacaaagtgggaccagctcttctcctcccacagtaagcccagatgcgtctctagagatgtgtctcatgcatgtattctcaatgggggcaaagtctcctccaggaaggcagacattgaaaagtgaaaaaacaacctttatgtataaacacagatacatacagagtacacacacagatatacagtgtatctgtggtattaaaatctcatggggagggggtaaggaagtgtttttttaatgcttagaaaagctccataggtatgcaataaaggaaaaaaaaaaggcaggctcttccatgcccatctcagctgagcctcttatcacttgtctcttatatttcctctcttgtgtctcttccaaatcaataaagtgatattttagaaaattctgccaaacccacatttctccctcctccaccgccttcccagcctctctgctcctgtgctcatctaatctgctgcctttcctgggatgtcagccttgcaattggctacagggaaagcaggcactggagagctgagagactccagtcttggttttccagacatagcagatgtgactgtgtttgtatctacccccagcaacaccatggggaagcagagctaggcactcctgcctcaccccacctccccaccacccagcttgactcagaatggtgcctcaagtcaaagacctgcctgcaactcccaagagaactaaatgtttccctccactaggggagggttactggtgggtttgggcttaggctggtttgttggaaggtggctgacactgcagtttggctcacccaaggtggagtccaaccttgcctgtcctcgaagatggaaagctgaataatcaccttccagcctcccttgcagctataggtggccacgccacatattctgcaggggaagatgtctgataaaaagcaggagggaacagcttaacctgatattgcccttcccccttttctttctaccttgaaatggacccaaagtctgaagctctccatctctcttgcagccatgagtgaaaagccaagggaatcctgacatcctacagacactatcttgacatgatgtagcagcagcactagtgccagaaacccctacatctagacttctacttgtaggaaaaactgcttttctctctgttacatgaagcccaaggaatcctaactaacacagaagtcaagagtgacaggcacagacacatgaaaaaatgctcatcatcactggccatcagagaaatgcaaatcaaaaccacaatgagataccatctcacaccagttagaatggtgatcattcaaaagtcaggaaacaacaggtgctggagaggatgtggagaaataggaacacttttacactgttggtgggactgtaaactagttcaaccattgtggaagacagtgtggcaattcttcaagcatctagaactagaaataccatttgacccagccatcccattactgtatatatacccaaaggattataaattatgctgctattaagacacatgcacatgtatgtttattgtggcactaatcacaatagcacggacttggaaccaacccaaacgtccatcaatgatagactggattaagaaaatgtgcacatatacaccatggaacactatgcagccataaaaaaaggatgagttcatgtcctttgtagggacatggatgaagctggaaaccgtcattctcagcaaactatcgcaaggacaaaaaccaaacactgcatgttctcactcataggtgggaattgaacaatgagaacacttggacacaggaaagggaacatcacacactggggcctgtcgtggggtcggggggagggggcagggatagcattaggagatatacctaatgtaaatgatgagttaatgggtgcagcacaccaacacggcacatgtatacatatgtaacaaacctgcatgttgtgcacatgtaccctagaacttaaagtataatttaaaaaatgccaaaaaaaaaaaaaagagtgacaggcataatccttacccatctgacttccctggagtctctttataaacacatctgtactacaaaacagaatgactagtgcttctcaatgtccagagtgcagggagactcagagatgctctgccatgctttaggtcccagggtcatggcctctctgcagggggttaagcacatgggctttgcactcaaattgacctggattctagtcctaactcctccacaaaagctgtgtgatcttagacacctcaccgttctgtatgtccgttgttttcactgtagaatgaagttgacaacagcacttatctcatagaattgttgcaaagattaaatgagatatatcacacactaatctcagtgcctggcacatactgtcttctcaatacgtgttagctgtcaagataattttccactttccctttctgggtctaagtccttctatgagcttgtctgtctcatttcccaattatttctcagtgttttctcatttccttatctctgtagctctttccttctcctttctctgtttctccatctctctgcatgtgtctccatttttgtctggctttttctccctcctccctcattcccattcaggtttacagtggagaaacacagcaatttgcctaattttccctctcccaggtcaagagaaagcccttcccaggctctcagtcacagttccttagacgtgggtcccccagatccccttgtgttctgaaatgcctgtgatgggaaggggaggggatggtgatgtggtctcctgccaggaaaagttgctgaaggttggggctggtgaagggggtagtgagagaggggcctgctgccctgcctcaggaatcacgtccacttcatgactggctttagcagctgagtctaaaagctttggaaggaaacgctgggtccaccactggctccattcctgcctccctttctggcctaccccaggattccttggcagaacttggaatttggtatagtcagggacaaactcttctctcagatgcttactgtcccaaatggaaagcaagacctaagtgcataatcctaacccaccatggacagacccctctggctccacagcacccaaaagacccctctggtgaggggagcaagtcaccaataataacccacaacacttgccctgcactgatgctgcttcaaaggcctttcctgtgccaacctactgacatccttgcagctgcaccaaggaacagactcctctttccccattttacaaatgtcatggcacatgggggctaagtgatatgttcaaggtcacacagttataaatagcaaagacatgttccaatctaagcaataacaacagcaataataacagcaacagcaaaataatattaagataattttaatgataaaaacacaatgtagcatttattatatgccaggcacatgcaagggctttgcatctattagctcattaaatctgacgcctaccctgtgagataactactatcattgtccccattttacaggtggaagggaaggtcaagggaaattcagtcatttgcccaaggcctcgataccataagagtgtggattcagggatgtgcatgctgcagtggccaaggcccacaatcttatgggacagctgaccacccaacccccagccagattcctacaagccccaggagtaaacactcccatgaagaatcagctcaagctcacctccaggctgagacaaagggtcaccaaggactggccaccacacgaatgcttctccttggtcttacaaaacatgaaaggtgctattatcagaagccatgcctgcttgcaaactacagaggtgacacgaggtaaattcatttccttcctgtcaagagaaactcaacaagggtataatcagaagctaatgtgtgtactgtgattgggcccatcacggggtggcacataattgaacaagttctccatgcctggaggagcagagccgagccccatcactgggaagtgtcactcatctggccagcacacattggtttttaataacattatggaaataatgctgcagggctgtggaaaggacagaagcttgaggggcagggcctcatcaggtctccgagagctttgaccttgagaaagaaccttctggccccatccagaatagccactttcctcagggatctctcctgtaggctttgtggatttatgtctcctgggcttaaggaacagggcttggtgtggctgaaccttcttgctgaatggatcccaggggaccccaggtgagcattgaggccgggttctcaagagactgaagggggtcggggggttaccagagagaggacaggccctttgcttccccagtaactgttgacaatggtaatacctccatggcccctactatgaatcagataattttctgaggactttatgtatattaactcatttaaactgaaaaacaatccatgtgataggtattgccattgtcctgattgtatagataaagaaattgaggcacagagaggtgaatttatctaagatcacacaggtgggaagttgtgtttgagcccgggcagtccatcatcctaaccatactccctactgcctcaatgagctgacacagcccagccctgataaagggggtggcagaggggagggggatgaggtgccttcctggctgttggcattcatttcattcacatttttatcaggcacccctttcaaccagatactgctgtaggcactgaggatacagtggagtataaatagataagagttatattctagcgaggagacacaaatcccatataaatgtacaaataagacaatttcagagaatgccaaatacaatcaagaaaataaaaccaagaggtcatagtgtccgtggcaggaaaaggtaagtaagttattttagagaggaggaaaaggtaactttaagaaccagagacaactgtttaggagaaggcctagccaagactgaataattcatgtgttaagaggttttcaatcacctaccaaatacaggaaggaaccagtcattgaggctattgagaagtcaagaagttagagacctatgaagacaaaggcagcctgggctctgctccacctgcccactcatgggcctaggcatcagaagctccgccatcttgcactgcaaccctggaagccacagtctcttcagtgccatcagggaagacagcaactgcaccaccacacacaggcatcccctgccccagcccagaagtgatgcacatcccttagtgcctcatgtcctgcctaacagtggatgctggaaatttacaggagcaactggaatattcataagcctaactgcctcggccaccagcccacaagggacactaatggagacagcagagttgcgtgagggctcacgagctaagaggtggaacccagccaggctgagtagaaagtaagccatcgacaagcagggagttaataggtttttccaaatgaacggtccttaatttcaattcattgagaggtgagggatcaggtgaaggaagcaaggtgaaaaggaggattaatccatccatcaaggaccttgggtactgaaaacatgaaaagatgaatgcatttgtgagacatactgattcactaccatgagaaataattatcttgaagcttatttggtcccagaatcaatctttatttaaccgtacttatttttggtggctcatcctgcttgcctctcttggaaactcaagaaatgctttctctatttttttttttgggtaaattccaaagacttgcatatttcatatttttcaacaggatgatctttgtgtagactgactgtcttccctcttcactagtcctctctatcattggacctcacccgtagtaatcactcactccacaatcatcttctcttgtttcctgcatcactcatcactaccttaaagtattatttattgatttattatttttttataatctgactcttctattgtaatataaggtgggtaaagacggagacctttcctgtctccgttggccacatccccaacaccacaccaatcaagcaacagactaaggacacagctaaataaatgaacaaaaagataataataacaatcatgtgttagtcttcataacaatcttcatttattctttttgattattcccatgttacaaatgaagaaatggaggcacagagaataattaagtaacttgctcaaggttatacagatattgtaaaacagccaggatttgaaaccagagagtttggctagaggttccatgctttgttggtataaatatttaagaaatatttgttgattgaatgaataataaataaatgaatggcttccttgtgtttcctgccttctttaccagggttatttgccttcaactttcactggaccctctatgtatcaggcatggtcttaaattctcttcacacattattcagttgagggtagtcccatctaccatatctccatagaatcggtcccaagcctggtacttagaactgccctgcattgtcaggctccccctttgccaggtggtgcctccctaatctgaaatcatggactgagtaccttcaaaagaaaaattaaaccaaagatcaggaggagatgcttctgacttagtgagtctagaagaccctggcctcccttgcccactctgcccagaaactgaatcccagagagatgaagttatgggtttcatacctgtgtctgcccatcaacccaagggggacaaatgccaacatagaatgacagagagggaaggaagaaagtgtttttcctaattaattggctctaaaagtggagaggaaccaagttgggttattatagaagcatcagcgtccgacacaggtcttcaactgccatgcaaataccccctactctgcaccatgcagttcccatggtttactctgttgtgatgtaactgtgcatgtttctacctgaacccattgaacacggctttgtgcttgaaccttgaacaatgcctgggacacagttggtgctcaataaataatgatgggataaatgaatgagggatccccattctcctacctaccttggccttgtcatcatctctcacttttgcgactgccagataacacctagctctatccccttgagccatccaagtctcagacacattcatatactgactgaccttgaatacatactcccttcctgaaagagatgcttcccaggaccctgcatcatggaaaataggaatatcatggtaaacgttgctttaattgaacagtggaatctatgctagtcttcatgacgaaccttgaaacacaagagtgctgcagtaaccatcattcctgaattgtggaacttcacagactcaggttagccccaagtgatgctttgctgagcaatttaaaacccagtcatgcaaagccaagtgctttcatgtttgagaaacaaaaacatttcaactgctcagcacatctaaatcagtactcccttaacaacccaccttggttcttccccttgattctgaaagccaatttagtaagaaaagcatattaataatcttgccctctcactggccttccctccctccctcctattccagcatcttgcagctggtaccttgggtcatttgttttgtttttgtcccttaggctgaagtgcgtccacagttttgaaactgctaactagagtttatatggaaaattcagattagaaacaaattcaaatgcactctctcattttcctgtaatacactgggtttcttcccccaatcagctagaagacttgctgggtacctcctcattgtgtcctgttggaaagtgtctcttctggtcaccttgactgttaaataagtaaacagactcattggggttgctgtgtcctgtgacattggcacagactctcaccccagccaagcatgcacatatcaatgggccaccatctgtggcagaattaccagacccaagatggaatttgatgcatctgtcctggtgaaatggcattatacttctgccatattcttctggttcaagaacattgtcctcaagcccaagggacagccctgtccagcataaacatgattaaaatgcccattgcccgactgccctgctgaccaagaaacatggccaagcacagagtctgcaagcagcctgcatgtgggtctaaagaagaggaagggggaaagtgtttccagaaagtaaggttgccaagatttgaatctcaatgtcacaatctggctttatgaccttgggtgagtcccttaatcccacagagcctcagtttccccatctgtaaaatgaagagtaccaatatcctgatgtgttgtgaggattacatgagatcattttcgtaaagcaccctagcacagagcctgatacagtgtcattgggagctaagatttaccagcactcatcatataccaggccttgtgcatgaaccccacctacattatgtcattaagcatcactgcatgcataagaaatgggtgttaccatccctatgttacaacagagaagactgatggtcagaaaagttaagtaacctgcacaaaggcaaggaggtagagacgagtgaacttaggattggaactcaggactctcttaaccacatgaagagaatccaagtggaaggtgcctcctaccaacgctgagatgaggttcgtgtctgtgggcccctgtctgaggctggttgacaagaagctttagagagacgcttggggatggcaggcttgcagccagaggccagggtttgactcctgtatgggctgtgtgaccaggggcctctttaccgctcgggtgtgcttcacctccttcctccataagacaaggacaactgcatcttccctgtaagactattgggaataaaacaatagggctttgtgacctttgacctaaggtaggattcttatactaccccatgctctatgacatgataagaagacagtaccaacactcagcacagtgttaaaagattccagcaaataataatggatactaacataataatagctaccatatatagaatacattatatttcagaaactgtactaaaaccttaattaaagcacttaatcctcaatgcaaccctgtgaagtagatgctttttattatccccttttacagatgaggaaactgaggcatgtaatgattaggtgacttgctcaaggtcacaaaactaagtgctgaaaacttgggattcacatggttgcatcaaaactttattgaaaggattggtcaatccaagtgaacaacacatctggactgtgccccatagaaacaagcattttagtttcactagaatcaccgggataaacagaggcaagctaacccctttactacaggacatctatggtctttaacttgtaaatacgaggaaaccatcaagagggagatagagtatgcagcctttcctgagctttgaggggcaacagtgtgctctgacatacgattcgagatgtaccaagtctgagtcatttaccctaaatagaacagccttccattggctgttggaaacacaaagtaaaacccaaagaagagagaaagcaaaagtgaagaggccattgtcctcgatcctttatcttttgttctctgattcagatcaggagaggtgtgtatgcctgcagacctggacacccgcaagccacatgctgaatgaaggcccacagaagtcccaaaaaaagatggaaccagggaaaggaggtcagcctggaacagtcctgggaagctgagacccagcccagaacctgctggaatcaatagtctttaacacaactgtgacattagcttgggctgctgggatccgtcttgaaagaagaagctttgtatatttctgctcttattccccacaggatccagaaatatatttctgtaattcttttagctgataagtatgaaaaacagaattttaaatattccagtagggacctgacagaacagggccatcttcattagctgctgaatttcccaatgactcctagaaattgacacaattagacaaaattaagtgcttctgtcctgaggataggccgccactgttctttagggcatatctttgcaaaggaaggtgctggaattcctcacaaaagccacatccctctctctctcacactctttctctgagcaaatctaaaatctagtgccaaattccttggagctaattctaaaaccaggaaagctttttgtaagattataaagattgtattggactttgaagatgagtccctttgctcagcaacttactttcttaatgcaatccctgaattctccttgctatgctctgaatgtttatgcctgcccacccccaattcatacgttgaaacctcatcaccaatgtaattatattaagagatgaagcctttgggaggtgataacgtcatggagacagagctctcatgaatgagattcatgcccttataaaagagcctccagagagctgccttgccccttccaccatgtgaggacacagcaagaaagtgccatctatgaaccagacagcgggccctcaccagacaccaaatctgctggtgtcttgaccttgaactttccagcctccagaactgtgagaaataaatgtgcttatcagccccccaagtttatggtatcttgttacagcaggccaaacagactaagacattcctccatcctcccatcgactgggcaaaaggataatattacttccatttctatggtgattatggaaactcagacccagcaagtggctcccaacccactgggtgagtaagcagggaaactgaggttaggaaatgaactcagttccttttctccccatcatcttttctcccctataagaaacttatcagcagttcttttgcatgtagagtcaatcagaaaatcattagccaaggtcagacaagaaaccacagctttggtttctttgatttcaaggttagaataagagcaatggaactttaaagagcatggatggtagtaactgtctctgagaagccagccactcaaactttccaggcccagaatcaacatttatttggaaaaactttttgttgtccatttttttaaagagctctaaacttccagtgagtcttatgtagatctatttatatgcccatttcttcttttattttttgagacagagtctcgctctgtcacccagcctggagtatagtggtacgatctcggcttggctcaccgcaacctctgcctcccaggctcaagcgattctcctgcttcagcctcccgagtagctgggactacaggcgcctgccaccacacccggctaatttttgtatttttaatagagatggggtttcaccatgttggccaggccagtcacaaactcctcacctcaggtgatccaccagccacggcctcccaaagtgctgggattataagcatgatccactgtgcccagcctacatgcccatttcataggcaagaatactgatgcatagggcacaccacactttacaggcacaagaatgaacaagtctttagagggtaactatttcttgtgcaagaatcaaatgcaactgctgacacttacagttttatcactggtgacagcatgagtggctgagtgagcaggatgaatcttgagcctggggtgtagaccagagcaggggcttccaggtgctcacacctctggaaagcaagaggaactggaacagttggagttcagaataggctaaaaaatctcctgccagtcttcacagcagaatctctgagtggagcacacagccattttgaagttggcctacttggatgccagggctcaaaaattctaatgtggccaaagaaaccttcagagaactacagcaaattcaactgataaatttgttctactctagaaaagacactgccaaaattccagtccctatctatcagggaccttggataagtcccttcccctgcatgcatatcatcacagaccatcctcatatgggggtggggagggtgtctctctcccctcttcagctgccttcctacctccaggggtgcaccaattcactgtgatgacctcacaatcatgcctggtgattatgaggacttagtgggatgatgctctgggcaaccacagggattgctcaccggtgactcagtggttgactcaaaggctagagggtggtttgggggtggaggcagaggtccagtgagctgggctccaccctttctctccctgcagtcccaactccatttttatctgtgctatatgttggagtctagccaagatgtcatttgaacaaagattctgaaagatcaaagaaaaaagtttgaaaaccaccaggacaatgctttcaggggactttatccaaaagactgcaacaatgtaaagagatacgattgcttttattactgtgatatgtttaaagtattataaattttttaagagctttgtaagtgacagaagtgaagacatgctcattttaatgttaccagtcaactctgagaagactaaaggtcaagggacaatgaaaatgtgacccttaccaacgacagaaactcccaggaagccacaattaactcaagaccaccaggatatttggggaagtttatccttctggaaaccagaatttctgatttgtggaaaattctatagatattctctgccagactccagcctatttggtaagctggccacagatgatttagaacacaatgaccctgatactcactagagctctgagtgtggctggataagcccatttcagcagcatgtcagcccctccctgaactaggctctgtcactcagatctcagatcttagggcagctgtagtctgccccttgctttcttattaccccagataaccaatgttatcctctgtttttccttcctcccagggggaaaagaattcagaaccctagtctgagtatatgaattagactctgcaaattgtttatatgagtcattctcaaaactaggtctggagggtccccaagagatccacaaatttcttgcaatattcatgtaacaatgttcatctctttagatctattaccattgagtaacccattgatatttaacaacaaaacaacagcaaacaccatcctgatagctttaaaagcaaccctgttcttctaattgtttctagtgcatgctttttgaagctaaactagtagactggattgtcctcaagtagactggctcaccaaaggtgtccacaacaagaacatttcaagttcagattggacaggaatatttatgagggtttgaccagtgctagacttgccagacaatgtgcctgaatagtctccctgaacttctctcttaaacacaaacaagatcctatgctggctttctggccacacctgtgccagccacaaatgggctaaaacacgtgaaatgtgctgtccgcgtgcagggttcaaatcagataacaaaatacacattgacggttctctatagaatgaaaaatatcctactttcattgcatgctggtgttgggtcagaaaacaacagtttcttatttctcctggttagtggtcctttggaaatcacagaggaaatacatgcagagagttaagaggactacttcacatctgttgtcccgtgatgctacttaactgaacactacactcatgtgcccattcccgttccctttcccctttatggtaaatgttgtcccatatgactttgtgattgatggaaatgttctctatctgtgctgcccaatatggtagccactaaccacacatggctattgagtactcaaaaggtggctaatgcaaagagaaactgaacctgtaatttcatttaaacttaaacaaccactcgtgtctagtggctaccatataaaacagtgaactaagtctaaaatttaggatcttgcagtacagggtgtgtgtgtgtgtgtgtgtgtgtgtgtttgtgtgtgtgtgttaacaaaacaaacactgctccttctgtagtgagcactggcctatggccagggtctaaggaatatgcaaaagaaagtgactggaagttttaagcttttaaggttttatcaaaagacatttcttaccactccctctgggcagtactgtagaacatctactagggagaggatgatatgaagatagagaagcaacaaaagtacagacacattagaggcaaaatatagatgccaccttgtaaactggttgataattcagaaaatgacagctctccccgacttagttggaaaggcaaaggccaaatgggaaacatcagtctcttcacgtccatggaagacaatcccctgaatgcaaaattagaacttggtggctatttcctgatccagccccttgtatttttcatgaagcttaaaggagattaatgggacaatcaggatattacagatgagaagcacaggcatttcaaatgaggctgtgacaaatggctgggaggcctttagaatgggggaagagaggatgtggaacaagccctggactgggaagctcctcactatgattcacaccctggtcctgctaatgaccacctggccaggagaccctggagaggcatccaacccttccctgagagccactggacagaggaataggagccccatcactgagtggttgtagggctcaagaaggatcatattggcagcaagaactccagaaactataaagctctatttagatgaatcacattattattaaacagttcaatcaacataataattattaataatagctaagatttattcagtgtctgctattgccagacaatatatatgcaaagtctctagggcttacagcaaccctataagatatgtctatctatccacatcattcgtgcttactagatgctgttacaagtgttttccatatatatgaaggtatatataatatatacatatataatgcataaaatttgtaaatgagttaaatgaggattaatccttacaacaacctataatgtggacattacttgtatcaatattttacagatgaaacaattgaggccaaagagataaagtgacagccaccatcatcccaactaagttggaaggccaaatgacaaaaggaaacataagaacgcaattacctgaatgacagattagaactcagggattatttcttgatccaggcttagtcaatggaagagctgggacatgaacgcaggcacagttggtgaacagtagagccaggattcagactcaggcagcctggctacagggcctgttttcttcaaccccatggcatcctgcctctttttttgggggggggggtggtgggggtggaggggtggggatggagtcttgttctgtcacccaggctggagttcagtgagtggtgcaatctcggctaactgcaacctccgcctcctgggttcaagcgattctcctgcctcagcctcccaagtagctgggactacagatgcgtgccaccacacccagctaatttttgtatttttagtagagacagggtttcaccatgttggccatgatggcacgatggtctcgatctcttgacctcgtgatctgcctgcctcagcatcccaaagtgctgaaagtgacagggtaaggatttgaaactcaggcctgcctgcctgtctccaaccactcagtcttttcttcagccaccctgcgtccgttacaattcacacactgtttgtcaccactggctaatggctttggatatttcttcctcttatcagtgtgagacatctggggaggctcccctttttttcaccatttgaggactgaaagtaaatttagcttcctcagcagaaagaaaagaagctgttttggaggttgggaagagctttagaaaatgcggcatcacgtctgttgccccatttgaagaaagcagctctggaaaaggcctaggacattagttgctacaaagttctagatcattctgtgtggtaagtatgccatcatgcccatagcactcttctctgtccacaaaattcgtcatatactaataaagaatgggtgtctttggacaaagtcaaagcaagtttgtccagagtactaactaagaagagactacagagggaagcaaaaggtagttcagtggctgaattatccaaggaaaggcctagaatttgagttgtcatagactgagcatcaaagattatgtcttggagctatatagaacctttactgcccaaaaaagagagactatggaaacttcagtgctctggtaaacatttctttgatgccttaccaaaacatatgccttctgagcatttgatatggtttggctctgtgtccccacccaaatctcatcttgaattgtattcccataattcccacgtattgtgggagggattccgtgggagataatctgaatcacggggtggtttcccccatactgttctcgtggtagcgaataaatctcatgagatctgatggttttatcaggggtttccacttttgcatcctcctcatttttatcttgctgctgtcaggtaaagaagtgcctttcacctcccactgtgattctgaggcctccccagccatgtggaactgtaagtccaatttaacctctttttcttcacagtctcaggtatgtctttatcagcagtgtgaaaacggactaatatagcatccgttgtccacttcctccttccatcagtctgcaaaattccatttggggatccatgtggcttcagggaaatcaactttatcaatgttctctgttccgtggcagcagtgatgggttcagggatgggcatgtgacctaagccagtccaatcagagtgactctcaggtcttgctgaaagtgcctggaaacgatgccatttccttcctgttgggcatgatgaaggaagcatctagccccaggagctccttcagtcatattagggcctaaaaggtgccagcctttgataaagacaccaaaggatatgaaagatagcataagacagaacggagagatggaaagaagccagatccttggtgatattgttgagccaacagatcaagtttggccttaagtcagccctaattctgtgcttttcaattagataagacaatacatgccctttattatttaagcctatttgtgttaggagttctagtctttgcaaatgaaagcacctaactaatactaatgtagatctctgtggccatccttctggtaaaaggagaaggcagagtcaagggtgacattacatttcctgaaactggcagctccatctcatagaaaactcacgcattactcagtgaaaaaacgaccccctgtacacaatatccacgtgggaaactcctactcactcatcaagacccatctctaatgtcccttctgtctcctagactacatttacgtaaaattaatcacttccttctgttttacttccatagaggcatattactcattcttttatgtaactataaacacagagcaattacatacagctcaagggcagagaatgtcttattcatccctaaatgcatcaaacccagcacaagcacatagatgctggattctccaggttgcatggcctttaacaagttctctaccattctgaccctgttttctctcctgtaaaatagggctaattgtatatgtcagaggattgttgtgaaaaatatcaataacggaagctacaggaatttcactaaaatgtgtttaattatagtaaaattaaattgatacataattttgtaaatcttcaatagtctttagctcaatattgatagccaaaaattaagcctggaggatagaaataacttcttaactctacagttggaaaagtgtgggcatagaacttgtctttgccttctagatcaggtctgtgttggtaaattagacaccgtgtggcctttcaacatccaggagcaagatggcaggagaatcatgccaacaactgaggtaccttgcaggaaatcaaacaggaagaaatcacccaatgggatcagctgggcaaacatgggtcaccccaggtctggtccctcaagtctacccaaccaaaccatatcatagtggatagctattatctttacctgactagcattcattgccccttctggtatgccctattccccactctcaatccctctgttttaagaatgcgcccacctccaccttccatctccaggagtgatatccacccaggtttgctcagtaagactatgagacctatcttcctggctgtggtgattggttcagaagcaacatgccaaccaacctgatccaatgagagtgagttctaggacttttgctggaactactgtatgtctatatataaaagagaatctatctttctattgaaagccaaaggtaagaagccaatatgatatgcatttgattctgttacggaaatccacataaaagaaggctgcccaagtataaaaccaacacagaagaaagcagaggtaagagatggaaaaagaaatgagtgaaccagtgacagcaagagactgaagaacatcatttgattgcctggaatcagctaagcctgaagagaagcctaaccctaagcttttcagttacccaagccatcaaattcccatccccatttttttggttcttaagcagcttgaaccatagttgtctcacttgcatgcaagagatccctgaagatacatgcagttcctcaggtgaagattgccatcagttaacagatcctggcacccatggaccctgggacagtcattctggtagcatcctctggtagagaataacatagtcaaatctgacagtcagagagtatctgccagcctctgcttagatatagcccactgaaagggagagatgattaatttagccttgatttcaaaaccttgtcttgtatattccattcagcactttttatcttcctgtattcccctggttcctctctagctgaataaagaacaatttttaaagcaaacatcttcactgtgtatctagcaaagctttctgcttcattggaatatgtgatttatttaaaaaattaaatttcccatgagacgcaataatttaaattaagagaaaagcttgtctttcttaaacttcagtttctacatacaaattgatgttttatagattccagaaactttcactgttatgaagatggctctcagttttcctgctggattcagattctcttcatgacttaaaacaacatgaggaggatgagtcacaactgtaagctggtgaaatgcagaaagaaccacctaggaattcaaatgtcagcttaagaaagacagaatggcttaaaaatcaaagatgagatgaagtggactgggggtctcgggaacaccaagtcacaaaatcagcttacagtcagagggaacttgcaaatgatctgattcaagatacaaagaaaggttttagttcttgaggactttttccagataaatatttgagccaaagcacaatataagaaaaagatgcaagtggaacagctccttcaagcagtgggggatgttaaggaaaagcagggaaaatcagctgagaatcctccgtcccacccccaagactcctgcaacctagctgagagccacagaactggtcctctctctccggctgttctccaacatcccagagccttaggtggggctacactaagaggaagtcctccaaggaaactctcaggattagaccagtctttttctgctagtggtctttgataagcctacatggtaaagagtgggattcactgacttatctgtagtagatattattaaatatgtctcaaagcatctcccccaccttctcacacccacccattagaacaggatgttatctacaggctgatacctccccactccctccacctcccttctaatacatggcaccaagacactgcctaggacctaacaagtgattggcccctccttctccaagacattcccctcttcctttttctcttttaagcccagagggcctgaccctctaacgcctgtcccagaccactctctccctccaggagcctgccaagttgaacacaaagtcctaccacccctgccctcaacacagacttctccaaaacaagtccacaaacaccattcaggatgattcctgctaagacccacagggtgggagtgataaaatttccagtaacatctaccatgatattacttacaatcctaaaagaggaaatgttctgtattacataaaacatgtccaaggtcctcctacaagtacgagtgaatccgtgcctggttcttctttgtcttcggatcctgccacctcatccctgtcgtcatctgtctaagttttgctttagaagccaccctcggtcaaaccttcactctcttacacaatgagctgggcatcctcagtttccccttcatgctaaaagtaagccccatgttttgtgcatgtgcccacaccatttcctcaagttcttgctcctaaaggtaacagggcctgggtaaggcacttcctgcagagatcaaaggagactcgttcacacccaggaggaggaatattcttcctgttctaccccatttaaccctgtcccctcaacccagaggtgtcctcactgtccagcaagtgcttcaggcctgcagttctgctgttaccctattttgaatctcataggtgtggaagcatgtgttggcggggaggggcaggaaggtttgtccgccaggaagaagaaacgagtgtgtcggtatgtgtgtgtgagcgccgcaatgacagtgctgccaccgctgctgctgcatgtgctgggtctttgaatgtggcatctgtcgggctcagtgaggatgacagatgtctctctgctttatgaacaaacaacacaggcctgtggggtgacaaaaacagcctcagcccaaccagagcggagaggtgcagttctctgggaataatcagaagacagcagcgtaggagtccagagtctaccacacacctgctcccctaaaaaagcatgttctcattatgaaaccttagaaggcagctcccacgccagggacaagtataagggagcctgtgtggcctcattcattaccagatgaaccactcattcagggaagtcttgaggcatgtccaggaaatggcgccccaaagacccagttaacccacagggtgagtgcccacggagatgggagctctgggggtgacactgttgagccagtggatcaagcttcaccctgagtcaaccctaattctgtgtttttcaaataaataagccaatcaattttcctgttcatttctgtatccccagcacctagaacagtgcctggcacacagtaggtgcccagtggacattcgctgaaagaacaaacgaatgccaaggcagaaaatgggggtgagaggcaaagatgtataaaaaaagaactaagcagagcaaagcgataagaagaatattaataatatgaaccacaaagacaggaaagtcatctgatttcaatacacaagagtataaactcattatggatgctgaattacactagtgatagtttaaatatttcttggaactgaatatgcacataagaagagcccatcccaggcttgaatgagtgcacattcttgtcttggagaaaaggaagaaaaatatataaagcaataggtacaatacaatgcaacagatgttctagaacaaaggcctggagctatgattccagggcagcctgcaaagatctcccagtggagctgatgattagcaggccttgaagcaaggatggaagcctggcaagaggcaggtcagtcatcacaggcagggatgacagcttccaagaactatgtcgtctgtgagcccaggggccagagagctgctgggtttcccagtctttccaggctatggccaaactgatgaagccatccttgtttcagtctctgattccttcagagaagaagaaagagttgagtctagcagagtctcactctgcctggacgcctgctgtaccaggagagcactccctccacatgccactctaaacagaaatactccccggagcacctgggacgaccggcatcctctgcacttccaaggccttcactcttcccagttttgcttacttcttctcatcttcccattcacttcccagatgtgtttctcgggtctccaaagggaaactcaggggagaaactgagtcaagctactttaaatctcctttcctacctggccctttccacagcactcagcccagaagaggtgctctgggtgaaacaaagcagcagtcggaatctctgcaggccacagggagggagggacgggtagaatcaaggagtggggcactagcacggaggcctgagcctcctcactgccaggatgagggagccgcaatgatctggggtactggcagctctgggagcctctgaatagtgaccctggggctctcagaagtactaggtcaaggtgtcccggtgggcacagctgggcttagtcatcaagacatgggtacaaacctcagctcagtcaccatccagctgtttgagtctgaaagttacttaatctctctaagcacagatgttctcatctatgaaaggactataatgcttgtcttgcggggatgttgttagaattacatgtgatgaggtctaaattgctcctagtacagaataggcaattggtaactcttaactactattagtgtagtattatcatgatcgtcatcgtcatcatcatcatcattggggcagacaaatctcagaccaggcctgagaattcccaactctgaattcagagccttttgctccagcaacagaaatgagaaggtaaggcctaaagtagaacaagactagaggaggccctgaacagtgctgggcgcccaaacagggacttcctcccaggaggcctctgtgccactggcctggggtctcatcatcaccgccagcaacagggtgactggctgccccctggattttctgcaagcaaagaacaggagggcagagcagaaaagcccgggaactaatgagattcagagagctcgaaaattagaggtgcacgaaaggagtttccgcctaattgctctgacacctcccactcccactgccgagtcactgcaaggagcaggcgagtgcaggagcaagaggggatccataggtctgctggtccaggtcactgctctctccaggagcactggctccagttgggagtggcccagggcctttctgcggcctggcaggacagggtggccactgcccgtggctggcccagaagagtccaccttgtgggtcaagagctgcccaggctgatatgtgccttaaaaagcgggaacgaaagcaaggcagcacacagcaagcccaggcacctcctcagccttgcaaatgggagctggtgatatgggctcaggaactgccatttctgacccagcccagacaaatgtggcccaattctctgttcccttggagctgagcccatttgtagccatgccaggcccagggtctccctcagtggctgctggcagttgatagcagctgtccttagagcctcagctgcctctcctgcgctgtgtcctccctaaggggcttccagatcggttgtctcacgcgaggctcccagcaggctggaggagggcaggctggcaaggcagccacactgcccctgcatcacagaggagaggagggtggcccactgacaggccagaggcaaactgagacccttccgatccattgtcccttccctgcacccccaagaacaatgacttagccccaggacacatccttaagaagagggcatccctaaataccaccagcccccaccccctatccccccccaccccccccaccccacacacacacacacacgatgctgggataggctgtgagacaatatggaaacagccagaaagatttgcattcaaatccaggttgtgtcacttcctgcccatatgtctttgggtgctttatgtaacccctctgagcctcaactgctccatccataaagcggagcatgactgggagggataaatggaatggcaagaggaaaacacagtgcccagaggacagcaggctttcaataaatgtgaaatgctctcagcatggccctgcctgacgtcctgcctcagaccccgccgtccagctcacaggacaagccacagccttgtaggacactagaattgctgccagtctgccttcagttccctttgttgtttaggagtctcccctggactatcagcttataagaagacatgtatccatcacaagggcctctgataaatctcttcacggaccgcttgcttatatcaagaggcagaacatttagaaaagacatagtgcctgctgctgtctgggccaagccatcccacaagcaggctgaagtgtgagagaggcagatacattccctttcaaaatgtctatggtcccctggtccatgatataataggagagatgcacagctggcttagcttgcgccgtctcccaatgcggacaggcacctgggagagccaagatcgttagccctccaggcaaaccattcaagtcctcgtgctgtcaaggtgacttacaatattgagagtagtttgagattgttaagaattattattattttttttttctgaaaaatacacagtgagtttctcaactccagtttactccagctaacaccacagctttactgttcctcttccaatcaatagtggaatgaaatgatccagttggaattccagttcaggccacagagctgacatcttctggattcccactcctggggattctcagacccaaaggcaaaatgggccctggtcatgggaaagtccatggctttagatgggcagaatctgcagccactgaggctgcagcacacagcagggaccaaagccaggaacagccaaggacactcaatgccactcctgccttatgccagccctcagggtgagtgcataagctcttcccataaaaatggcatttgcacccttagtaaccttttattcaattcaacttcatctagtcctagtaaatagaattacattacttccttgcttaaaacacttccatggtgcctatgcaaaaatgtaaaatactttctctggcacacaaagcccacatgctcttgccctcctctccagcctccttcatgccagtcactggcttggccatccaattcagactccctggcttcacttctccttccttgactgtgcgtagctctttcttgctttgtagtgagacatacactcctccccgtctttgtccagttaattcctgctcccttttctggtctcagctcaaatgttgcctcctcaagaaaaactcccctgactgcttcccagtacaatttattcccactcctgcccccttctctcctatagttccctgttctttttaaaatggacttgtcaatatgcatgacgatatgtttttgtgtttattgtcctcgctctctgaccatgtaaactctatgaagccagagagaatatcttattctctcgaccagtttgcacaatgcctgacacctagcagatcctcaacaacctttgttgaataaatgtgtccatttattcagttctccaatgtctgacttcattcaatcacttataattaaaatgccaatttttataatctccatgaaccataaattaagaaatcactgtgcggccgggcgcagtggctcacacctgtaatcccagcactttgggaggtcaaggtgggcggactacctgagatcaggagttcaagaccagcctggccaacatagcaaaaccctgtctctactaaaaatacaaaaattagccaggtatggtggtgtgtgcctgtagtctcagctacttgggaggctgaggcaggacaatctcttgaaccccagaggcagaggctgcagtgagccaagatcgtgccactgcactccagcttgggtaacagagcaaagctccatctcaaaaaaaagaaagaaaaaagaaaagaaaaaaagagaaagaaaacactgtcttccaagctgtgactggaggcttacattaactcatttatatttgtagttagtaacatcaccatttttaaatgagtgaaccctgaccccaagaagctaagtaaccttataagtcatagaatcagtaagtggcaaaaccataattgaaacctctggctcataacttctcacttttcctaccaaatgacacaagtggctacaacctgagtggccaggcctgaatgggtagccagtctagaactgccttggtccccagccccacagcacctgggacaagacccagagtggcatcctcctcctccacagcagaggagactacttaggcaatgagatgaaattggcacgtttacctgcctctgattaaacagagtttttactggacagcagttgttgaaataatttgggctataaataaataggaaccgggctagaatctgaacctgcttacaaagctagtccttttccatttgagtcataacaaatccaatccactcggggaaaaattaggaaacaagggggaaaagctttcagtttctgtagcattttaatgaaggattgattgaggttttatgcagcaagaagggcacagctggggagtaattgccaagaaaattgaggtgcaagagccatttacatagaagaatcaactaaggttcctcaccagtgctcaactgaaagcagtagcaattggaccaaatgacaagcatcacaatctcactctctagcaccccaccctaggaaacaaagccaccttgtcactgtctccttcaaaagtaccacaacccaacccaagacaggcaatggcaattcatgtgcatcctccactcccaagccttcagcaacctagatactttgtctggggaccttctgaagaggaggctttagttgacttcttcaagatcacttactaccatagacgatggctaaagcaggactgaattccagatgttatgatcctagagagtctctcaatcaatggtagaactctcatgcacaatcttctttggttgggggcagaggaggggtaacttggagcaggtgatagtgtggctcccgacaggctagccactttacaaggattcaccttctgtcccttcactatgtatcagaagctacactttatggccacgttttgtttcctcttttcttcctcttcctctttactgtacctccatccatccttttatagtgccgctttcaccttggtgtgtgaacttgccgctgacttcccaaatgagttctgagaaccgatttcctgtgctttgtgctctgtgatggttcagcccactcatcacacctctcatggagatctctggcactttggtgggccctacttagaaaccatcttcctccttgatccttcactaacaagttctataatcttaacctcccagggtctcagttatactacctgcaagatgggcagaagaattccagcctagatccccacacaaatgtaggaaatccaaagacaataatatataagggcttggagaaaagaataaaactcagactgcagtgaggtgaataattcagtgcatcctccttatgcagctggagttaattccaaggaagcactttgcaaattctcaggtactatgcatgttctttctttctttctttttcttttcttctctctctctctctttctctttctttctttcttccttcctttctttctatttttgagatcacgtttctgtcttgtcacccatgctggagtgcaatggcacgatctcagctcactgccacctccgcctcccaggttcaagtaattctcctgtctcagcccctggagtagttgagattacaggtgcctgccaccatgcccagctaatttttgtatctttattagagacagggtttcaccttgttgaccaggctggtctcaaactcctgaccttaggtgatccgcccacctcagcctcccaaagtgctgggattacaggcatgagccaccacgcccggccacatgtgctttttaacatttttattatttcatttttggagtcattattatttttgttacaccacacaaattgcaataacattaagagattgagatgatgatggtatgagggtggtgttggtgatgacagtgatgatgacagcaatgttgctgatgttccatagtggtaatggtgaagatgatggtgatactggggagatatgatggtggtggtgatggaagtgatgcttacattacaagtccactctacacacacatgttctttacaaatgtggatgaaccctatctcctgcatggagtgggcagcacagattgtggaggaagctgttttccttccctggcatcttctgttcttggaaatcaatgaatgtccttcattattttccccatagttcctaagaggatactttcctgcttctgaaacattcactatttctataaagtcagtttgtcttcattctgtaagctcctcagcaaccctcactatttgccatgatgctggtcaccgggcctacaagacatagatcttgtctttgaaaagcctgtgttcctagggagagaaacatctgaaaagtgaaagaacatgagagcaaaatagcatgcatactgcattagaaggtgcaccctcattccgcacgggtgtgtcagggactggcagggtcggggatggcttccctgggaaggtgcctttcaagctggccagtgactaaggggtcactcatcctccagggaatgggtggatagagagcactctaggccacaaacaaagcagagaatatacactgctgtagggtatgatctgagggatatgggagatttcaggggaaagagcttactttaagttttttgaagtgataaaatatttgaattttatcttggaagaactatggatccgttaaaggtctctcagcgtaggaatgaaatgagctgaatctgcatgttacgatgtttcctctgtagagcctaaccccctccacttgtgttcccaagagccccagcatcactcaggagcttataagaaatgcagagtcccaggccccattgctaaacctcttgaataagaatctgcacttttcaaaagtttcattttctaaattactatacagtaaatttaattttttatttttggtgtaaagttctacgaatgttagtatatgtgtcaatttgtatagccaccaccataatcaagatacagaacaactctgccccaaaaactatcttgcattatcctttatgatcacacctatcacccctacccactaataaccactaatctgtcctctgtcactacagttttacctatccaaggaagtaacataaatgaaattgatataatatgtaacctattaacgctggcttttttaattgagcaaaatgttgttgagattcatccaagttgttgcttttatcaatagttcattcttttttgctactgcatgtattcatggtaaggatgtatcacagttgttttagccattcacccactgagattcttcctagttttgggtaattatgaatagagatgctacaaacatgtatatgaatgttttttctgtaaacttaagttttcatttccctagggtaaatatctagacattgaatttctggtaatatgctaagtatatgcttaattttataagaaaacttctaaactgttttcctgaatagcaacattgttttgcattcccattagtaatgtctgagagttccagttgccccccatcctcatcactacttggtattgttggtatttttatttcagccattataataggtgtgttcacatctcatcattgcttacacttgcatttccctaatggctaaagatgctgatgttctttttctgagcttatttgccatccaaatatcctctttgatcatgtgtctattcaagtcttttgcccattttccagttgggtagcttgttctcttcctgttgaattttgagagttctttatatatcctggctataaagccttctgtaatatatgtgatttttaagtattctctcccattatgtagcttatcttttcattctcataatagtatctttcacagaataatagtttctaattttgacgtgtctaagtgatccatttttcttttgtgaatcatctttttggggtcatgtctaacttacctaagttcagatcagaaagattttctcctatgtgtttttatcaaagctttatagttttacacttatatctgtgatccactttgagtcaatttttgtataagacatgaagtttaggttgagctttttgttttgttttgtttcatttgcccttggatgtccaattgttccaagaccattgtagaaaagactccttctccattgaattgtctttgtacctctatcaaagcaattgaccatatttgttgtaggtctatttttggactctagtctactccattgatctatgtgtctatccctttgccaatatgacactgtcttgattactatagctttatagcaagtgttaaaatcaggtagggcgattggtgatttcttcaaatatacacttctttttcaaaattattttacctattctagttgctttgccttttcacataaattttagaaattggtttgtttatatctgcaaacagtcctgcttagattttggttggagttacattaaatctgtagagaaatctgggggtgagctggcaccattactaggatgagtcttccagtccatgaacatggtatgtcttgccatttctctaggtcctcagaatctgcatcttaacaagaatcccaggtaatttccctgtacattagagtctgggaagcacagctctagagtggaaatgacagtgaagtcatctgggaggatttacaaaatatggaagcctagacctcactcagaccaactgaataagaatctctgaagggggacctaggtgctggaattttttctatgtcttgtaggtgattctaactggcagccatgtgtgaacctctactctaaacccagtctgggctcttgtggctctggccctatgctcattaaatcaatctgattaaggccatcagttcattccttttcaaccctagatgtatattggaatcctttgaggatagaggttacttcaatgagaattttcaagaaaaaattctagttgacagattcaccaaacttcctctgaggccccacctatatttgaggattacctttccctgcccaaccccaggagctagaacaacattccagaagttttaactctcaactctaaaaacctgctctctttttggaagtctctctacaagttactgaggcaggaggagacagaggagagagggaacatgtgtgcacacaagagaaatgtccaattgaatgagtctgatcaataagatctatgactcaaaaatacttgcttcatggcaagggaacatcttttgctttcatatccatctcacatacctgctgagtcaaggaaacagctccatatttaggagaaaaatcctcttctaatctctaaatgcaatcgaaggttttctatgtctttttctgtggctccttggaaatgttaaaggcatgtctcagctacagcaaggtggggcatgacatattgccccccaaaatatgaaccaattgaatgtcgtctgaagtcagctctgtttctgttatcttttaatggattttaggtaaagaagtgttgatgtagataaaatagatataaaaccaaattcttctgctttggatgtgcaccaaccccagcaggctaaaaatagattcaactgcatcaataatatttctctttaaagttgcaggtcctttgggggtttggaaacattcagagaggataaaaggggagaaagatatgaaaacagcagaagctgcagtctaagcctccaggtgggggccttggggacagccatgctggaatgcctgatttttacatgtccaagtacctatttcctaccaaaaaaaaagcccttccacatatgataagaacacatcttttcttgcagggctgtcaagttcattctaaacacccctgccgctgcctgtttgagattgatgcctctccaatctctagctctttgtttgaaattaaacatccaaagacctttagaataaaaaaagtcaacatacaaatgaaatgcatttcaacatgcatctcaactgcagaaccacagcatgttgagactggaccaagcaaaccctgaagaagtttcccctcttgctcctctgtggtagatgacctatccaagttcacacaacaggtaacatggagcatgtggagagactcagcataggccagtgcagtagcggggtctactggaaaagacttggcctttgaagtctcattccaatcccagccttgcattgaccaactctgtgaccttgaccttgaaaaagtagagtcacagtgccctctacttcacagggttgtttggagaattactgaaaatgtgcacaaaatacctgatacacagtggggcactcagctaacaccagtcattcctgtaatccaggtctcccaacttctagtccagtgctctttgcacaacaacaccatatgaagactctgagctatccaaataagtgcacttgaaccacaggttaaatccccttcctctcatcagaaatacaggctagcaccgcccagcgttctttaaagacagccaggaaaacaaaccaaattcatactacttacccaacactgaacgagacacgctggctccctttcctttattttgtttcccttctatttgtcctgggtttgtggttctcgggcaaggtgaactctgctcagtatgatatgtgacccctggccacagttgcatatggccctgcctcagttgctgcctgctccttacttgattctccaggtccacactcctttcctgtgccatcttcccctgtggcacctgtgtgtaggaatcttcaacagctgcaccgccaacagagaagccacaagctggagccccacaagtttccccccaggccccatgcatgggtcagcagtcttgacccctgggctgattttaatattttaattaaattgacaacatgtaaaaaatctggagatttcacaacaatgcagatttctgacttcttttgacaaattacaaactggccaaatgtccacagctggccagagctgtgaggcagctgctcccttcatctggaaagactcttgctccactggtcaaagtccccaccggtcccctcattgcaacctcaccattccctatcaacctctgagttttccacccctgttatgatatgcacttccagttctccagctggacactcaagatgtgtcaccacatggcccactgcacttattcaatctcttctcctgggaaccctggaaaatctctctgcttctaggctctgctgggagcaattcccctcctacaatgtcctccttgctcttttatttatccaacccaatcaagagtatctctgcttaaaaaattcttgctgaccacccaagccacaaagagctctcctttccttaaagcatggagtcaacagttatcttacctaccttcacatagttggttcttcctgtttgcacatcctgtttccctagctaaattgtaaacttcttgagttcacatttgtttgccttccccagaaggcagccacagactttccaaagggaaagttctgaacaaagattaattgtttggtcaggagctatcaaccatatcatcactcagtgcaagaccagtctctccagcctcttttgcctccactccacttcccttgttcccctctcaaatccacccaaacccccatcctcctggaatcactccaaaaggactagaatttgtttcctgttttgcccacgattgttcccatcgctgccactccccagggctaaacacagaacctgccacataacaaaagctcagcatatgcacattaaatggaaagtgccttactttttagtccctatatcttaacatctgcagttcaccaggctgaccatgcccttctcccttttcaccaacagatctacgggtcttggaaatcccagttcagtgttcctctctcaatctttttctcttcctttactcagccaagtcactcctctctctaggcgccgcagtcctttgctcttgcctgccacagccattgccaaatgttggtgcaattgtttgcccacacctgtttttcccttggatgccaaggtcttccggatccaggattgtgtgatcttcttccatgcgcttgcctggttccccaagtcataactggacataattagtctggtggagaaggcaagtattatggccctcatttttccaatgagaaaatggaagcaaggcaccaggctccctgcatgcagcagagagatggaagaggaagagaggagcagcttgggtgagaagacttggttctattagcaggggtcaagcaatggaatggaaatgtgtcatgtcctttcaaggtcatctgtggagcaatgtttaacagcctgcccaagaaatatttaattacctagaggaaagtaagtacctttgttgacttgatatttgctaccaactaaatagccagattatgtgaagttacacattaatgtgtaggattttgcctagtagaaatacaaatgttttctgttcaggagaaaagataatctcaaagtttattaattgactcccgtgtaggacattaaccagttttgtttctaatttagcaatctcattccaacactcttcctccagtgcctatgtaaactcatgctgccatcttgttggtttcctcattaatgagctaaatgcatttttgacatgtccacattctagatttgtatgagtcacaattttaactttttgaaaattatactttgccacccaggtgccaccaactctgggagtgtgagcaagtccctccctcccctcttctggactcagtttcttcaacagtaacatgagggcgtaggtctgcatgggaaattacaagccccaggaatatttgattttaagcctgaatcttaaaaagaataatttcctcatagggttgaacatcttacggagttattttccaaaataacaacaataatgggacagtgcttcatacctggggctaagtattttaattctcacataatgagatggggctattgttcctagctctattacaggtgaggttaggaaagctgaaacagtattttttttaacgaggagacactatgtttgtccttccactcatgtttccttccattcttcttttcacctgtctggtcatccatgtttccagtcatccatcccactgatgcaaaaagaaggtggtttccattttcactctggatctatctaattgactatttaattgatgtggactttagtagaggcagtgattgcttccagttggtgggcccaggaagactgtgaaaaaggtaccactttcagcttgaccctgaaggttcaagcagaattatttagggataggttgaagaagcatctttgcctgaaggaaccatggcagggacaccagaagacaaaggagggagacatgcacagtgaccagtgggtggttatggctgtgggaagggtggataatgggagatgagatgaaaaagattgattggtcttggcatatgtcaatggctgattgagaatcttaagtttccttgatctgaagccctgtccacaatcacccagactctgagtacttcatgtggtagtaagaggcagagacaaacccttccccaggtgccctgatctggccaagcctgggcgctctgactaccagagtcctgaactcttagaagggagagctgcaaacaaccatggcgggaatctactccagcctcccttcccgaacatgtgggcctgagctaatttaagctagtctgagctcactttgcaagcagttgtcacaaggtgctacatcaaaagactcccaaggcccaaatatttaacaaccagaacactccctccatccatcagtttggtaattctatccacacaaaaaaactattggggtttcatttctggcctgctcatttcttataaacatgccagggccatttacagctcacaactcactgctctctaaacatttacacatttctccctcttaacacatccttggctatttgattaagtagtagatcacaggggatggaaggcaaggccttggcatctttgggttttctccaaacctatcttgacatgggttcaatgccagcctccccttccagtaaacacaaggattattgcactcctgggcacagacttgctgatgccttggtcttttctatcccttctcttgcagtttctttaggtaggagggaatacaaaccccaaaaacaaacagacatgagtccattttaccagctgggtttaatgggaaagctggtagggttccccatgacccctaggactgaatgagtgcccacatttcacaacaccctgattccagacaggaagcttggagaagtatctatatttgggggaaggaagctgccccagacacagcttcctggactgttagcaaaggaatctcacacaaggcctaaaccagtttccatacaacttccttgccttttgggaaggtgcaatctcacaggactggtgggacttacccaatgcagtcatccaaaaacagttatggccaacacctaagtgctgagaaaagtcaagaggaagaggaagccccaagggcagagaaagtggtgaaggtcacagaaaaggcatggagctgtggcaccattggcgggggacagctagagtccaggcacagagctaaaactgggtatgagcaagggtaggagaggggacactgctgaacacccacaatggtcctgctcctgttggctctgccttcaatctcaaaggcaattatgaataaaggaaagcacactgccttcagagtccgacctaagtttgaatcctggcatctttcccagctggccgtattacccctaggagctactcaacacttcagaacctcactttcttcttcagcaaaacagaggtgcaggtatatatctcctaggagtgacaagggaattcacgcggctgttaatgacctggtgcctgcctggggctaccaagcagccaccacaagagtcctccataatagcatccaccgcactgcagtcagggcaacagcactgcaagcacttcatggacagagaccaagcctttccaacttgatctgccatgtttcaacacagtgcctcagccattgagaaaatcctgtgacaggcacagacccccttcaagaaggacttgctgctcagctcgtgagagggttgtcagcagcttcttcagggcttgctcagttgcagagagctacctggccagaggtcatgcccttcaggggcagcccacctcctctgagtgatgggagtgatggaataaaggcccatgtcagcccatcccagcactcattccagcacaatgctggcaggccatcttggtgctcttggggctggctgtggctgcatccagcctgcatcacgactcaacctctgcacagtcctgctgccttcccctcctcccgtgggtatgagcctccagcacactcaacttcgtgtcagagcttaccttccaagaaccctacctgcaatgaacttggtatttgttgatgagtaaatgtctgaaacaagatccccaatcttctaaatccagagttaaaactcagacaggccacggtccttggtcattctaggtccaagaggctcttgctgctggcatggccaagagatacaggtaagtaaaacagtatactgtggtgctatgaccacccagggggctgccgtgtcccactcaggaaaatcaggtacctagttggcttccaaaagaggctggggaaattttaagttgaggttgggctctgtagaccttctccaccactaaagcccccaggtttatcatttcccgggagaataggtcctgggggagagggggagataacaatggaacacaccaaaagggaaccctgtaatggaacagtgcccactaatgtttattttatcccaggagtcacagaaggcctggaatggctgcgatggagataaaggatgaagggtagtcccctcagggtgttatccaaaaagtcaccttggaagaggaagaaactcctaccaatatcagaagagcaacaaacatttttttttctagaagataagtggctaatttcaaaataattattttatcaactgccacataagtttttttttttttaattcattaaaaaaaaaaaatgaggccgggcacagtggctcatgcctgtaatcccagcactttgggaggccaaggtgggtggatcacctgaggtcaggtattcaagaccagcttggtcaacatggtgaaaccccatctctactaaaaatacaaaaattagccaggagtcgtggcgcatgcctgtaatcccagctactcaggaggctgaggtgggagaatcacttgaacccaagaggcagaggttgtagtgagccgagatcgtgccactgcactccagcctgggtgacagagcaagattccctctcaaaataaataaatacatacatacatacatacatacatacatacatacataaaaatgaaatgcttcccttttcaaatgaggagtgggaacacttagattacagtgctaagttctttttgtctgtgaggtaaggagaagagcctgcgcctaggtgaccttggcctggtcagagatgctgggacagcctggacgtgggaaagaagggatctacgcaggtctgtccacagcacattccagggcagcttcctcccgggctgcttctgtgccagaacctgctggcctcaggagccccagctcacctttcactgaccttcagcccacaggagaacagcatttcctacctcccccacctgctgacaaggcctctctctttcccacgccaaggacaaagatgacctctgggggattccttttagctggctcataaaaggaagagagatgggccaaagagaaagagctgctgggtccttccccaactagaacatgggaaatgatgattttccagtagggaagtggtggccaggcaggcaggcgtcgactagatgggtccctctggggtgtggtggaaatgacctcaacttcaaagagacagacttccagagaaggctggcattagcatcctgatctgctctactgagaatcccaagggttttgcggaactcttgctgggccatgaggatacagtctcctcctgaccccaatcctctaaccaaagcagctaggtttcagttagtgtacacagagctccaggcctctaagagtgtgaaagccactgcctcaggagatatcccttgctggagatcctgggaagtagaggctatggaggcagaccacttaatagctgtgcaaccctcagcaagtcattcatccactctgagcccgagttccctcctgtgtaaaacagcagttatcacagtgcctagctcctagtctgggtgtgagagttcaaggtgaggccaaccagttgcttcactccgtgcctggctcatagtgagacctcagtaaatgtgagctattttctttcaatgaatatttgccctttccagcatcacaaatacatgagcttccaattctagggatacaaagacagaggggctttatttctttcaatgagttcagagaagtccctagcacttaaactgctatacactgagagagtaagccatagttctgaaaatgctctgtgtgctcattcacctgaagcagcactgggggtcactgcagcctcaggtgccaccgagccgacaggccatgaaaagaacacccactgactcactcatctgggtggaatggtttcatggggacccaggtgaggtggtgaggttgctgcttttttatgtattggctttttctgcctccccaatgccccacttccgtcgcaaaagtgtctgagttctggagcaaaggctcagctaggaaaagtttcagatattttctttgtcttaacccttcagggagaggaaggaaaatctgtctcttgccagggtgagggccaccaagcgggttagctcactctgccacattctgcattttctaccttcaacacaatggacagtgggatgtctctctcttgccatatgcattcaagagaaaagccctggtttgggtggggctctggtttgggtggggtttgcattgggtctacagccactagcaacttgctgtagtcaaggcaaatgacataagctctctgatcctcagcttcctcattgtaaagagagctcttagctccaggtctcattactttcagggtatttaggatgtttagatgccaaataagacagcagaaggcagagcaccttgacaagcataaagcactgtatgcaaacataaagcatggtgcaatctcacaggactggtgggacttacccaattataaacaaatttataatcacatggcaggaagggtggaatttcaagatagaattattattcattgtaagatgacttgtgtaatattgtaaatgactgctcttcaccccatcctctgattcaaattaaaatcctcattccatggcccctacatgtacgctcattttcactgttcagttacaagcaacaagatgagacattttgacgcccttggtaattgtctggtttctagaagttcttggttcacaggcctaagcatgtttcatttgatgtttggcaccatagaaaacagtgtatgtttaatgatttctgtgttaaactgaataatgaataaccaggaaagacaacagaccaaatagcaacttcttgatacacctgcttgacggaattctgagcctttttcccactctatcaaggacaactgcctaatggagagtcagaatatttttctaatacaaataaagtaaaaaagcaatgtaatgttattatcttttaaagacagaaatactattaaatcctcaaccatttttaaattaaagcataaaaccctcttctacccaataagcaataagaactcacttgaattccttttcacaggcatttaagggatactaatgggtacagacagaagagggaaaagtacagaaaggaaaacagcagataaatatatagaagcagaaaacaagagtaacagaagagaagcagaagagactaaggaaggcatctaggatgcagttgtgaagagaaaatcagacatatgtaggcagaaaagaaaacaatcaaacaaacaacaataataaaattagaactaaagagaaactttcttaaaggaacccataattttggaagcttatcagtagattttaaaagtagactacagatttatgactacaggagtaaagggtgtgttactcttagtaattgtttccttaatgacataaaatcacatcaagactatatccagctcatgggccagcagctccccatccctgccccataatgctgcactgtattatgtttcaatacaaaacatttggtgtccacttgggtcagcacctccatcagactgccatcactaagggaactgagccagcctcccacgtcagtttcctcccctatgggctccactgaatggggatgaatgcggtacctactctcatagtagggatatgaggattaatgaggtgatgtagaaaaatcacctggtattgtaggtggcatttagtaaatccttcataaacactagtgttcattattagttggggttacaaatagttactctcagagggggaaaaatgaatgaaagtgtgtgaacaggttaaacaaaatattttggaaattttatgttgtcgtctgaaagttctttcatgtgcatctaaaggcatcacactcactgtcaccctcttcacatggtgggtatcaatataaagaacattcttcaatttctgcttgactgctacatctcatttctgtctctaggtttccactgagccctccagctcaaggggcctccctccgcatgagtcgtctttaggaagcccagcctggtctctaattttgagaagcatttcccttatttcaggtcttcattcagccagtggttcaaccactgaaccacttcagtttccttccttcattttattcacaaaggaatcctttcatctacagcccctagctgggctcctttgaagagactttctcttcttgcattattttcttggtcagccttccttaggaaggaattaagacacatttcaggaaacgggcagaaaatgttaatccttctctccctcattgtcctactcataaacgcttactccctcaaatgcacccataaataagctgtagatccacatctggttctgagcccagcacatagtaggagctcagatgaatgatcacgcctgacttctcagccttgcttctgccatcccttcccctgaaaaatctgctcctctctacttaacctagtagaaccctcatgaaagctgttgtccctgttgaaggaatgatgccccaagcatccagcgtgtctgctgtttacttcatgcaccttagtggatgtggtgaaatgaaatgacttttccatttccaaagagaaagtgcaaagtctccaaacttatgacctctttctcagaatgccaatatttacagcttagccctgggcaaccctgtgcttttctgaccttagattcccatttggagtggaaatggcttttctatttctccccaaggttctctgaattagatgaccaaaggagaacttacttctaccaagatgggtctatgagacccattcaggctctcatccattcgttcaacagattcattcattcagcccctactgtgttccaggaaataagtgtcaaccatacaggagtgacccagacaaaaagccctgcttttatggagttagtttggattttagtggagacaggggaagatagatgataagtaaaataaataaagtatatatagtatattagagaattataaggtttataaagaaaaaatgaaagatacaattagtagggaatggggataatttaaaatagggggaaatttataaacataatggaaaatatgcatgtaagtaaaattccttccaaaaaatggaatatttaacactaacttgcggtgtaaacatgaacacatcatgggctccctccaggcctcggtttccttctcggcagtataaggtggaactacaaggtatctctatggtagcttctggcactgaaattctctttctctacccaatagatagcaatttgaattaacactagagcctgttgggacccagtgattgtggtctaagtttcaatgactttttttttaaatccctacattccttggggttcccagcaatgtctccagtgggctgctggtccaaattaattgtgagagcaaccacaaattcccttgtttatatttttgaattgttgacttagaatcagttttaaatctgagcccttcttccccacagatactctcaaaacagcctcctgataggcactaacccctaagaaggtcatcaagtggggctctgagagcaaggatgctgggcaacccggcttccaatgccacttatcctagccacatgagtactcataacaggcttgacgtcaattaaatcatactggccctgagaggcgccacccaacaaactgtttcttcttcgtggactttttgttccctctttatttattttccactgagctacaacaaggctcaggaggaggcccttcatctaggaagagtcatcttgggaccatctagggaggaaaaggcatccatcaggcactcatcagccacctctgatgaaaagcttcctttggggtaatttctctgcaccaccgagtaagccttctgcctgctggaggagctgtggtgagcatgtgaagggaggttctgaaggcttcagcagcagccaccagtccccctgcagcccctaatgagaggtgatccttgttcaactcctgctatgtgctagacacattctaagcactttacatgtattaactaacaagtctatgaaacaggtgttatcattattcccattttacagatgaagcaagtgagacacagtgaagcagcttgtccaagatgacagtttgtaattggaggagaagagcccctatcagcatcgctgtccagaagaaacataagacaaaccacacaggtcattctaaattttctagaaggcacatttctttgacacttattttatttacaactctatgcaaatttaaagacaaataatattccaagtggggccgggcatggtggctcatacctgtaatcccagcactttgggaggccaaggcgggtggatcacctgaggtcaggagtttgagaacagcttggccaacatggtaaaaccctgtctctactaaaaatacaaaaattagctcggtgtggtggtgggtgcctgtaatcccagctactcaggagcctgaggcaggagaatcacttgaacccagaaggtggaggttgcagtaagccgagatcacaccattgcattccagcctgggagacaagagcaaagctccgtctcaaaaaaaaaaaaaaaaaaaaatatatatatatatatatacacacacacacacacatacatatatatacatatatacacatatacatatatatacgtgtgtgtgtgtgtgtgtgtgtgtgtgtgtgtgtgtatatatatatatatatatatatatatatatatattccaagtggaggaaagaagttttcagattgctctcacttgtaactcccatacattaattttcttgtacatttttctttaagattataatgttgattgcctcctaacagtcatttccatccccctccctcattcagagaaccctgattttgttcaggggtgcaggtacctcaccaaaactgatgctggccccactcctgggcagacctcgattagtctgagcaagccctggtgctctcattcttatgccaacaattggcttaggaccgacctgtgactggttcttgacctgtgaaataaatgtgcaggtgtgctgggggcttctagaaatgtgggccagactgctgaagaagaggcctggagagatggttgcttaacctcgagatttttttttttttttgctttctttttagtatgataaaatatacataagataaaatttaccatttaagtaatttttaagtatacagctcagtggtattaagtacattcacatggtcgctcagccatcaccattatccatctagaaagcatattttttaaaagtaaaaagaaaaaagtgaaattaattttaataatggagtttaatctatacaaaatattatcaataagtaatcaatataaacattataataaggtttttttacagtctttttttgtactaaatttccacttacagcattgttgcttttttagagacagggtctctctggagtgcactggcatgatcatagctcactgcacagtccttgaactcctggcctcaagcgattctcctgcctcacctccaaagtagttgggactacaggtgtgcactactactcccagctttacagcacacagcaattcatatttcagatgctcactgaccaccggtgttggactgcccaggtttaaagtttctcaggcttgtgcgtgctcagccagctcatgggcatctccaagggacagcagcatgctgtatgtttatgaaagatttgtgcgtcaccatcagctctctggggcagtttgcgattcaccgcaggaccctagatggtgtctgactctaatggttctagatcagcctctctaacccccgcggagatcactggcatcacgctgatggacaatacaagatctgaagcctaaatgagagcttttcctggtggagcaaataccgtgcctccatcacccagctgtgatttcatctcccagttgagaacatgacctcaatggcagaggtagggacaacacctatgcagctgcacaggcactcccaggttggaccaataataaataaacacattcctacttggaaagagggcagcatgtgtgcagggttgaggcaagccgtggttgccatggaaaccagccagcatcactccagactttttccctggtgctcggatcattggtggctgacgaagcccagtggagaggcattgttcctgtacttatggaaaccttccaaataggcccattatgatgaaagcacatcaaagagggaatgatgacgtacctttaccatccatcgtcacatccactgtttgtcctgggtaatacccaaaagagaagaaaataaagccactcttgccacagagggaaataactggagagcactgaggtatgacactaggggtagcaaggtggtccccaaaggggaggcaatgaaactgccccatctcaccaccatagtgaatgctcgactggacaaatggttatggcttcagggatttgctacctgcccaagctgacttacaactcactttctatggcaagcctctggtttgctctctttctggagccacgtatgtttgagatcttcccattcattcattctttcctatgcccattcattccttcactcattcttgaatgagaagcaccatggtaacatgaaaacagcctgggtcatcgagtcatgagatcccagatttaaatctcagttcagatgcttattggatgtgtgatctcacctaagctattaaagattctctgagccttggttttctcacctgtaacatggggacaagagaagaataatgtttgccacttgtcttctacacagtcatactcaatgtgtttatacatgatttatatctcattccattttgatcaacaattacccaacagagagcctggtctctccagatactcaataagattattgaattattgattattgaataaaaatatgacaatgtgctttcacatatatttcttctctctctctctcttcaaatttcattttcacagcaatctggttcaaggttgtttcagcccagcacaggacaaagaggattataaaattaaaccacatgtttctgactctcagtgaacttacagtttactatgttttattaacaatgtatacaacacttagtctgccccagctactgtactaagtactttataaatattaggtcatgtaatctgcataataaccctatgaggtaagtactacgattgtcttctgtcactggctcagggtcacactagtacatggcagaacaaaggtcaaactcagccagtctggctctatagcctgtgctcttaaccactcagcctcattgcctttagagtggataagtcacattcacaagtgtatgcgaatactctccaagactgatggattcagaggaggaaacactatgcactgcatcttaaagatgaggtaggatttgaacacatggagtgcatggaggagagcagaagaaggacaggttggaaagaggataggggccctgaccatttgcttgaagtgtttgggctttagaccttggaaagccactgaaggtctctgagccatggggaaacctaagcaaagctggctttggggaaaattcatctggcaatagcatgaaagatggactgaagcggggagatgggacaaatgaggagagtgacatgtagctgctataatgagtgaaggaaggggtcacagggcttaagccaggacaatggaaaaagaagcatcaagggcaaatccataggacgtgcctcctaccaggatgtaatatgtctccccgagtttcccaccaaaactttcacatcagaaacaagttccaaggagcactcactgggcactttcgtggccatccagagtggcacatgggtgctctatagcactgctttcctcaaaggaaacatggggtcatcttgagcagctggaaacactggctgagcctttcctagttgcatgcagccatttactgaggccaagggggcaaaatctaatcctgacaaagaatcctggccacctcaaatgcaaaagatagccaagtacaacgaaccatagtcccgtttgttataatgtcctataaatcacagcctaggccttacagttaatagggctttctattccaattcccattatgctggaaggggaagaggaagaattgaggaacgaatgaggagtctgagagtgagttacggcccaagaatatgacttgtcagccgtcttccaagctctaccaattgcctgaaattctctatccagtcgtaggtttgcataaattcctggagaaggctttgtctgataccacagtgaaacagatgccagggtgcaggcacaacaggtagactcataaaactggtaaagagaactttgctttgacaaaagctggagttttccttgttatttatctttcctatttgaagccttgaaatcccattttcatcttgatggagatgataaactcttagaaaacttttatggctcccaggatgaaactgaggactctgcctctgctccccactgcaattctggcaggcttttaaattcaagtcagggcagaaactgtttttggtcagaggcaaaatgtatttatctctgtaagcacagccattaagatgtgagcatgaatagctaagagaaagaacattaagggagaaacaggaagaaatagaaggtgaggctatgatggaaggaaatgatgacgcatcaacccccaccaaaagctttttacagtgccgggggagtggggcacagggaaaggcatctgcagcgattgggagaaagaacccgggagtgggctgaggggaaggctttgcagtgggagggctgtgatcagcgtgtgcttcatgcaaagagaattttgagagtggacataacaaacaggaaaattgtgcttgcatttctgtttgtctgtagaatcactgtggctctgaaatccaccccctctgctctccaaacactaaagaaagtctccagatggaaaaatctgaagtcaggctgcaatatgaaaaaagaaaagaaaaagaaggctgctacaggaagctgacaaatttgctgtttctctgaggtctaacctatgcagctggggtatcaaatactagacagggtcaggagacatgtctgaaactgaccaaatgaccttggacaagccccactttaatcacacataatgtaaactttagggaatgtgacctagaacaggtagctaaggcacaaataacactagtactaccaccctccaagctggcactcatggcaggcatcattagtcagtcatggaattgttcttttcttttcttttcttttcttttctttttcttttcttttcttttttttcttttctcttttcttttcttttcttttctttcttttcttttcttttcttttctttttagatggaatcttgctctgtcacccaggttggagtccagtagcgtgatctcggctcactgcaacctctcactcccaggttcaagtgattctcctgcctcagcctcccaagtagctgagactacaggtgcctgccagcatgctcagctaatttttacatttttagttgagacagggttttagcatgttggccaggctggtcttaaactcctgacctcaagtgatccacctgccttggcctcccaaagtgctgggattacagacgtgagccactgcacccagccctcggaattctttagagcagagccattatgactgtttgctgctgaaccttaaatctttggccaaatattctctgtagctgctactgatcaatcagaatgaacccagaagatgaaagctgatgaaagatgatgaaagttcaccattgctagacttgatctcttctaatccttaaacactagagccagataagattgcatgtcatgtgtaatctcattatagacatccttaactaagtcctaccttggttttcttttctctttggccttctttccaagtcttagcagccaaggctgtgaaataagaactggtatgaaggctcttcattcaactccacatctgaagctctgaaagtgaccttgtgcacttttcttgagcctctttactttacgttcccccattctgccacaaagctcctggtggggctggtgtctcctctactctcctgctgatttcatcaaggtaaagaattctattccttttcaaatgctttgagatcatgggatagaagacagcctggggaagttcaaagacgtttaatcattagcctcagttcttttgaaaattattaaagagcccagaattagaaattcagatttcctccaaatccctgagaacaaacaactctcttgtaaatggcttaatgtgtctgtttaatgtacacaaaattatctttcaggaaagtggattgttttttatatcattttgcatctctaaaatataccacctatggcaaaaggattgggattcaaagtctgacaaaatctacagcagaaataattagcaccagaggctgtttctgagagttaaatgaaagagaaactggttatttatttatttcttttctctctatctgtatctctccatctcagccccgggaagaggaattgtatctcttggtgctagaagggtggcttgctgaattgcctttacaaggtttttttctgtaagacaacaactgagcccccaacacacaactccctgtgggccgcagtgctatggaaacagctgcagtgctccaactctggggaaaacaaccagataaacccactggtttgcaaactaggcacaagggcagaggaatagtgatgttttctaatttagcatccagggaggcaagggggagtctttgcttaaatcatgttaatgaaattggaaacacttgaaatagcccattgagggtctgttgcccctgttttttaaagttcatctaaaagttaacctacaaggaattttcatttggggaatttctgcaatgtcaactccactgatcacccacagtgtttaacacccttgctataaatttgggggctagcttggcagctcctgccacccccctgagtctgctaccttgctccagaaataaaaaatgactttggccacagtaatgtttcctcgatcctcagcccctcctgggggcctccggcagtcattattttaaataaacatgccttttattgttttcaggtacacagagatggaggcgcttctacctctggaggagggatggactttcaggggccccatgatttgcagcagttcagtcaaaagcaatacaaagagcaaaggataggggctgttatctcacccaagagctcctcaagcagaggatactcaattggaaaggaggctcttccagtcaaatttggggctagtggggtcaccacgtttgataccaactaggaacaacatccccttagaggcttccaactgaggaaggttccaaaagagagctccatggctgaaatgattcaaaagaagccaactccttctcattgagctggccctttggaatatggccccctcctcccacggcatccttccccctgcccagtgcctcaggcccatctacatgcttctacctataggctttgcttcttctctagaaaggagcaaagaaggaaaagaatcattggaggtgagtcaaaagcaggcaccgtaactcacggggccttgtaagccagggacacagtttcagattttacttcaaatggaggcaaaaccatgggagagccatgcagagacaccccttgatgaactctgcttcacgccaatcactctggcagctaagaaaagtgcattctctctccttttgcagttctcctggtgcctagcacagggccaagggcacagtagatgtgagcctaacacttgtggcctttgctgatgaaggacagtgaaggggataagaaaacataaagatattttgggctgcaagggaacgaactactgaaaaactactgcggccccctctatttatggagatgctgaggccttggagagggaattgacttgtccaaggtcaaccagaaaagtgatagcaaagccagggttagtatccaggtttctgctgattgcagctcctcagataaaagtaagtgacttgcctctcttctcccatatccagaattgatctcaaacactgtcatgaatccccaagggccagagagacacacagcatagaccaaggtgagtaaactgttttctctctttctgatgatctgagctttttcctggagagatctcaggtggccaagaaaccaagttgcccacctcatggttcagaggaaacaataacctcctggcagcttccctgggagcccatgcaggtgcctcagggattaaggagctcctgaaaacaactcctttcctttgcaggaagtgattttccacccctgaggcataacaccaggcagaggctctatcagtgcctgctgatataattagctctggacagactctccaaccaaggcagacacaaccaggcccttgctctagaaacaaaaagaatgttctggacctatcccagtacacttccaaaccccacgccttcctgggcaagtcggggctcagagaccaacaaacccaacagacttcagcagcagccagggagctggcagcctctgtcccctgaaatgccacttttttttttgtgattcagcctctgtttcaagctatttttagtgtaagcaaaggctgcatctgagggaaggtggtgtgggaaaggggtctttactttctctctccttttcaatgaactgtcctgtttcccttaggacagccatttcaccaaaagccacaaaacatgtggggagggaggattaaaaagaaaaatgggaaaaaggtcaaaattcagcctgtttgctaaaagtctgggaacagttctaggaaggtgatagtttctcgatcctttgcgttaacctgctgaatcctgggctgctcctgccagtggggaaccaatatgcccagtccatctaccttccgaattaaccaacctccagtaaacaaggaaggcccagaagtttgctctcccagggacgtggtgcaaacaggtttaatggtcccccttgatgccccagggaaggatgtgtgcccttggaggcttgtgaacagagaagcaagcttccgctcacagaggaccctggcttcccaccctcaccccgtctccatcatgtcagcacaaggccaattttacaaactgaaattaactggatgagcaaaaagatagccttggtgcttaagaggcttgggtacatttaattgagtttccaagtgccctgattccttaagaaagccagagaagccactgttatgtcctagatccctcactactcaaacaggagagaatagtttttacaataaaaattttagggcaaatggtggctttctgttgttgtcatttccctgaagtaggttttttgtttgtttgtttgtttgtttgtttgtttgtttttttctggaaaaagcctcactctggacccagagtctaaaaatgaggcttttagtgcaccaaattgggctgtttggggcccgtaggcacgagtcagtctgcctcctcctaaacatagcctcgtaaactaaacttggaagcatcagcttgcgtgtggtcccgagtgtgactttccaagcatgcactcccctgcaacgacaaaggctgatgactttgtcatcatcatctctatttttgagtctccctgctaaacaaactttctcgcagctgaaatggaggctctaaggatatttttctgacaaaaacggagtgctaagccatcagcaccctctgaaggccttgggggaaaacctgggtaagaaaagtctcccagcccaactcagtagccgcaaatacagacatttcatttcctgaaatgcctccagggggcgccagctttcatgggttgggaaggagggagggaaggacggaggaatggaatgaggcgaggaaggaagggagggagggaggaagggagggagggaggagggaggagtgggggaggtgggagggggcagtggggaggaaggaaggaagggagagagggaaagaaggaagggagagagggaagggaagggagggaaaggaagggagggaagggaaggaaggtaagggaggcaagggagggaagggagggaggcagggagggaaaccaactactcacatatttgcccaggcccctgggattcagctgcagaactgcacaggatgtgcaatcaggactagaatgtctgagctcccaggcctgtccaagggactgagagatgggtcacaggttctgacttatcactaaaccctacttcagaaaccttgccaccccaaatcattctagaaaatgcaagcataacatttccaccttcaacactttggatgactgcactttgcagcttttgctgaatgaaccaacatatgtccagcacattgaacagtatctgaccccgagcaggtgctccagaatgtttgaaggaatggatgaagggatggaggaatagctcagaggagctgcctcgcatgtgcagtagaatctgggtctttatcttctggtgacctcacacgctttcccatctcctttcaatgaatgtgtggtcactacctgtcaaaatgtacatcaaacccacctccccaaatactggtgcagatgtgccctccgaaaccagcctgtccctgccctgtcagcctcgccccacctccagggagaagtggatacggagaccacagtaagtgcacttgaccctttttccttaagactcatctgttgtcctgccaaggcatttcctgtgacacatgcgcccacaacgtacagctccagggagagcccagcccgttctccagtccccagccagctcagggaggctatatgaagtgagaatttcctggccaatttgacaatggtgagtcaggctggcatgagccagctgcaaagaggacgcagcctggacaagcctgaattaagtgtgtgcacagagcaaacatcatcatctggatggatccaaaccagggcttgcctggggcattcagagcctttcagatggccctgcccagagctgctcagcactcttggaagatgtctgggtttggggaggctcaagggctgttcttctacccctgccccagaaaaggatttgttcttcaccccctgacccgtctgtctccataccagcccatttcctccatgacatggtgaccgggctcacacacacaataacaaaaataataataaccatgcttatcaagcactaaccatgtcagaggcactgttctaaatattttacatgcattaactcattaagaggcagggactattattgtccccattttgtagatgaggaaactgaggtatgagacaatgaagccactcgcccagggtaaaagccaagcccctgagacagatggagctgggagtcaggagtctgcagaggctgggcttccaactgcccagccgcaccacacacagcagctccttcccaagatgggtgtcccagggagagaggcaatgcaagagctgaagtgagttttgaggctgctatgggctccacccatcctccttgtttgttccaatcaagtgagaacgagacacaaggagcaagatggagatcaaaaaagagtaggagctctagttcagatcatgatgcactgacaaaggggcagggtttctcactcccaggccccaacagagactgaagcaaagcggacagagacaagacaggaccggcagaagcaggccggactggctgctgactgcacagaggctgcaagtgctctgcttgcttaccaggcccccactgacctgtgctacgctcagttctgtatactagggaacaccaatcaatgtcggtggatcacacaggtggatgaatggacatagatggatgggcagacagacaatgggatggaaggccaaagcaggcacccacatgcacctggaaacttcagaggagagggaaaacagccatgccagcacttgccatcagagccctgagggcctgggagccagagatgagtggccaggatcaagtgggctgtccctggaccaggaggctcttcctcactctggagccaactgagggttgatttctgaaactctccttcattttcacagcagccctggggagggcagaggagccaacacaccagctagtaaaattaacagctgctctttacagggcgtgccggagagcccagcacatggctcgaggcctgcagaccagaagctgctgcgagctgaggtgcctggcctgcaggccctgatcaggggtcctcttgggggtaaggcttagactctgagctgccagcagggcctggggtgtgggggctgccgaagcagtgggcaggtggatggagaaactcaaggaatgatgctgctacaaaattctcagacatattctcctgaccttgcgaagtggaaatccatatgttcaccccagctgggaatctgctatggaacttggggacccacctggctctggcctctccatctctaatgcagtacttagttgagcttggggaagtgaatgtagacacgtccccatgagaaggggacagatgttatatcttatctattacctatgccataggtaacttatggagcaagtcctgtaggccacttgaagaggaatattgacaggcatacagggagtggcaattgtttctttacagggacagatggtaattattttaggctggtgggtgttttggactccggatactactcaactctgcctttgtagcttcttacagaagcagccacagacgatacgtaaatgagtgagcatggctgtattccaatgcaactttgtttatggacgctgaaatttgaatttcatatagctttcacatgtcacaaaatacacttattttgatttttaaaaaataaccatttaggccaggtatggtggctcacatctgtaatcccagcactttgggaggtcaaggtgagaggattgcctgggcccaggggttcaagaccaacctgggcaacacagtagaaccccatcagtacaaaaaatttaagaaaacatagcatgtcatggtggcctgcacctgtaatcccagctatcagggaggctgaggcagaaggatcgcttgaacccaggagtttgaggttgcagggagctatgattgcaccaatgcactccagcctgagcaatagagtgaaaccttgtctctgaaaaaaaaataaaaaaatgtaaaaaccatccttagcttatgaaccacacaaaagaggcaatgagccagactgtcccacaggctataactaactgatccctgggctaattaaatgtttcccaaagtgagtgctatgtgatgcccacaggtattacatggggaaaggattccacagggaaatgaaaatggaaaatgctgggcaaaacagagcctttccgctttctgactgcaggacttctgtaagtatttatatgctgatatgcattggcaatctcgaggagggggatgagaaatgaagtctatccaagttcccagggaaccatttttatccgggaacaattcgtgggtctagtgttctatggaacctaattaaagccatgaggataaagtctaaccaactgtcagcaacagcactatgaaatgcgatcctgctgctctttgaatatttctagtaacaggcagctcactacctgtcgggggagactgctcaattcaattatttctctgactcatgttttctcatctgggtaaatgatgttgagtcaaaaataacaaatctagtgcaaatctagtgtatctttcattagataaagacaaaatttcatgtttaatagtaaaaaaagaatgtatcttctttgactttttgactgatacccataatgtgatttcagtatctatgcatgggatgaaatacagaaccactattaagtcctggaaggaaattatcatatggttcctttaaacagaagcctcccttaggagtgttaaaacaatgccaataaaactccaactgattcccaatagcagagagcaggacatacctattcactatgggacattcttactaaaagtacagtcctgtgaaacctctagtctttctgctacacaaggcattggccaatgatgtaagaattttacatagatttgcctaaaatataataaaagctggggcatagatgaggggggtgagagacagagacagagacagagagagagagaagtgtgtgtgaatttgccaccaggcaccactgagaaagaaaagtagaggatactgatgggaaatgtcacaacctccatagggcacctaacagaagtgaatgcaatgaatgtgatatatttgattatgtgtgtgcccatgtgtactcccactgggttcaaccagtctaatttcatgcgcaaacagcacatcagtgaatgtacatctatttaactctgttaaaccaataggattattcctatttgaaaggcatatttgacacatattttcttttgggcccttggagataaagatgaaatggtccaggctatgtatataacgttaatgtaaaatgccacacatgcaacatatttagggggataaagagagaggctgatatttttctttcttcttacatcgataaatcatccctatacattcaagcaagtagcatatgctttcagttcatagaattagctgtgtaagcttcctggagcaatacacagatgtaacagcataggaatatggggaaagtaactacaaagagtgattctaagggctctctctagctttgctcaggagctggtagctattttggcaagaccagtctttgaagagacacacaaaacattgaatctgtcagggggttgaggtaaagtctaggcagtgtagatgtcgctcccaagttgaggtgaggctgtccttcaccacaggacatagtttccctagggagacagttgctgtgagatcaacatggaaatgaatatgaacatgcagaaactaagtgacaatgtggatagtgagagtatgtgtgtgtgcctgtatttatctttgtgtgtgtatcactgagtctgtaacgctcctttacaaagagtgtgacactcttgctactcgaccttagagaatctcttcgcctccagccccagactttcaatttctttatatataaaacaaggggataaattagactgagtcagcaaactatggtgtgtgaaacaaatctggcccaccacctgtttctttttttaaaacgttgtattgacatataatagtgtacatattttgggggatgcatgtgatattttggtacatgtataatgattagatcagggtaacagaaaaccatcacctcaaacatttatctttgtgttgggaacattctaattcttttctagctattttgagatgtacaataaattactgttaactataatctccctattgtactatcacatgctggaacttattccttccagtcaactgttttctctaccccctatttctataaatacagtttatttgtataaatgtaaggagtatgagtgcagttttgtcacatggatattttgcacagtggtgaagtctgggcttttagtgtaaccgtcatccaaatagcgtgcattgcaaccattaagtaatttctcatcactcatcgccacctcccacccttccaccattctgagtctccattgactactattccactctctgtccatgtgtacacactatttagctcccacttattcatgagaacatgtggtatttgacttcgtttctgagttgttccacttaagataatggtgtctagttccatccatgttgctgcaaaagacatgatttcattcttttttatggctgaatagtatcttattgtgtgtgtttgtatatatataaatgtaatatatatacatatataatgtgatatatatgcatgtgtgtgtatatatgtgtgtatgtgtgtgtgtgtgtgtgtattttttttttctttatttaatcatccactgatggacccttgggttgattccatagctttgctattgtgagtagtgttgtgataaacataggagttcaggtatctttcttatataatgatttcttttcctatgggtagccaccaattagtagaaatgctggatcaaatggaagttctgttttcacttctttgagaaatttctgtgctgtttttcatagaggttgtactaatttacatctccatataagtgatccttttctccacatcctcaccaacatctgttattttttgtctttttaataatagccattctggctgctgtgagatgatatctaattgtggttttaatttgcatgtctctgaagactagagatgttgagtattttttcatatgcttgttggccattcgtatgtcttcttttgaaaaatgactattcatatcttttgcccacttttaaatgttatttggtgatttttgttgttgagttttttaagttcctcatgaattctggacatcaggccattgttgaatgcattgtttgcaaatattttctcccattctataaagaaagtttactggaacaaagtcacaccaaggctgtttgtggctgctttcaaactactgtggcagagttgagtcgtggagcccacatggtctgcaagcctagaatatttactatctggccttttatggaaaaacttaccaaccctgaatttgactaccactgttgactttggcttatgattctatacagcacaaccaaactatactaaaacctacaccatacgtttcttgccctctttatttagaaaccaccttattcttagggggatttaatttacctgacaaaaatgtatggaacacataactgcatacatgtaaattccaaataggagtaagaaaagtagggcaaagggaaaatgagaggagagatgatgaagacaagccagagcaggggtgcaaagacacagagcgcaaacctgagccactctgtattttccataagccaccgacttggctctgagcagccaccactgagagacatgatccctttctcgatttagcatgctcactggatgttcaccaggaaaaccacaacaatctctggtgcaaaacactacttatcccatgagtctgtgcataaagcaggtaacatgagatgcagtgaacaaagtcctcaatgacacccaaacagttaagagaaatcctgacgacattgactgctatatccaaatttccctccgcatgagccgactccaaatcccacagtggaatttatcagcacgtcttccagcacatttcaatttttttaaaaaaagcaaacatatattacttttataatcagaaaataaacatttgtttagttaagaaaaaaataaaaggaagcagtactcttgacagcctggtgttcactttaatgtagaatccctcagccacgtgctccaagagaaggctctgtccagtcctgctgtttttggccagttgagcctgagtgccagggtgagagaggaggcaaagacaggctattctgagatctggagccggggggtcaaggaatttttatcatgtggataatcaggctccaggcgttgactataaaaagcactggtgaatggcaattatcatttgtcatttcttaaattgagctctgcatccttatatctagtttatcaatataaataattcacacctggatctctgttgctcactgctttatgcccagtgccttgaacagtgccaggtacagatgagcagtaaacacttagtgaataacggatgtgctcgtctgggagatcctacagatattctgaggttgtattggcaaattcttccccagctggaccttactcatgatgtcccagcttcgagattcacacctgtgacaattagacaggtgagatagaggcccagatgaggaggccaagctcctgagcgtgcatcaaggaaaacaaattaaaaattgaaacgggaaactgaatagccagctgtctggtcttgctttggtcccattgttgcagggataaacatttggacggctcaagacaaacacagctttgggttctgaacaggcagtgctgctttctcttgcccgccattacttaattgtgaaatctcttctttgttcagtgcagggacctgcctgctcctaaagggcaggcctattctcaggataccgcctggagctctgagatgcctgctttctgtgcagcaggtcccacttgctctgcatggccccaacagcctgggcaggattttctccaaggagaccttcagagagcagctggcaccttgggcaggctcaggcaaagaggcctgagtggaccatgcttctacatgcaaatgtttaacaagcaggccaagcatcctcaggaccaaattggctaaaagatggtaatgtcaaaatgtcacagccaaagtgacagctgtcagtggcttagaaaagaaaaggcattatcttcgactgggaagtaatgacacaaaaggagcaccagactgggagacagggagctggcaggtactagcctggctctgtcactcaaagctgaatgtttttagacaaataattgcccttgctatatcttgattttctcaactgtaaaacagagatgaattcactgataagattggcctgttttcttgtaatgaacccctacaacacaacagcaataaggagatacggaagaaatacgacattgtccttccccttcaaactgatcataacatataaggttagcacagtgcctggatcacaagaggcgttcaacagtgtgattgccaggagagtctcaaggtggccgctgggtgtgctgggcccaatgagttccatttccatgatatcacccacatgggctacctgcatcttctgcttggtgtcagtgcagaccgtgccccaccaggaccacatcaggaatctgctcccatgccatcactaaagcagtagcttactgccctaacttgtcctatagcctccaagctctagcctcacccattcagtctccacttgtcccccagctctctctgtacaacaccccctgcctcaaaatctccttgttctacaaacttcaaaaattcatttttttttttttgagacggagtcttgctctgtcacccaggctggaatgcagtggggcgatctcagcagagccgctcactgcaagttccgcctcctgggtccgtgccattatcctgcctcagcctctcgagtagctgggactacaggcacccgccaccacactggctaattttttgtatttttagtagagatggggtttcactgtgttagccaggatggtctcgatctccggacctcgtgatccacccacctgagcctcccaaagtgctgggattacaggtgtaagccaccacgcctggccccaaaattctttagcatggcctttaaagccccaccaggctgtctccaggacacttccccagactttggggtctgcaccccccatttcccagagcgccaggctccttctctgtttttcctgctcctcactttgaaggctttcttctcctttaactctcaagatcctaactcacacttaaaagctcactgcaaatgcattctgtcttattaagtattcttcacaaattccagcccacctagtggtcattttcttgtgtttaagcctggatatgtttttattttttatatcttcccgccataaagcagctcatcttgaaatgggagttttagttcaaagactttcctccctatgaaagcttttctgatcagccctactttcccctacagcccctccccacactccacaagtgcacaccgtgtttgtactcatagcacttatcctccatgcattccttcaataacttccgcatatggtgcaatagaatcaggatccttccttgttttctccagagctgaaacaaatacacttggcccagaattagtgttcagtaactcttgcaatgctgatgaagaaaattagaactgtctataatggccacatggaaggaacaagtgtcacatttgtgcagctaaactgtctgctgctccccattcactatcaccaccatacatatagaatacactacctccattttgtccccatgaatacccagactcagaattcaacctctcttaagtttccaatgcagaatccactcctcttcaagcatgaaagagcaatggagacttcagtcaagaggcaggaggagagatagaggtgctgttacacagctcagccaacagcaagtcacctccaagtccccactagacactgtccctcctgggtcacaccagactgaattgtctccctctctgccttcctccaagcagccactgacctcaccagtttctctctcctcctccaaaactccaactttaaatgtcccctctttccattttgccatcaattgacatcagccatggtttcataaccagacccttcagcacacagctcacggcagatccctcggtgaacagaacctgtctttcttgaaggctgtgtggccagcacctttgattactcaagcaccacgttcattctctcactccttcccacaaaagtgtgtgtgatattgatcccagacataacattgagttctccccaagaaggattctgagaagtgaaattctcaccacctccctccatctacagtcacctcttcactgagtttttgctgtgagactcagagataatgactgttttccagtgtccctgcctggtctttgagcctcgcaggcctcaggatgtccctactccttccatctatgagccaaatgactcttgactgagccctagcttcatgccaggacaggtggcccaaacaaaacagcttccagaatcacaatgagaaatcactccgaatgcaatatccttctcagggaaactcctgacccagagcagacccaagaaagcaagctagggctttcctagagcatgggcctggctatggcgaccaattcatccctgtttgcccaggactttcccagtttttgcactgaaagactcatgtctcatgtacccctcagtctcaggcaaactgggatggttgatcactataagcctgtcccagtaatgatccttgacaaaaaccaagggctcatgaggccagccagtgaagccaagcttcatataagcagatcagagagatgttggaaacatacagagaaggggcagaatcagccctggttgcaggtgggcttaggagacaatctcatcagaaaagggcacacaagcgagctctaggtacacgggccaggcagcctcaggtgggctactgatgcatccaccatcagcatgactgatttctaccgtgcacagggcccagctcacacactgcagaaaattaggaaactgctgcaagagggggtccctatgggctaccacaggacaagaagaacatcccccgaagaccaccaaacacacactcactcagcactccccaggatccccgcatttgtagcccttccatgagtttctggtatatttccttaaccctcttctcctctccaagatgatggagggtgtgtgtgtgtgcgcgcatgtgtgctttagcagaggaaatgtgctacatcttcccaacaacccttctccactgcaaatcccactccttgaaaatccctccacaaaccactgtacacaaggaaccgagcctctcctccatgaccacgcgggagcacttgctgctcacccccacctcccaatagccagcctcctgcagaagaccctggggaatatcacgtctcataagcaaagccaccttggcccagacagcaaggcctcctggtgtgagaagtgggtggagactcaccaggactctgccagtcagtgtctgggcggatatcatcacccccgcccagtccttcacggaggtcatccagccgacctcggcggccactgcctcctctttttcatccactggtttgagagtgccatccgcctggcttgagccattgttaatcttctgggcctcctggcaacagagagagcaagagttaagacatagggaacaatggatttaaataacatgctctacccataaagaaccagagccagaaggggtccccagctgagatggaaactagcttaaaggtataggagtaaagcagaaggggtaaattatgcctttgatttttttaaagcctttatttaaaaaagaatattttctttatttcctcttaaaatatcttagtgaaacaaagaaggatggtattattctattctattttattttattttattttttgagatgaagtctcactctgtcacccaggctggagtgcagtggcgcaatctcggctctctgcaacctccacccaccaggtgcaagcaattctcacgcctcagcctccctagtagctagaattacaggcgcgcggccaccatgctcggctaatttttgtatttttagtagagagggtttcaccatgttggccaggctggtctcaaactcctgacctcaagtgatccgcccacctcagcctcccaaagttctggtctcctcccattttaaagaaaaagaaaataccaaagcaagaggaaacgcaatctgtctaagattagggcatgctgaggagggaggaggaaagtgtgggagatgtcctgtggtctttgcctacccagcctctatgccccttttcacagcagcacccccactttcctttaggaaaattatctcttcctctcagtctatgtagttcaaaggggacagatggcctcacattggctccaacattggagtcctttctaccccctgccaacagcaattgggccattaataatcacatgatccatgccaagccaataagactcaagcgtggaacatttgcaggaaagaataggaaaagtcatccttccctgagaatgaagccactgcagagaaaagtaaaagtaatagactactgatgtcatcatttgaacacccggatccagctgtgcctgaaatctacaccagacctttccagttacaggagacaatacattccccttctggcttaaaatgtgcttgaggaaacaaggctgatttcatcagataactgagccccacacaggggccgaaactgtaaacctttgcatacagtgagtgttctgcctggaatactcttctcccacagagacttatggcctgctcccttaagtctttgctcaaatatctccttttcaatgaagtcttccctggccacctgtttaaatttgcaacactttctttccaatagcacttttctgctttatttttctccatagcacttaaaaccgctaatatacttaataattcatttacttctttcacttactgtctgccttccccactgctgcagccttggtgcctaatagagtgtctgggacagagttggctcaataaccatgaatgaatgactagaaagggctatgagtatcagcccctcgttagctacaaaggctgggtttagtgttgccagataaaatacaggatacccagtaaaatttaaatttcagataaacaacaaataactttttagtataagtatattccaaataccacatgggacatgcttatactaaaaccttattatttatctaacaatgtacatttaactggaccccaacacaaatacccactgcaactatgactgcagatgaagatgtttaaaaagatgccagcaaattatgttcatcatttaaaactctggaattaattcccaaggcaaagccacactggggatcattgtgatttggagtaaggggaagaaccaaagacagtggtgaaaagctttgtctgcagtgacaaagggggcggggcagagggaggccaggcacgtgggaggcaggtggggagggtgcactggtgagtcatcctcttggggacttggccacggcaggcaggaagctggtcccgattcctgcttctctccctctggctgcctgtggctcagggaagctggggaagagaaaagtgggacctgcagccctggacgctaatattttctttccaaatgtgttaagccccacagagctacaatgatccaagaggaggcccaggagggggaggccactgggcagatgtatctgggggctgcctgctgacatgtgtgggacctgctgcccaagcctcccaggccagcctcagataggacctgttaggtcttgccctggtccctgagcctctgccctgtgagactctgaacaggagggtatttaggaggatggggaggccctgatacagggtcaaccatggtaactgaaggtgtagattcgggggaaaatccagctctgccaccgctgtgggacctcaataagatggggacagtactgccagcccctcaggcattgtcaggattaaacagtgtccaatagcacaaaacacaggttcaagcaattatcccagcaccccttgcttcttctcgtgcccctgacaccataaagcaatggttatcacaatgagcgggcatcataagcacaccagagggcttgttgaaacacagtgtgctgggcccatcccagaacctacattcgaaccaagatgtcaggcacttctgatgctgctgggcttggaagcctactttggggaccacagctcctgactaccctagtatggctcggtgactgctgaaatgagacatggatcttcacccccagctctctcctggcctctcccttcacccaaggacagaaccacctgcttgtttcaatattggacattggtggaggggtgaggaaaagaggagggcagggagatcgtcccacatctgaggctctagtgtttccttttgagtcaagcctcccaggatgtttctgaactggtccctggccaccacgtggggacctggaagatagctccctgctcctcagtcctgggggcccaagttccacagccccttggtagaccctggagaggagaaatcaacgtgaaaaaggctgggaggcaggggggccctccagtcacagtggttaactgcatcagtaattcatagcacaagaggtatgtggcagataatgctatttcgccagccctcttacctattgttttacaaggcattcattattttaattactttatgataggcaaggaaaaacacagactaaagggagataatgcccttgttattatttgcttacactagatgttgtgagcttaattaccatgtgtgggaagcaggactgggaggagtgatgggggagctatttaaagcctgatgccagccggccagactagccaccaggctagccacagatcttgtgcctggaggaagaggcccctctctccaccactgacttcactctggccaaagcacctcttatggggagcaggcattataactccatgctccaaagaaaaagcagagaaggttcagtagccttgctgggaacatgcaggggcagagtccattataagagtgttggccaccattgaacaagccagaactaggtgccagcaactaagaattaagtgttttctatgcattgtcttgcttaaaccttataatacatccaacaggcaagtgaaattatttccattttacagacagggtaactaagagcaggtatctctcagaaaaaggcacagagcctgagagctcaggctggaagcagagagcccacctgggcttgtacctgctccagaacttccaagctgatggctgtggcccatcaacccttgagtctcagcctcttccatgtaagatggggacaaacatgccgcctcattaaggtggtggggaagctgaagcttggcacagtcccgggcacacagtggttacagctgccctgatgaagcacccgctgatggggctggggcctctaagagtaatccactgaagctgcaccactttcatcaaccagtggccctgggaggcacactggccagagtgaacctttaataaataatcacagaatggaggataaggaggtgcaggttctaacactgttatcctccaatgagcaagaagtccctataaggcaaggtgctgtgactcctgcagggcttctagtaggcgctgtgtgaccaccacccaggacagctggggcagggattcccgcacagggtggaccccagacccagtgacatctcagaccccttctgactcgccccattagatcaacctcccatttttaagatgagaacgctgaggaccagggagaggctgcctcctgagtcccagcattccgttcttgctcctggccccacaggatactgcctcacaggggaacaaatggtttgttccaaatagcaaaggggatatgcagccacgcccaaaccttccacctcccactgcagaggaccctgtccttacacaggaagcacttcccagtaggggcagcccgatgtcagtcaggaaatcactgagtgcgtgtgctcacacatgtgtgtgtgcatgtgtgagagtgtgtgcatgtgtgtgcacgtgtgagagtgtgtgcatgtgtgtgtgcgtttgtgtgcacgtgtgagtgtgtacgtgtgtgtgcatgtctgagaatgtgtgcatgtgtgtgtgcatctgtgtgtgtgctcacacatgcgtgtgtgtgtctgtgtgtgtaagggagagaaaccccactggctgcagcctccagctaccccagcttcaggaggacaggccaccagatcttctgaaatgcaagaaaagatgtcttgggaaaagaaaggaacatggagggaagaatagggagaaaaatgagaggtgaggccatcgcgtggggaggccatctcagaaagaggaggtcctgcaggagccctccccctgcccttggcagctccctgagaaagggattcggccttgcactggaggccactctggatctgcctccaaccctgccctctctccccactagagccttgtgtaaagcaggccacagctgcctctcagtggcaacagtgacatctaatttcagtgcccacatcagaaggtggggaggaattcagggcaagggtgcaggcacaggaggcagggaacaccagagagaagagtggccacagtcccctcccgacacccaccctaccaggcaacctctcacggggctgtgcccagccttacaccctcacccctttctatgccttctccccattccctttagtggtgttccccacgatgactttttgttgacatggccgcagaggggctcacccttcctatgtcacctggggccaagggcctgactgcaccccatcacctggtgctcaagatacaaacctcatctgatgcgtttgggcatttcccgctgaatcacaagatcaaagaccaaagcttgagaagggaccttagcaattcctgaggatccccaccaccacccaactaccacacacacagtgtacagatgagaaaactgaggcccagagggaaagccacaagctcagggccacccagcccagccaggtgaccaccgggccaggaagcaagccccagttgctctgtttcccttatctcttgttgcctccccgataagacaattgctccaaatctagcccaagtgacagtcactctgctgccccagcctggaacctggagttcagggtgttcctaggactggcagaaggctccacctagcctggtactgggttcaggtgtgagggtcacgacaagggctaatcctgcttgtcttcaaagggcccagccttccccagccacgacagctgctctggtctagcacaggagagcaagcttgtgctaatcctaggaccccacagccccatccctcagatttggctgtctccgtctctcatccttgctgaattagacccagtatactgggactctcaggtctgtggtgtggcaggaagaactatgaaaatcaaaagatactctggaccaagtccaacttttctgggtggcctccagcaagtcatgtcattcctcaaaccctccatattctcttctatgaacagggatgagtcctgccttgtcaccctgcctgattcttgcaggagccctaatctggtaacagagcattgcctttctgaaagcaactgctttacaaacggcaggcaagtggagtcactgtcctctggttctgggcaggaagcagggctgctctggagaaagaagtcctgtgccacaaagccagagccctcacagaacgcagggctcaacactcagattcctacccagctgcaacttgcagggcaggtcccccgttgtcaccctgcaccctaacaggatgtcaaattgccaagtctcagcaggtgacctgtcatgctgggcacaccctccctgacagggtgagctgctgccacacctgctctcacccggttggactctctcacccccaggcacactcctgacacctgtcaagctgaaccaggcaccaaggtcactgcaggcaccacacctgctggatgactgcctcaggcatgagaagctggctgggcccgccttgaggggatcccagggcccctccctgctgcctgcctagagccaagccttgaagctccaagtctgcctcgggtttaactacgtgtcagttctttggacactggttcctcatccaggatctgggaagttgtttaggcaaaggccatctgggaagaaaaatacttttcaaaaatgtaactgaaatcatgtcactgttgtacccaacaccctcctatggcttcttggcccattcagaggacaagtgaagtcttcacacccaatcagccccactcgtgcctgtcatcctgcgagtctgccgctcactagctccacttcagatgcaatggcctcctcatgctgccaggacattccagacccagtcccgtctcggggctgtctgcactggcctctgcctctgctccagagatccccgtggctgcaccctcatttctctcgagctttggttcacatcctcactttgtccatgagctctccacctcatcccgacctctccctgtctgtgctgtcttctccggagtgtgtctgccacctgcttcctttacttcatcattgtgtgctgtctgcaagctgcatgagggaaagagtttttgtctgtttctttttgttttgtttgttttgttttagacagagtctttctctgtcacccaggctggagtgcagtggcgtgatctcggctcactgcaacctctgcctcctgggttcaagcgattctcctgtctcagcctcctgagtgctaggagtataggcatgtgccaccacacctgtttagtttttgcatttttagtagagatgggggtttcaccatgtctgtttcatttatggctgtatcttcaatattgaatccctgtgagctcagagtaagcacctgacaaatcttggtgggtgggagggaaggaaggagtgggggaaggaggagaggagggaggagagctacagcaaatggaaagtcagttcttaccatgcacaatctagaatagatattactagtaaatagtactactaacaataattatactatcgactactgttttttagcatgatcatagtaactctatgacgttggtactaatgtcctccattgacagatgagaggttaagtagctggcccaggaagacacagtgtgaatttaaatccagctgtctgatgccaaaaagggacacgtacccatcctgctgtcctcccgggaacagtgtgagcagcagacgggagaatgcatgtgcaaggattattggctgctgcaaagtgcccacgaaaggtttattaacatgaagagcactcaattcatgccacttctgggtactgcttgtaccatcacgacccttcttccagggccctgtgcctatggagggcagttccatcaaggacagagaaacacagttcctttctctgccaagaacctgcccggaaccataaattcacccttcgtggagcagagtatcacattggaaatgagcgtggccaagctgacgggctgtgaagccctcctgctaagaaccacggttctctatgcagatgctgctaaaggaagatttggcttcctccctcgccatgcgtatccttggagtccttagcacgctctgcccagcggtctccagcactaagaggctgagctctgccgggcctgacgcacctgagtgggaggtagggttctgacagggaacaggagagatcaggttagcacaaaaccatctccgctagcccttttgggaccagagtaggggctgggaagcccctctcatccctggaagctggatgttctgcccagcaccctggaaccatgggatagtcccaggatgcttgacccccagagggctgtgagagaaggaagggcctcatgcctcacagcccctttgtcctcaaattttcctggtcaacatcagaaggccatttcccctgagccttcattgatggactgcgctctgagttactcattccatctgccaggagccccaccccaccctctccctggccactccattgccccatctcctctcgtctgttgaaactgacccagcagccccacatgctgctgtcctcaactgggcacaatgcagaagggctccttctctcctaccaaagggtgggggcagggggaagccttctggaccagaagctatgaagccaggcacaggctgtgtgccctgggccagtcacctaacctctctgagaagagtccctatctgggagacgagagggggtggtgagttaaatccacagttttctgtaccttgaggcccagcattgtgaggtgccccaggggggctggttaccaagggagggcagaggaggcagggccccggaccccgcggaaataaaagcgcctctgcattgagcaatttcacctattatggttctgtgctagactgcatctgagtgaagggattttctggggaaaaacattagaaatcccctgagtaaaagtccataggcccatgttagcttttttttgttttgttttgttttgttttgttttttgagaaagagtctcactctgttgcccaggctggagtacagtggcgtgatctcagctcactgcaatttctgcctcccaggttcaagtgattcttgtgcctcagcctccctagtagctgggattacaggcgtgtgtcatcatacccggctaatttttgtatttttagtacagacagggtttcaccatgttggccaggctggtctcaaacttctgacctcaagtgatccacctgcctcagcctcccaaagtgctaggatttacaggagtgagccacctcgcccggccccatgttagctttttaaaaaatgctttgtttcatgacaataactatgacatcctgtggcacagtttggcctaagatccagaagtgtctgaacctcaataccttaggaagccctggggctgctggtccctccccgcgggctgctctcctctccttcgcctcaggttttcaccagccccgaatgctggggctgggtcttccgtgtcccccctcccatgccaaagaggacatccacccagcaacctctttcacctcctgggcgggtttcccagccacgggcattctcccaggtaccaataatcctgcatattagggtattaggcagattacccaaagcagctcaagcaaatcaagcatagcatgggcaccaccagctggggttttcatggcaagagttctgcaaagggaatggatggaggaggtggttactctgagactcaaggaccagagaaatagggcaacaggggacccaggtctttcctagagctggtgtcaggagtggcagagttcacttctgcccctgggaagttgcatagtccaacctctccctggctgccatcacttctcctgctctgcaccccggagactctgcaccagcagggcttaagacatttgcactgattaattcacctagcagttactgtgtttgctaactgtgggctgtacctttagggaagggacacactgtccacagattcaggcaacaggaacttataaagaagctgggacctaaccgattaccccgagctgtcagaaagccctgtgagtttactgggtgtctcggctggacctacagtgctccaccattgaggcatttttagccattgctttctgggtgccctgtccagattctcactcttagaagcacccctgcgctgggtgtgaacaactactctttggaagtcttcatggtagaaaaaggccaggtgacctttaacaagtccttaccatcttgtgcctcaggtttctttgtctcaaatgcagggagccatgtaaacactccccaaggtctgtccagctctaaactgtctgacccggaggcctggattgttaagtcccttactttgcacgcactgtctcagctctgtaaccctgggcaagtcaatcaagcatcatttccctcccccgggaaatgctgcaggacagattccttttcagctcttctcagagccaggttcaaagctgctctcccattccctgaggaccaagggggtcaactggtgctcaggagatcactgatcccctcttacatctactgtgttctgtccttggtgattttacaccaacttaatcttcacaagaagcctgcaagataggaatgttttttctttttttcttttttctttttcttttgagacagagtctcactctgtcgcccaggatggagtgcagtgatgcaatctcagctcactgcagcctccgcctcccaggttcaaacgattctcctcctcagcctcccaggtagctgggattacaggcacccaccaccatgctccagtaattttttttttcctagtaagatggggtttcaacatgttggataggctggtctggaactcctgacctcaagtgatctgcccgcctcagcctcccaaagtgctgggattacaggcgtgagccaccacgcctggctgcaaggtaggaatgtcatgaggctcagagagattgggtaattttccaagattacccatcttgtaagtggcagagctgaaatttcaatctagtccattctaactctgaaggccatattttttctctctattccacactgtcttgggataggtccaatgtgcaagaacagagatggaatctccatataaaattctgtttactactactactgaaacaaccatctcacaacctatggcttctaagtaacaaaatcctgtagtacagacatctaaattcagttataatccactatgtacggacagagagttggagaaatgggctaggggacggggatccaacctgggaatacaatgctcattagacattagatatgttctcaaatggccacatatgctgcctaaaattagtaaggcaacctccaaactttcagggctaatacatacatcctggccaatgtgccgtatttgtaaaataacaatctccttctctttcaattagcttaataaaattggaaaatataagtgacagtccagagtccactatcagagccatagagactttgaattggattagtagagtcctcagccaggatgaccctggcagggtccaagacagcctgctgtccatcagagactcggagactcagctgccagtctgcagggcagcccatcctgccccagaagctcagctcaagacctgcccagacaagaaaactgtggcaggggcccagcaggaaggcaaaaattacatttgtttctcatcagggcagactgggatatggataaccaaacacacaggaaatcccaaaccctcatgttcataaaagaatgcagaaatcttcgtgccaagttaacttttaccggagggagcccattgccatcctgtagaccaggaggaggatccagcccccaaggagcctcactctcctcagcaaaggctcctgcaggtagctcacaggtgctctgttcccatgggtcctgcatggccacagggcagtgctgcccctgatgtggtacggaatgaaaagcctcagtacagcgcactgtgtgtgtcagtggaagacaactgatgaagggcctctcccaggaagaactgtccttttctttgacattatatcgttactcctttgttgggtattaacatgtccttttaatgaaatgacaatggtggcagagctggcatttgacagtttctttttttatgtttttgcttgtcaaaataaaaagctggtggccttgtgatattctgttttataaaaattcattgattatcccacaaaaagtctaggaaccactcccctagcccaaatgcctcattctacaggcaggaaatttaaggccccaatattccacactcatagtggccaggttcccctcgaaaaatgtggctttcagacttcaggggcccagggtgtgtctgtcacactagccagaggcagccttggggccaggaaaggtagggtctgagggatggaggcatggtctctcagggctggaggagctctgcaagctgctggcccacacaataggggaaaggggaaggcaagcattttcagagctcagggccataccaaccgcctgagttcctggcatctaatgccttcactaccactactgcaggaaatgcacagaactataacaacctcccgggaaatactacaagtgttaccgtggccccaagccaccacccaaggggcaactgggaagaaagaattcaaccacagatagcagataggatgaattgtttatggttgaatattcccttcagagtcaacagaggactccaagcaatttggagtaaaaagatgagtaacccgagagcaatgtaagtcacagcccagtgccccacacggaagggaacacggtcatccccttcgctgctgttctttgcttcccaccactaccaccttcatcacacacgtgtgcttattctctagcagtcagggcagagtctgcctgatttgcccactccacatcctcaaagcctgaacagcacctagcacacggtgagcatttcacagtgcactgaaataataaatgaagaaattctgttttttgttctgtcctgctttgttttcactcttcgctcatatcttctggaatctcaaaaatcctgccaagtccacaatgccctaagcatagaagtcaaactcctcaaggcctgatcttcaaggcctggagctgaggctgccggctgccctccccactcgtcactgacctgctcttccacctgacttctcggctatgacttggtcctcctgactgccacacctccgtgctggctgttcccactcctgggatgctctccccattgctccccaaccatcttcatcctccctgatcaaatcccagaggtgcagtgaagttctccttcctggctagatctccccaaagctctccctgtcctgtctccagggcccacatctgctcccccaattccacatgggacaggtacttagctgtcttttggtccatgcatgttgcattgccccagttagcctggacaatccttgaaggcaaggcctatataccttttatgcccaaagtgtttggcatacagcaatgtgcttaacagacacgtaccgattgagtaaattaaatctctgctcagtgggcactggaaaagcaagagctttcccaggcatcactgacgtctgggtaaaccaggccagtttccatgacttgaagcttaaactgggggttggctcctaactgctgttcctcagggcagctacattttcaaataaaaacactaaatcccaaatgagatcagatgacatggagcttctgagaggcacatgccctaccaggcatgtcagtcaaaagaaagatgaatgttcttgtttacaaaaggatttgtcccgtgccaggaaaatttccaccatgatttaggacctaatccagtctgtgcctatagacctcaccaactgaacatgttcccgcttcttccatttgctgaacttggatggggcttggcttcgggtcaaaagagctgtcccaattaggtcgtcagacagcctttccccacacttaagatgatccccattcaggaaaccaagggctagcaagacagacagactttgggaggcagaaagatggccaggttaccaggcatacagcggcagtcaggatctaccgctccgagcacagcccagcctgaggaaccaggctcccagagctgccctgctccctggactctgcctctgacctcaccccttggaagaactggctgggttccaaaacttcagcctctatgtccctgggttcccacacaccctagtttggatctaggtctccaacacagcagccaaacacaagagagtccagagcagttgctaatgtgaaataaaaacaattcaacagcccagggaaaggagacaggacttctttttccattggattcagagaactccttctccttttccttctcgatccctaatgggagttaaggatggcaagcgcctggccctgcaaagcctcaactctctacttggctccgctagacccatcaatcttctctccatggcctgggacccctccaaccctggacgtcgagagagactcggcagctgtgagaaccttctttctcaagtaaggtttttttccaaaattatatcaggtttccttctaccccagcttgtcagtgggggactcttttgcctaacatggttgaggaatgtcttagaaactggtgtgattcaatctggcttctgatgaggttttccacccagacagagctcaccgagtgtctggaagtgtcggttccctacacccaggggcatccacaccctgtccccatctccagacctcagtgaggaggatacccttgacaaagtggctggtccagccctacgatgaagttggatccagaaaaagagccaagaggaagccaaaaggacttgcccacacacttgcatccacgggggcctccctcctaccatgtcccctctttcccccaactttctaaattggtgaatctacttgcaacacacccagtataaataattgaagagctcccgatggaagtggctcaataattgaaatctcaaaaggcacacacctttcttttagaagagagggccacctcattcagacttctccaggggaagtcgttcttcccctcattccttttcagactggcctccttctacaaatacagattttaaccagagggtaattgttagaaagtgcagtttgcaaaaatgtcagtaacctgaatgccaagtttactaatgaattgtgactaggctgttgttagtgccgccacactctcacctgaagacccacaatctcccctggacagagggaaactggctgtccctctgttactgctcagctactgcactgaggtggggtggcaccagggggactggcatgaaggtcacatgaggggagagttccttttacatctcagaagtctcttattataaggatctgccaactgcaaggagagaagagccctgcagagcagagggacctgccagagcgctgcaggcatcaactttgctggcgtcttggaaagacgccccacgtctccataacaactaaccatccagcccttagcactgacagggatggagaccttttttggaggagcagatccggaagaaaggtcaggtggttacctgaatcccaagtctctttgttttgttttgttttgtttttctccttttgcagctgtttttcttactagaagctaggcagaaagagttgttactcagatttcttgaacttgagacgtcaaaggtgagacgccagccaaggagaagggatggtcagggaagcttctggggataccgacagtattttattttttgaactcagtggtagtgacacaaattttctataataatttgctattttgtaatttttcattttatagacttttctgtctatactatttttttaaagtctttaaaaaataaattgggcaaactgctcttcagggacccatcgtcattgccagcatttattaagtatcttctggcacaggacagaaatcagtctgcaaatcaccctgtgtcacagccctggaaagcaggactgagaaccagaaaacttcagtggaagtcattggtcccagtggccaaagcaccaaactgaagaagaaagtgaagaggtcaggggcaatcacaacaagtcataggatcaatgggctagaggccccagagaacttgttgatgcagtttgctgttatcccagctttagagctctgcctataaacaaagtcatagagaggggaatgtgattcatgatttgtacctgccttggaagggcctgaagtgaattggggtacgcagggccctggccatcagtgaaagagtgggtcttctgctgccctgctgatccactgctgagggtaactcatggtcccagcacagccttcactgaactgtcaggcacatgaagcaatcaggagtctagattgagtttccaaaacaggagcacctctttgctctctgtaagcctccactgatggctcatgccagccacatggctcccctagcctcccctgcacccaccggaggctgttaatagacctgtcattgtgctcatgttggattaatgaccactgttctccttcccaaatcctacacattgtttaagagaaagcctaaacgctgcctctgccatgaagcctctccagacctcttcagtagagctaacgtctccagggctgtttgctcaatacttcctttcaggtatcagtcccctcagatatcacttgtttctctgcttatcagtcctcattacattctagtccagtggctacatccatcagtctcccggctaagaacctgaggtcaggagccagggcttattaattcttatatttcatagcatctagcactgggcctggtggatttgtagcaggtgtgcaacaaacaatcaatatttattaatatatcagggtccaagagcacagacccagtaaccaggaaggaaggttctttaggttgtcagagaacacaaagggcctggcaggagggaggccaagcatcacagagaaccttcacctttcaaatctacccacttctctccatctcagcttctctcccctggttgactcctaagcttcataatcatttacattgtatcatgcaatggtacaattcccacttagttctgcccctcattctccacactgaagccagagagataccacaaggtttctatcagtcacatcatgcctgtgcttaaactcttctcagggactcccccttgctcttaggcaaaagttaaggccctcagcatggccgtcgaagatgctctggcacatctggcctttgccaggcatctggccacatactgaaatactcttggcctcacctcccttaatccacagcaatactggacattcttgcattccttcaatgagcactcctcttttctaattcagggatctgcatgtcctaggtttccttttcctgtaacaaccttcttcacacagtcatattccagatgtcctactcatatttaagatctctccccaggaagcctttcctaactcaccctccacctccactccaccaccaccattgctatcagtcaataaaaccttccaatcatgtggtctttgcactgctccttcataacactcaaggcatttgcaagtacttgttcagggcctctttgcttcactagactagaggtgggcaaattgtttctgtaaagggccagataggaaatattttaggctttagcatatggtctctgttgcaactattcagctctgttgctggggggcaaaagtggccttagacaatatataaacaaaggagtgtggttgtattccagcggaattttatttagagacattgaaatcagaatttcataccatttcatgtttcatgaaatattcttcatttaaaatttttgttcaactatttaaaaatgtgaaaaccattcttagctaatgggccatacaaaaacagatggcaggccagacttggcccacagcctgtggtgtgccagctcctgcactagactatcagtttcctagagacggaagccacgtcttgttcacagatgtatctctccagcacagtgtcttgttctcacaaggcggttcataaaaattcactgaatgccttgatatgtggactagagccatgtttcccagtgtaaattcacggaacaccagtctgatgggaaactccatacaaaagggacacttctctttgcagtgaaatctggaaatgccatcattcctcttctaacaaatgttcaatgctcactgcatacagcatagcaaaagctcagagatagccttcagtcaaggaacctgttcaacatagaccaatacaatgctgcccacactcattttgaccaaataactttcttctttaacccaaaatatctgccagtgtccaagggcagccccactgaaaagtgatgcagtgaggagagacggcagaatttagaggaatgggtctcaaactttagtgtgcatcagagtcaccaggaaggcttattaaaataagaaactaccccagcccagagtttccaattcagtaggcttaggttggagcataagaatttacatgccttacatgtttctcagctgacgctaatgctgatggctaggggaaccccgttttgagaaacactgatctgcagaataaatgatttcaaggcttcggtcctctagctggagtttgctcctccatccaaggatcttattcccaggtgaactccaacttgtccactttctcacactggcagtagcagctctgacccatctttctagtcttaggcacctgtaatgggttgcagtgtttttttccaaaagatttgtttcaatagtaatccccagttcctgtgaaggtaagccttatttggaaagaaggtctttgcagatgtaatcaagttaaaatgaggtcatactggagtagggtgagctcctaatccaatatgactggtgtccctaggagaggaggaaagagacacacatagggagaacgccccatgaccaaagaagcagagactggagtggtggctgcaagtcaaagactgccagccaccagcagaaacacggaagatgcaaggaaggagaaaccctacaggcttcagagggaggctggccctgctgacatcttgatttaagccttccagccttctgaactgtgagacaataaattaacattgttttaagtcaaccccgttgttatggcatcactaagaaacattctagtccaaggacagataaagctctggccaaggccttattcttggtaggtgtccacatgaactctgaaggaggaagccacgatgtcagctgtctgttccctttgtcatcactgctagacagtgggtgtctgcgctggggtctgtttttggaaattagattatctaattaatgtgatgttttgttggatccatgccttagggctggatttggcaaaaagcatgtgattattttttactcttaaaaaaatgtcactaaataagataaggagacttggctttgccctatcttgggctccacatgtcctgtttctcactgagagaccctggcaaggagtttctcagtgacaaagaaatggtttcttctcctctagttctgagctataaacaccttctctaatcgacatagaaacggctaagcagtagatattttcagtcagagtaccccagttttagtcataaattatatgcctctccttttggaaatataaggggtataatttttattcttgggcagacatagtcctgtgcccgataccttaggaaagagccaaaaagagaatgtggacacagcttgtcatggtggatggagaggaaggagacaccaggggtagggactctgtattctgaagctctgaggccacaggatgaaaaatcagagccaagtgaatgccttctctgcctctccaatccatgccaacccagggctggctgctcacatggggtctgcacaaacttgaaaatctccagatgttttataggggggacaaagccacgctttctgctgcaacagactgtgagacttttaggatgctcaccccaaggcccttgaaaaatgagagaggggtctgattctttgagatgggtaaggcagaggcaccccgtggaagtcaagcattccttctctcttccctcccaaggccagcatgtaatttcaaatgtccagtccatccatgaacaatatgttagcctttggccaggcggtgagcttccaaaatgcaaacatctcagcctctgtctgcagaggtgagaattcagcttggcagaggaatgggacactgtcaaggaagacaagcttttggagtcagacaatcccaggtttgcatattggccttgttttgttggtttgttttgctttgtgttaaaatctaatttattctgcaaactacagcaggttagttaatcctttgaaacctcaggtttctgagctataatacaggaataattataagtgctttgcagcagatttgtgaggattctgagagttgttggatgtgtctagcacattccttctaacttataaagcattatatgccaagtatgaatctaagtaatgcacatgccctaatcttttccatccttacaactatttatagcactgcccccatatggcaaatgaaggctcagagaggtcaaggcacctgcccacagtcacaaagtcagtaagcagctgattctggagctggtgctctcaccacagggactgctatatacccatagtggaagcctggggctaggaatgaagatctgtgttcattcattcattcattcattcattcaacaattcacctgggcatctctgagagaggattactcacaacaggttctcagacaaaaaaaaaaatacaatctctccttccaggagttgaagatctctcaggggaaacagacaagtacccaaaactaaatcaaggtagaatatgacaccagggaggaagagagtatggcagaggacctgttaaatggcaggaacagactgatttaatgaaggtggtggtatttctgctgagcctcaaaggataggcatgattttgacagatgcactcagcctggttcagtccaaattagggcccccttgttctttctcatcacaacccattcatttcctttgttggactcactgtgattttaatttcacagctatttgctgatttatttgttcaatgctggtctcccacactagaccatgagcaggaaggagaggcagcatgcaactgtgctcgttgtctacacagggcctagcactgggcctgggccagggcaggcacctgggaggtatgtgctgaataaatgaatggatggatgggtggatggatgggtggatggatgagtggatggatggatggatggatgagtggatggatggatggatggatggatggatggatggatggatggatgaggatataagtattggcaggctggtggcagcttgcagaaggagagcacattatctataaacacattgccccgatttatttaacattgtagtcactccaaatcttggttaccctcacctgaattttctcttttgggggaagttttacacaaccaccccagtttccctaaatgccccctccctggattcctgcagcacttgaatttaggcttctgagcactggtatctccccaaatagatgagactccccatgtgggcagcagccctgccttctccttcatgtttgtccacagtgcttgggtgagatctggacatgtagcccacactctgttgaaacctgcccatggcatgcagctgaggggccctgccttctccttgtcctcatttattgccatcagtcaaccaccaatcatcccacatcgaccccagaggcattggtcttggggtctccctggtgcggcaatgtgggctgccttcccagccttgtccaggtggcaggacttctgctgctgacaacagggctgtgatactcagctccccaaggctgaactggatgactaagagtcctaatgattctggtattttttcaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggccttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattcattcctcatctgtaaaatgagcatatgagtcccacttcaccagactgtaggacatacgtgaaggactctgcagtgtctggaacatatttatggcccctgaaataaacagttattgatgacagagatgaaaagaagaagatccaatggagtaatcttcaaggcctgcttcaagtcttgccttggtaaagctttctattgggcactcatataaagcttatatgacttttttttgtatataacagacatgtatatatgatgactgtctactgggtatggttctgagcactccctaaatagtaactcattgaatcctcacaacaagtttatgtagtatgtactattattatgcccattttacggatgaggaaaataggcatgaggggttaggtgaacgactcgaggtcacacagttataagaggttgagctgggatataaatccagacagtctgcgctagagttcgtgttagttaaagatggatacagtgtgctgctgttattattcttgtagatgttgactattatagtctcttgtcttgcggagcagagctagtctctctcccactttcttgacaaatggtaggggcctcccctataacatctctgaagcccctgcagcacttcatagagccagtcagagtgagtttgctgacccacttgccaggacttgctgtgccctctgccttcttcaaggcatccccagcagagccttaaagggcaaagcctgcacacctccctctgcagcactgctgcatgccccacctccttccagggccacgctttccaacttgtgacctggacccaaagtaagaaatacattttacatcgtgacccacacatacctactatacaagtaattgcaacacaggattcatgaaacaatacctacactattacatggaatgtactttgatatcctgtattttttaacattgattacaactcactaaattgatttcataatccacttagaaaattcctcttaggggagttcagctccaacatctagcacatgcaatttctgagtgcagtgcacagcaattcttcccaaaggcagcccttcctggtgcacatcagcatcatggtgctgtcccagcccagatggtcacttatatattccccagagccctgagcctggctggagcacccaggcagtggaaagtcaatacaggctgggaatcaaggacccattcaaaacaatgctcacagcagacacagagtgaagaggcttgctttagagtatgatagaactgagctcaaatctcacctctgctagttactaactcagatgttattggacgggttcttaacctctgtgagcttcagtgccctcccctggaagggggcactatcaatatgcaccacagagggtgttagctgagatgtggagatgacttggcacagcacccagatacagatactgaatcagtgccagtcagtggtggtgggaggtctttgctaacacctcacaagggccttccctcccctctctttttgtctctatatttagagattctacaaccttcagaagaaatagcagtacttcctagcacataggtaacactcaacaaatgtctgaaccaattaagcaagggcccaggcttttgcccaataagtcatccaatcctgagcatccatccattcatttatttatttatttatttatttatttatttatttatttatttattgagatggagtctcgctctgtcacccaggctggagtgcagtggcatgatctcggctcactgctgcaacctccacctcccacgttcaagcaattctcctgcctcagcttcccgagtagctgggactacaggtgcatgccaccacgcctggctaatttttgtatttttagtagagacagggtttcaccatgttggccaggatggtcttgatctcctgaccttgtaatccacctgcctcggcctcccaaagtgctgggattacaggtgtgagccaccatgcccagctctaagcatccttttgaaggaagatgtgttttataatcccttctaaattcagtggccaataaagtctgctccgtgaattacactcattcaatcacagctgatatctctagatcaaggacaatgcccctctctacaggtgggaagacaaaaccaggaggtcccaatgtggcttctccaaggttcccccaaagttactgtcagtgcagagctggggtgacagagcccctgctcatcactgcctatgttgccttccaagagagaagcaagttgctcaataaatagctcatcaccctaaaaataacgaggtctctgatgagacttagtctctaatgaaactaagcacaggactgagggggtgaagagcaagcagaaaatggatttccaccatgggctagactgttcacgtggcccagtggtggagagaatccttagggaaagcctaactccgaagcccagagaaggaaggaaaactaataaggagtgtgttttgcaggctgatttttctgaagttatccataggaaaattcatttatgtgagaggctaattagtcatgacagtgctttgctccagacataattgcattggtcccatgcagtctctgtgggtcagcctgtaatggaatttccattacctattgtgttttggttactggagaaaaatgtgtgattggggaagaaagagggatgaagagaaaacatgaaaggctggaataccttgaatatccataaaaaccatctgtgattttaaaacttcataaagatgatggatctctaagagccagatagtcttcttggaatctgagctctgtctgcgggaactgctcctggcaggcagtgggttttgaaatccaagtttgtcagaccacagagcaaagcgagctgccccagcttggccactaggggtggaaacaagacccaggaaagggagactaaatgttcttctcaactagccaccagctctcaggctgccaggaatgctgggctgtggtaaatgaatatatagatatatagatatatgggtctggtgccagaaatgtgcaggtctgcagggatgagtatgaaaggcctcacctctcctgccttctagagaataatatacagttcaagagccaaagatgcctgagggtgaactggtatgccaagttcggaagggtcaccaaaccacctaatcccccaagtgttagagccaggaacagaagggggttttaagttcagggtttctcaacctcagcacaattgtcactttggctagatggataaactttttgttgtgggaggctgtcctgtatattgcaggaggtttggcagcatccctggcatctatccagtagctattctcctccattccacccccatccttaattgtgacaactaaaatgtctcccaacatggccaaacgtcccctcgagggcaaaatcgccaccatttgaacatcgctggtctacccttacaattcccaaagtagaattccaaggaatattaatttcataagcttctccccaacacaagtattctatggtcaactaagtttgagaatcactgcatattgtaccctcttttggaaattccccatagtagtctattaaaggccctaaaaagttctgcaataagaagaacactatttaattgttttgtttgacctaacatcttgcaagctttctcaaacaaaacccctttattcctatatttgcatctttcagagttcctgttccaaagaatattgtgatttatatatatgttaatatgtatctatcatatatgtatatatatgatatatcaggcaacccaacctttccattgaacaagaggaactgaagcaataagcaagtcagggttcaaaatcctactaagagatgagtgtcagagccatgcatagaagctgaagtcctgattcccagtctacctccttctcttacacaaatgatttagattaatcctcaagaagatacaagatacaagaaaccatcctctcacagccatgtcacaatttggtttgtgaaaggaaagtaaaatcttgggaccctcaactcactatgccaaaagaaagagtgaactttgtcatgcaaaagctgctttctctttgttcctaaacagattgctgcaagagagaaggtcacctatctccccaggtagcctctctcaccctgacaatgtatcttcacaggtaagggacaaagacaagactagaaatcatccctctgcccacctcaagacaaatgcagatctgacttcttcttcctctactctatgtttactttatcttatgtaaaatacaagatttactgagcaggagccgaatgcactattgagtgtccctctttttgctccttcccactctcctgcctttaaatactgaagttctcaaaaccctctttggaaaaagcacaggccacagagtctactgtagcctttatctctttttcctgggctcatcctcaaccttggcaaaatgaacctctaaattgattgagaactctttcagacatgttttggtttataggctccaccaccaccatccagaatactcacctaggaacaacgcctagtgaaacatcagcatttctgttccccaggagaacagacaaagcaggcactttttgcagacatagttgagaaggacctcacagtggtcataacaagggagggtgcaaggaggcgccatccacttacatcatgtccatgcacctgctaatctactataagtacaactcccatgagaatcactaaagctgattcgtctttgtatcaatgcaatacatctttgtattgtggcgagcacagagtgggcctccattaagttaggtggaaggaataaactgttaggcaacacatgctaaggacttgtccatcaacatgccttgattataattcacagatcgtcaccaacacaataaagcctccccaatcctctctgtcctcttcatgattttcttgggaaatattctaccctggcctctccaggctgcagggaactactccttttaggatggcagctccccgcttccctgacacatctactgtcatctcttcacttgcgccagttcagaaagataaaagatcaatttccagctcagatcagccagcccaatgtccctcctgaagacagtacatcaagggaccagtttcctatcattctaggtagaaaacatgcagtgactggtcattcagtctcttgatggtctctcttgccaaaagcaggcactggagaggccatagattggctcccattctcagattgcaaacaatagaactaatattgacagagaaactggatggtatgacattctacaattttgcatggggattgaaatgtaatcataccttgaggcctctggtattccaggaatcctctttcagccctgggaacagaacagtgtcctagggatttctctaatccttttatgacattctaagcagagtgtatggatgcaggaacagccaagagtctcagccagagggcagacctggggccccctcttggtttaccttggctccagccagtccaaagaatacacaggcagcttgcagaccactgagttgagactaagggctcagccctagggcagctgcaacacaaatgcagcagcaactgctagatatttgcagcatgcccctgaagtctggtctgttgtaaaaaaaaaaaaaaaaaaaaaaaaaaaaaaaaaaggccgggagcggtggctcacgcctgtaatcccaaaactttgggaagccgatgcggatggatcacgaggttaggagattgagactatcctggccaacatggtgaaaccccatctctaaaatataaaaaattagccgggtgtggtggtgcacacctgtagtcccagctactcgggaggttgaggcacgggaatcacttggacccgggaggcagaggttgcagtgagccaagatcgtgccactgcactccagcctggcgacagagcaagactctatctctgaaaaaaaaaaaggctcacagcaaagggtgtggaggttgggatgctcagcttcggggcaggagaagcatacagcaagcctctcacacctgcaggactccaggctcccagagccacagctgcactctacctctctcctttcctttccccttctgagcaccttcgggttactgggataaagtagtgcttaatgagaggccaaagggactttgcctccttgaggctttttgattgctttgcacaaaactcatagaatcaccttatgttccttcacttaatcagtcacttatgagcactattctaggcactgcgtgaggctgggaaggccctgctcacctgttactcttactctgttatgctcttcgtaaaatccatcaaaaacaagcagtcatcctgcttctcttatttccccatttcacaactgtggaacccaagtacagccatccagtgtcagactcatgaacttcagaagcagaagcctgaagatgagctttggagtcactgtcacagcaacaagccaactggcatgcagaaatgaagagactcactcaaatgagggacctaaatcccttctatggtcaatgagaaacagaggcccatgaaagggaaaggccagatacaccctcacacaaggaagtggtggcagagccaggcccagacagcagagatctcaaaggtccccattttcaatgttgtgtttcttccatactgtcatttcaaaagagccatttaaggctgggacactctggtcccactcaaaaaaaacaacaacaaatcattaaactttcaacttttaaaaaactaccaaacaggttgcaaaacactttcttatcctacacctgggcgagagagacttacagagggggaaggggcagggagggaagaaggagagggtcatgaatggtgagggggaagggactgagtgagggtggaagtgttcatgattgggatggagtagagattagggagccttgaacctccctgaaggtgagaaaagatcacggatatctgttcatgaatttaaaaagactccgcaacttcatattcagagaggagcaggactcaggaatcaggcaatggtcatgaggtaagtttcaatttttcaaaacaaaggtgatttcatttttaaaaatttgttgtttatttgtcaagagaaactatttatttttatttttattttgagacagagtctcactctgttacccaggctggagtgcaatgctatgatctccgctcactgcaacatccacctcccgggttcaagcaattctcacgcctcagcctcccgagtagctgggactacaggtgcacaccaccacatctggctaatttttgtatttttagtagagacagggtttcaccatgttggtcaggctggtcttgaacttctggcctcaagtgatctgcccaccttggcctcccaaaattctgggattacaggcatgagccactgtgcccagccttaagaaaaactatttcttaagccacatattcatgttttatagttcaagaacacaggtcagtgacaaatctctaggtaattcttcccaaaggaatactttatattccaaaatcactttgcactctgaaagatacctcatctcctcaaaatctttcatagaatcataatttctgtagaatccgtgtatgccttcttttttagttcagccacagcaaagttacagagggttgcaacccccagggaaataacaaatgcgccaacaatatgaaatcacagatgctcagccagaaggccatgtatctgaggttttgtcaaagcaccggaagccacagtagttattatgctcaaaaggtatgtcagcctcaacaccagcatccttcctggctgatcgatttcattttttgacagatgagtttgacaccgccaatcagtggcaccaagggactgtatcataatatcctaatggtcccgaggctgattcccacgccacaagggtaactgcaattccatcaagccacagccaaatacagaatgcctcccatttaggaagctcagttaaactttttatgtcaccaacacgccccaacctcagagttgtcccttcctcactcaacacacgggacatttatcttcaacgtcaccacctagcttcaagcttccttcggcttccccaaccacagtccccactaactacaagctcaggccagcgctacagcctgctgaccactggcaaggggccttggcacatctagacatctgcagccaggcctgcctctcaccttctaggctattttctctgtagaagaacaaactgcttgaaaatcagactgcaccagaacaggcattcttcctgctgctgtggaagtgtgtctcgttcctgtggaaaggaggtatcttgttctggacagtgtgggctggagctgctggcggtcagaacagggaagatcgtgttcaggaagaacaccatccctgagagaaccagtctcccgacacacatctcaaggccagcctgcaccagctcaaccctctcctaagcgagaggctcccctattagcgtgatgcatgtcttggaccattatggattgacatacattcttttgtatgaagatattcaatgctgcacatggcatctctcacgacaggacccccgaacccagaacacagctgctgaggaacaggtgctccatcaatacgggtgaaatagatgaatacgtccaagtgccggtgtcgagcactggaaatacaaggacgataaagacaccacccctgcctccaaggagttttttggctagtgggagattcccccttgttatttgtcactggtggggtcagaaatggagtcaaggtcagcgggttttggactaatctagaagaaggactggatcagtgcttcttaaatgtgttattcacatactcccatcacaacttctgccctagctgcatgactcctatgctattcactaaacatttttctttcaatggagtcaaattttttaactaaacaaagatatcttttttggggagagagtctcactctgcctcctaggatggagggcagtggtgtgatcataactcactgcaggctcaacctcccacttcagcctcctgaaaagctgggactacaggcatgtgctaccacacctggctattttttttttaattttttgtagagatggtgtctccctctgttgcctaggctggcctcaaactcctaggctcaagcgatcttcccgcctcagcctcccaaagtgctgagattacagcaatgagccactgcacccagcttaaataaatatatcttaaggatactccgtaacattaccacatgtgaaaaactggtatcaccagtgaagaaatagaagataaccttcaaaataaacaaaatagaagaaaactttcaaaataaatgcaaaacaaaaccagggtatgaaattctaggtagatgcctccgtttgcatgcagtctcaatgggggctgttctgtgcctttgttcaaaagggagacaggcaagggttaagagatgttcaaacagtaaaccgagactttctccctgagataactagaaagactggaagaaaactggaaatgaactaaatccctccttggtgactcagggtcctgtccatatatcactagaaggtatctgctacaccacctgtggtgtggggaaaccataaagctgaaatgagctttaacatttctttcaacatccaggtcctataacaccataagcagattatttaatgtcaaagaaatcaagcgcatggaagaaagacagcacctaaacaacacaggtctgttgactgaattagatttccaaagtttctggccctcccagattcattatatcctatggtcttcgggttacaaatgaggacagaaaagcagagagagaggagggaatgtacccaacccatccacctggcagtgacagagctcagaggtcttcattttggatgaaccatgggacccagatgcctatgaaaggggaggacttgtaatctttttattcccgatcttagactacctgtgtgtgcaatatgtgtttccaccactttgtgaagttcagccaaatggcccttaagaaatgaaggcaatgacttggtggaggccctgcacgtagagaacgtcagaaaaggctgaattggatccccagatgttcctaagacctgctgggggaagcttgcacaagtctggtccaaaatccgtttgtaaggaaattggtgaaaatcacagcaaagctggccttcacaggccacatacccaggccctgctctcaagcaacatcaggcttggatagatttttccagaaccccagatagagctgggctaacttaacaggttgaattcaaggcgtaccaaactttaaaactggaattggagttgactatttatattacaagaagattcttcactctccaaaagcaaccctttgtcgtctgagcacccctaaagacttaagtgtttgttaacagattactaaccatttggcaggagtgcaagcactaaagaaaacttgcagagaaaggaaggggagggaactggaatctctgcaccattggttcgccaagctttgtgctacatgcttcacttacagtatctcatttaactaatcctcccagcagggttaagaatctccattatacagaaaaggaaacagcacagagaagtgaagtaatttggccaaggtcacacaggtactacagcactagaagcaggggctgtttccagcagcacatgacatggaacttcctaaggaagtgccatttgcattttgttatcaccatctactaaaacatacccctctggcacacagtgcaataactatttattgacatgaatatacataaatgctaagaatgccatacacagtaaagatgaccatatggagcttaaaatttattacaggtcagaggtatcaaaagaaaattatctgaatatgccaggctagcaagggaggggattcttggtgcctaaagtcctactattccagtcttctttctttacacacacacacacacacacacacacacacacacacacactccttcagccaaaatgttccactttagtggagggaaaagagagcctggagccataagtctagcttattgctgatgcctggtgttccccactctgcctcccaggatctggaatttatcttgaccaccagacagagcacagaactccattacctagggtgggccagggctgccacggagcagcattgtgtggctgtaccctccagaaactctggatgtaagatggaaggattgtagtacctggtggacaataggtgggaaaggatggagggtaaagaaaagcacaagacagggagaaaaaggaaggggagagtgggaggatgggaggcaggaagttcggttaaaatatactgtcagtggcaccggataaaaataatagccttttctgtgattgaaagcatttctaaaaatcaaagataggaacagctgctgtgctatggtggtgggattatgactgcttttgtaaatgtcttttaatgttcttatatagttttacagcaggtaaaattttggagcagaaagatataaaaacattcatggatagaaaattcagaacaagtcaccaaggggaacttggtttgtgataattttataaaacagtgttacatacattcctaacctatccccaggccccctgagagccacaaccaagacccattggaccaagcttctgaatttcacagagcttaatgggcttctgatggcaggggctagtcacccacaaagagaggccacaacatacagaggcaggaggcctgcaccggggccaggaccatgctctgtggacaaaatagatgatttcaggcaaatcccttacctggctgactcgggtcgtcttccttaaagtaagaggctgcatgcgatcaggagtgacaaactcaaatgctttaaagagttaggctgggatcacagaactgaatgggccatcagagcctatggtggcctggaaatcacacacccggaggccaagggtgcagctgctacccagacctaggtgaatgctgggccccatgctgccagtgtagagaagttgggaatctatacttttttaaatgtttggtttaattttaattttttttgtttttagagatgggatcccactgtgttgcctagagtgaagtggtgcaatcatagctcactacagctttagactcctgggctcaaagtgatcctcccgcctcagcctcccaagttgctaggactagaagcatgggccgccacaccagaagaaaactagactttcatgtgggctctaatttttctgttggcatccagtttctaaaaaacgtagtaccaagcacagtgcctgaatctgtaattccaacactttgggaggccaaggcgggcagatcacctgaggtcaggagttcgagaccagcctcaattaggagaaaccccgtctctactaaaaatacaaaattagccgggcgtggtggtgcatgcctataatcccagctacttgggaagctgaggcaggagaattgcttgaacctgggaggcagaggctgcagtgagccgagattgtgtcattgcactccagcctgggcaacaagagcgaaactctgtctcaaaaaaaaaaaaaaacaaagaagtacttcaaatgtattatctcactactctatgatatgttgtaagattggccccatttttacaaatgaggaaactgaggctcagagacattaagtaatttgcccaaggtaacacagctaaaaaggggcagagccaggattggctactacaaagtccttattccttctctccacaacattttattaagaaaatttcaaacaaggccgagtgtagtggcccaggtggctcatgcctgtaatcccagcactttgggaggccaagacgggtggatcacctgaggtcaggagttcaagaccagcctgaccaacatggtgaaaccccatctccactaaaaatacaaaaattagccggggtgatggtgcatgcctgtggtcccagctactcgggaggctgaaacaggagaatgacttgaacccgggaggccgaggccgagcccagatcatgccactgcactccagcctgggcgacagagcgagactctctcaaaaaaagaaagaaaagaaaagagaagagaagagaagagaagagaagagaagagaagagaagagaagagaagagaagagaaaagagaagagaagaaaagaaaagagaagagaagattccaaacatacaacaggttgaaaggatttcacagacaatacctgtatcccatcacctagattataccataaacattaaattttactgtattgctctatcacaaatctatccaaagattgtctcctttggttccatctgaaaagcaacctagaaagtacgttagaggtggagcccagatgttgccatttctgaattagaaataatttggcctcttctgaaacccactcatcccattccctttgtggctggggagtatgggggtgggaagggggcaggcaggaaggagagtgttgatccaggaacatctgcacacatcatcacaacacacatcccaaccagctctgatttctcccctggctcaaagcagggagagatgggtatttgggaaaagctcaccaccccaaaatatctccctaaaccctgaaggctaagtcaacccatgggctctctgaaagtggccaggggacagcaggagaggcagtactcggaaaagggcagcggtacctatcttcggagccctttcacctgctccagtgggattttattctcactctgtggccctgatacctcctgtgtcttttagctgcattcgtgggatgggagggttgtcagggaggtttcccacctggggcctcttcgtacacctcaaggggataccatgcccacagaatgcaatgtgaatggtcctcctggagtcctgcagagtggtggcaatcttcaagtccatctgattcatgcaaaagttgttcgagcataaacagcagctttctccagtgtcccacgcacagtaaagaccctgcaagagggctgcctatgaaaggccttggggccagggcgggggctgggagtgctggactctcaattctgacaccatagcttctccaccacttcttgctatgtgaccttaagaaaccttcctatcctctctgggtcagagctttacaaatgacgccacaccaaaggaaaaaaaacaagcaaattctggccatctcctatgttcaagacagtgggccagatgctgggtggaggggaaagaggcatactaaggagctcagcagatacctcagagccctggtctaagcgctttgcacgtttttaatactgacatcaactctacaaggtgggtgtgacttttatccacattctataggtgagaaaactcaggaggagagaaattaaaactttcctaaggccacagggttaagtaagaggcagagcaagggtgaaacatgggcaacagtttcagaagcctgcacaggtgaccaccacaaaacgctgcttgctagagaagcccaagaccccctctctgacctccaggaagactcggtccaggggagggagcaagacaaaagtgaagatttaaatgctgataaaatatttaaataattctttgagataatagtgggaaagatgctgccagggagaacatgattaattgtcaaatgaaagtgttcagacaaaattgctctaacggtccagaaaaggggaggaaaaaaacccctctaccgtgagctcattctgagttggaggaagcctgggaggttaaatgtcactggcttttgcagagtgagcaggacttgaacaggagagagtagggcagaaagcattccagcaagaatcaaaattctttttttgtttttgtttttgtttttgagacagagtctcattctgtcgcccaggctggagtgcagtggcacgatcttggctcactgcaagctccgcctcccgggttcacgccattctcctgcctcagccctccgagtggctgggactgcaggcgccagccaccatgcctggctaattttttctgtttttttttcagtagagacggggtttcaccgtgttggccagggtggtctcgatctcctgacctcgtgatccaccttccttgacctcccaaagtgctgggattacaggcgtgagccaccgcgcccggccaagaatcaaaattcaaagggccagctctcatgtttggaaaggtgaagggccctgaacgactgaagatggctcaggggtgcaggaagggtgagctgaggctgggtctgaactttgccttataagtaatagggagtcatagaggaatttcagtagagtagaggagcatcatgacccaaatgtctgctgatgacacactggatacactaggggtgcagggagaaaattaataaattccccaaagtgttggccaaggagtccttgggtcttgacagaggaaagcaagaagttaaggtcatgatactcctcagagactgaccaaagaaggaagaagggggatacttcagctggaagtcttcagctgggttccatcctaaggactttagaatttggcactctgcgtcatcagggaagcaagtaaatatgatccaaagtccccccaccccctcgcagggttatatccagagaacagaattttttaatgctatttttaatctttctgttgaccaaaaacacactgagaagaaatgaagcatgaacatcaacaagaggctctacaaactctctcccctctcttccctcctgttaaccactctgcgaccctgcagactcaccatatggtccaccagctagatggccccttctgatcctggaagggctgatccgcttaattatttggcagctataaatagaagcattggacaatagcctgagatcttttttttttcttctttttttggtcttgcaaacaaagagagggtccctagttggcaggattggagagtaggatttcactccctccctccaggccattgtcttccacctgagccaccacagcctcagggcggcttcagaactgtcctggatgagctagggacagccctgtctcaactgcgccagcaaggagatgtgctggggtcactcacagttcttagagtcagggtgggttttaggaaagagatcacccaggagactcgaaaggtccgtttgctttaggcatgtccttgcctatggggccaagacctcactctagccacccacagcttttcctaccttaccactcactgcacccacattcagccttcactctcacccccaccccattcccaggcgagagcagccacctggaggaatggactcctctggatccagagccaggaggtgagcagagcaaatgttcccagtgcctgcaggaggaagccaggcacccagggttccccttgccacctagacccccgccacctccccatctaggatgggctttctctactccacacataagcactctcctgccccagctcctaagctgttctccctacccctaatcttagcagggacctggcatggaagtcagatgagcctggcttggcctcttgggtctgctactttactagttgtaagatcatgggcaagaggtttcattgctcagtgcctcagcttccccacctgtacaatgggcacaataacgatactgacctctagggactgcttatgaggacctatcgagagagcaggtaaaggttgtcatctagagcctggcacacagcaagtgcttgctaaggggtgttactggcagcttttctctgagtccaactcccatcacctatatgcatgggactcagcacacatttgctaagttgttggtttctccacgctcccctcctcctccttcacacccaagaggaatgaccaggtggccacaggagtcagcatgtttgactttggtacctggggctcctgaccatccagtgtgaatccaaacgcatttccctgactgtctgacacctgctgtttaatctccatcaccttccctcctcctacctggctcagggtccctcactccgcataggtggccaaggtgtgggggagagccctccttcctaatgcttgtttgttttttcgctcatgtgtttgctcagagacaggataccatggtgacacccacgatccagggtggctgggtacacacacatagacagggaaatcaagtgaaagaaaaagcccatgggggccaccatcatcccacgaggggccagactggctcccaaaagagggggaaaggctgtccctcccaggggcctacatatgttttcccaatggaaagcttttctcagtggtcccggcaggcttccaggacactcctgcaggccagggactggtttctgtttgtctagaagccctgcattcatggtctagcatagccaccaacctccttgagatccatcactatccccccatcatgggcatctgcagagcattcatgggttgtggtcatgacttggaaaattattcttaggctgggagtatggctggactaggcttcacagagaacacggagggcagggtgagacgctgccagttggagagaatggcagcccctcatgaagttcagagaccccagcacacgaggaatctaccctgcctggcactgcattggctctcgtggaacatggagggagtgggctttggaatcagaggccagggatcaattcctagctgtgccacttcctagctaggtcaactgtgctgtttcctttaacctttctgagccaaattatttctaattcagaaatggcaacatctgagctccacctctaaagtgctttctaggttgcttttcaaatggaaccaaaggagacaatctttggatagatttgtgataaagaaatactgaatgctaaaatgaaaataaaaatatcttctgcagaaataagacctagagtttgatagatcagtagggtgactatagtttagaaaatattatatatttcaaagtagctagaagagaataattcaaaggtttctagcataaagacaaatatttaatatgatagatatcccaataaccctgatttgacctttacaaattatatgactatattaaatatcacatgtacatatgtacatttattatttatcagtaaaaataaaattaaaattataaaagggagagagacttcctgcatatgaaatagagattacaaatcctttctaagtacacatgggatactgacctgtatgctaagtcattaaaaaaagaaatccttctgcaaaggaccgttttgagactatgaggctctaatttagaaaggtgacaagcacattgcaggaccttacttaatagggctggggcttgccagcatacaaaattactgcagtgacttgttcagactcctgcactgggaaaagacttagtccagagacttacccaatgttttgccatagtaaattctccaaggatgaagaaaggaggaggagagaaagagaacttttctctgtcttcttcaaaagctgtagcagccagatgaagtacggtgtaggtggccaagcagccagatccctaaatagcaactaatgactttgattgaaattaataatgaaacgacacctgttagctcacttgtagccactttagtttgtcacatggcaattatattcactatcctatcagctggtccatgagctgtaaaatgctataatgccatgccatatgcctctcttgtctcccatgttgagacgggggctgtcctcagggtggttatcaattccaggcctcctaaccactctggagattgtcctgggaacttccccggcattcaaaaagacttgaggaccaccagccccagtgaacctgctgagtcccagggagcagctgggcagcctctttgaaggtggattcccccaccgagcaagaggaaaaacacacccaagagttaccgagtcccttctgtggttgggtccttgaaaagccttgttgggtgatagagggaattctccacttgagcagtgaacaacagtgtcaccatccacattatctccccagacagaggcaggacataaagaactaaacaggcccccagcaggccatgagatttggtttctatagcaacccaactgaggttgcatgagtgcctatgagatagatgcccaaggctcaccccagacagggccagaattccagaatcccaacggcaaggaccacccagcagcgtttagagatggaaagcaaggtttgttcatgttcagaaaaacccagggaagccacaggaaaaaaatggggctaggatccccactttctataaggcaagctccaagactatctggcagcccaaagctggcatgcagagctgaggcaggccccacaggtgagctgagccacgctggggattttaacagaaaataatcctccatccacctctgcatcgtccatattctctctctctctctctcacacgcacatacacagacacacacacacacacacacacacacacacatatgaaaaataaaaaaaatcttgcaattattcaaaagaaactatggttgatttgttgatcagaaaaatatcaatgaatgaccaattgcaacaaggtccaaggtcctttaatgaaagtttctaattaaccctacctttgaacacttctattactctatctgtagagtaattgttattttagcgatgcaatgtttcctaataagaccaagcattgggagaaagggaggaagggagggacctgaaacccaaacccagccccaggtacaagctagcacaattagcagccagtgtactggcttctcgaatgctgatatggaatagctcaggaaactcaatcccaccagggacctgcttactgtccacagatgtcatcacagtcatcggtcaagctgagagaggctagcgcaaacaggcgatggggccgctctatctctcctcctccatcaaatcacaaaatgccatgacaacacccaagccagggcctctgaggacacatgaaaggaaatccaacttcatgcaacagggactcaaggtatggcccttttcggccaaaaggcagtgtgggctggagagagagataaacacaagaggctggaaacacagacagggtgagtgggaaagcttagaaggcacttagcaggtaaggctggcatcgggagggagctggctggaccctaatccctgaaacctctctccctgaaacctctcttcaaagagatctacactttctaaatcctgcctccatgagatgaaacttctgttcggtgtcccactcttacagcccctgattcccccagggcctagctaaggaggcccttggaccaccagtgaaactaaacagagtcactgcctatgaagtcccttcagtctggagctgtctgaggaaacagataagccatccaggccaaagaccagcctttcaccatctgaggggctattagatgcccagcaaatatgggttgcctagctggtagcttctggcccagatgccagtccaagagctagagtggcctctccaagcttgggagttagggaagctgtacccagatccttggcacccaccccaaaagagcccatgaagagaaatgaatgaaagggcccagggagattctcaaggccccggtcagccgccctagaagtcacctcaatcttagtcaaggatgagctgagccttgaaaatccatactctgtgcaagaagatgcagataatctgcccagttgcccaaggcaataacttggaggacaaccaacaaaggccaatgggggtcacttgggaagacacatccctaagttgacctgacttccttagagtgggcaggaaagacaggcttcagaagatagctagaaagtaacaccagagaaggtcaccctagaggtggcccctggccatttctcaaggtgacagcctctctgcccaggcgtccacactgcaatgttttccatattggcacttccttacaaagtcctctctttctacctccatacctttgttcacactgttttgcttagctggcaagttcttcctgctcctctctgcctaccaaagccccacttgcccttcagggtcaggtcaaactcaagctcctcatcaagctctgcatgccatggagatgtgctgcccccaacctcacctcgaagaaggacttgaggcccagcttcagggagacggctttgcaaacagcccccagctgtcggttccttcaggctcagcctcagctacagcttcagccaaggtcacccttcctgggacagcctgcatctggtgacagagtgaggtggggtacagaagcacagcaatttgggcccaaagggatcatctctgttggataaatccactccagagttgtctgctgggttggccgaggttttgtggaagctgcatcagctctcgacttgtccctcttgtcactctggcctctgcctctcccttctcagaggtggattcctaataaacatcatgagctcaaactggtctccaccagtacccatctcccaccagaaattcaatcaatggtcattattattatagcccatgtttctgccacaaaaggtgctcaataaacctttgataaacacatgagataatttagcatttctacttgctgacggagctcttgcagagcctgccactctttcaggcacactcacagcagctgctgatcaggtagaccaaatgacatgaggccaatgaaataaatatgccatcacaagagcatggcttcctctggctccctaggaatcacacagcatgctggctcctgaagaacacacaaggagatgcctcacctgagaggttttggatcctgggatcaagaacaggggctcattggtacctctgtgtccatcctaaatgatggctcacttaagaagtgatggaaggtcagctttagtgacaccttctcatcagcaatgctgctactaggtgccaacagcatctctcaccacggcactttaatcaggatggcatgacaccactgtaaatattaaaaaggttataattagagacgcagttaaaacaaccgagggcttagtgttactaaagatatttgcagaatctggtgcaatataaatagcagggtttacggtgtcatgcctaaaattttgagcaggctgatgttccaaggggatgttcagtgaatgcccatccaagctgggatttctctcaactgattgttttctctccagtgtcagagttctcagaaatagatatccagagtgtgcccattctcataaaggggtgaaaagaccttgctactcaaaaagtaggacaaccttgcaccaggacacccgttgaagctcggtggggcagctgcagcccctcaagctgctagaaacactgtctcctgcatggagaggtcacagccttgtgattccatcggctccaaatttaaagcaatcttgcagaaaagggccaacatttatcagaatgaggaaattgttttctagggtgatatcaactggagtctgctgggtacacatgacacagagaacaggcaatcaacctaccaacaaagacgataattgtcacagtgcctgccaccggccaggcctctgcacacattcactttttcctcaccacaatcttacaaggctattgttgacatagtcactttacatatgagacaatcaagactcgcaacatcataaaactgatcagcagcgacatctaaatttgaattcaggtctgtccaattccagggttctttcagatgtgagaagggaggttcagaaagggcccctttttcttctccctccgtgtacttctgtattatttgaaatttttatcaatagtatattttcttgtattactttttaaatcttcaaatcatcaaaaagaatttatgggcaagagaaatggtcctatttctgttgaaaatgtatcttaatttgatgtaacaaaatactactaacaggccgggtgcagtgctcatgcctgtaatcccagcactttgggaggccaaggcgggcagattacgaggtcaggagatcgagaccagccagactaacatggtgaaaccccgtctctactaaaaatacaaaaattagccaggcgtagtggtgcatgcctgtaatcccagctactcatgaggctgatgcaggagaatcgcttgaatccaggaggtggaggttgcagtgagccgagatcgcatcactgcactccagcctgggcaacagagcaagactccgaaaaaaaaaaaaaattacaaacagccattgaaataaaaaaaaatctgttctttgctacaataatttcatttctggaaacctatcctgaaaaaaataagcagagacaccaaattatattaaataaaaaagctgcctttattttgaagtgttacctttaataagaaataaactggcaagaaactcgacacccaacaacagaaaataaagactggatatcctcatgataaactagggtgatgctattaaaaatagttttgaaatgtcagcaaccacaaggggaaatgctcattacatgtttctaggtttaagaatcaataaataaactaagtattcacacatgtaaatgctggtatatgcatccctcccaggacccacaggcatacaaaggaatttagaaagagtagacatctttggagagaggtttccaggattagggtgggtggggtagggtgggcagaaaacttttacttttcattttatatttttataagttatttcaatgtttaccatatgtgttacttttatttcatttcactttttcaattttttttttaatttttaattttttttttttttttgagacggagtctcactttgtcgcccaggctggagtgcagtggcgggatgtcagcccactgcaagctccacctcccgggttcacaccattctcctgcctcagcctcccgagtagctgggactacaggcacccaccaccatgcccagctaattttttgtatttttagtagagacggggtttcactgtgttagccaggatggtcttgatctcctgacctcatgatccacctgcctcggcctcccaaagtgctgggattacaggtgtgagccaccacgcctggcctatttatttatttttaatttaaaatagagaatgtgtctcactctgtcacccaggctagagtgcagtggtgcaatcacagcccactgcagcctccaactcctgggctcaagtggtcctccaccatgcctggctttattattcatttatttatttatttgagacacagtgcagtggcacgatcttggctcacttcaacctttgtctcccaggttcaagtgattctcctaattcagtctcccgagtagctgggattacaggtgcccgctaccatgcctggctaacttttgcatttttagtagagatggggttttgccatgttggccaggttggtctcgaactcctgccctgaggtgatccacctgcctcggcctcccaaagtgctgggagtacaggcgtgagccgctgtacccagatttattttttaaactaagtatattttaaagctttacatatattatgtatattaaccaatatacatattaacatttatatatattaaccaatctaagttttcagaataacatttcattatataataataaaatacacccaaatgtgatttctgcattgcagaattacagacattgctttctctttataatttttctgtatttgccaagttttctcccataaaagcataattttattatcataaaaagcctccttttcaaaactttaaggtatctcactagtaagaggatatactttctctaataagagtttgggtttcaccaccagtcatgtccagcctcagacccacccaaagagtcatactatcatgagtacaggggatagaagggccccatgagactcattccaggaggttaccaaagtagtagacctgaaatggtttggctctgtgtccccactcaaatctcctcttgaattgtaataattcccatgtgttgtaggagggacccagtcaggggtaacagaatgatgggggcatgtttttcccatactgttctcattatagtgaataggtctcatgagatctgatggttttattaaggggagttcccctgcacatgccttcttacctgctgccatgtaagatgtgactttgctcctcatttaccttctgccatgattgtgaggcttccccagccatgtggaactgtgagtccattaaacctctttcctttggaaactacccagtctcaggtatgtctttactagcagcatgagaacagaataatacaagacacaagccctactggcttagcctagagcctcagctgaagccacagccctcagccctggacccctgagatacaagaggagcctgaccagtgacatcccggaattaaacagggggagaatcttcctcttattgtcatcctgagcaatacactagacaaaggccatcgggcagataaaaagaggaaccctgtgcccctgaagttgatctgaccaccagcgagaggtcacatctgctatgtgcaatgccctgcaggggtcacaaagatgacttcaacctcgaccctgtcttcaaaggagagtccagtccaggcgagtaggtgagaaggcatgtaccaactcaaatcccaggtagaaagtgagcagagcccgaactacagaggtatgaatacagggcaattgaagttcagaggacgaaagctcgcttccagcctagggtgcaaggacagcttccaaaggaggtgattcacaaactgagtttgaagtctaggtgtattcaaatacaggccaagtgtgcccctgcccaggagtaggcagtctatgcaacatgtgaatcacatgttcaagcacctgcctcacctgttttatgggcaagtctgccagctacagtcctatcagggcacctatatttctaaggacctggatgcctggatgttttttctccccagggcatatatctcaattacaaacctgcaggaaacaaaaagtttgtggagagtcacaaaacatatttgaaatgtataagactttcaccacaggaaactaggcctaacaagtattttcctgtggaacacccctggctttgatgaaactccccattcaatgtctctttcctcctgcaaactttgctaatagcagtgaaaataaaagcacagatcctatatttacttaatgatcttggctgctttagacatgagatagcattccaagagagcaaagtgctttttaacaaaattcaacaagaccctgccctttcccccgccctcccacctggcctctggaaggaggaaggaatttctcattctctgatcttttcgcctgccatgacccccagggcaatccagacagtaagactggccatgcctcctggtcatgtcccatacctcatgtcctcatgtgagaccccagatgggggagatgatcacatttgagttacatttgaggcggagattcaggtgggggcccaaaacatggctgacatccagccagcattctttgctagatggagctgggaatggggggttaacttttgtgaaagtttattagagaataaagtaagtgagttaattaaattggagtgtgaaagacatttgggtggtgatgaggaggcgaggtgatgatttatttataattgacaaggttgcatctagctactgggatagtaattatacactttataaatgcgcaaaaaaagtcctttcatgcgatggaggtttaagggaaaatcctgtcagggaagtttctgtctgcccatgagtatgacaccacctcaagagctgttggccacttggcttctgccaaccacagctgtaagttggggactgaataatctctaaatacccttctaaaaatgaggccttttctgggaatcagtacttagcctccatctgcttctgatgatgttttcttatctcaattcagggacaaagagggatcctttatcttgtgtctgattctttgtttttgttttactgattcatattcaagttccagctcttggatcctccctaatcaagatgataagaaagatgctgcccaatgcggcatctcatttaagggtgagcagatgtgaattcagaccctaaatttgggaaagttccttaatctcatctggaaaacagggatgggggtacctagctgacggggttgctataaggacagaacctggtgtaaaggcaagcctggtacccagttaacactcattatcatgcaccttaggttaagtcatggtaaaggaaacgtttcaggttaacttcagtcccttgataactggggattccagcctgacctgtttgcatagagtctagcttggcccctgtgaccagcatttgcctctctaagggctcctaagcactcagttttaaaatccaatcaagagtatttccagagataagccacgacatcattagaatacagattacagcatccatcttctgacacccactgagaaattctaacaagcacaagaagttccagaatgctagaggtaaaaaataaataaatataaataaataaataaataaataaataatcttatctcaccattcaaagattctccaaagaagtagcatggactagatctctcctcccacctgaaacaactaaaaattcagacaagacaatgattttcagacactggagctcagtcaggggaagacagcaatccctgagagaggagaaacgaagtgagccctacagttgcctcaacttcctgtctggagagagcgtccaagtcacagcagaaagaaggaggaccccagcagggcccagatgtctccctgagttgaggagatgaaggctggattccagcaaggccaaggaggctggaattcacaggccagggcagcaaaaagaactgcccagtgaatacttgaggtcagcagagggacccccttgagtctttagctaagtattggtggacacaggcatgtgtgaaagctatccaaggtgggggagagaaacaccctaaaggagcagacagaacatttcccagagtttatacagggctgggaacggttcaccttcccaccagccagagtggaaacctcaagctcacagagcacctggtagagtactgagaatagcagcgtctctgtagtgggaaaaaattagccctagattaagagagctctggttccacctaataaagctcaaaggcaagacccaaaaaagatcaaactgtttccatacaacttgatcatgtcccagaaaataagctcaagaatgttttataggagtactaagatatccagcaaccaacaaggtaaaattcacaatgtctggtatccaatcaaaaactaccaggcattcaaaaaggcaaaaaaattgaacccataatgaaaaaatagtccatcaaaagactccccacttctgcaaccacatctacagtgtatttcaggacccagccatagagcccctctggtcctagaaatgcatttcaaagtgcctctctagctctgtgcaagagattttctctttttcattctaaagacagtaatcctaggtagaaacaagagagagaaaaaaaacagaaatgctcactttctagtttgtttctctgtttgctaacagtgtcacatttcccaagcagtgatactctcccatctcgttcatcttctaattctctgcctataattttacaaatgtctgtggctatctttagcagttttcaccagttttgtgttttagccacctgaccccctttcactctaccctaagttagatgactcctcattcctcattcataaagttctgtctgttaaacctagagttgatcagcgatcacgatacacgaacatgctctcttcttcagatgccctcacattttccttctttacttggggattaacaatttaatttttaattagtggagcatactcaaaatgtcatggttgcagccttccatcactcttgggctatattctctcttaaggtcttcatatggactgctgtctaaaacaatctagaagagcaagaaatccaaaaatgggcccaagtatcctagggctgtggatccaaggcatccatccaatgtgaactagataaactgcagtctgtctgcaccattgatctttctgagatgagggcacctgaaagagtgggccaagccactagaaccctggaccctccaccacaggtaccttgtggcagttggctttaacttcctccctatccttgccatattaatcttcattccctgtagtcataaagttctagaagaatatatcagctttgatctctttcagttattcatgcattctttcatttaagtaaacagatatttactgagtacctaccatgtgcttggcaatactttccaatcttcagaaccgggctctcacaccaagcccaagcacaggcagctacccttactcctactcaaaaatgtgaagaggctgaggcttctaaaatagaaaaagtcaccagctcagggtcaaataattaatggaactcgaacccaggactcctagacccaagcctctcctggccaagtctcattcactgcaatcacaggtccagcctggtcacgatgatgagtgggactgtaccctgccctccctgcccagcccattctaggcttcctcagaattccctactttgagtgctcctttgccatgtgaggctcagtgatttccttctccgagtccactcacatttgataggctcctatgaaatgtaggtgagcttcacctgaatctgcacctgtcctcattgctaaggtgatgagctagtgtcaagaaaggctgagggatccaaggatgaactcaggcagggcttgaggccactactcccggttcccctcctctcttccccatgaatcaccttcaaggacacttccatcaaacctgactcacacagaaggcccagacctgagaaatgaccagcccctgggccagagcagagagccagaaggcaattccctcccccatcactgctgcactgggtggaaattgggtcagagctggccagcccattcatttaatccaaacgccccctttccattcagctcttagtcctcagagctttcagtccaaggaagcactatttcctctgcaaaataaacaaaataaattaagcccatgctctttgatctcagggcttttgtgtggctgatgaattgaacagaaatgatctgccatcctcctggcatctcaaagacactgcaaaaattcagctgtagcttccagccacctgccaggcactgtgctgacaaggaagcatggctaaggaaggcactctttgccacccattctcccagggaagcaagaagagtctgcaggaggcacgacaggggaagtcaaaagagtcaaagactgtgaggcaggattcgtctttggccacataggcatggattcttcttcctctgctcattcccaccccagggactttgcactggcttttgtccccatgtggcatactttctctggagaccttggaaagctggctccttctcatccttctcatgtcagcttgcacaggacctccggagagaaacctttcccatcaaaagtagcccccagactctacccgcatcactgtctgccagccccctactctattatctccacacttatcataatcagaaatgaccttgttgctgcatttgttctcttgtttgttttctgtttccacttctacctccgtgacagcagggacatcatctatcttgatcagtgccatatccccggcagttagcaaaacgtctggcatatggcaggtgcaaggcaaatgtttgctgaaggagggaggctgcatggaggagactgggccctctttccagtgccagctctgcctgcatcgagcactatgtggcgcatctagaccaggatccacatccatggtgtggtttccccaggctgcagaagtgcactgtggaagcaggtctgtgtgcttgagatcagggaaagctgaccaagaagatgggacacagttgattctggagaggcagggaacagacaggggactctcctaacaggctggatcttccaggacagttgaaggacaacatccagtaggaccctagaccaagagtatagacactgtcgctatgggtgtttctctgagccctgagacttcccatgtttaagataagctggttggattactggttattgattatgttgaatcttttggtggcacagaccaacttgagaatctgaagatatcaactttctttctggagaaatgcatgtgcttacatagagacaaaatatgcctgcacttcctagaagggcaaggacccctccgaagttcattcacagccccaggatgacagcctctcacttaaaggctcttgggccgccctgctagtcattggcctgcttgctctgagacccagtctttacccctcgtctgtagactgtggactacactccccaggctccctcgctctttcttctagggaagtttgttctattcagcaggaatgcaggcagaagtctgcagggtgggggcaggcagaaaccaggacatttctccctccttctgcatttggtggcatctccagatagagaacatgtccatcattatatctatcacctctgggtatcctgccctccccagagtcctttcctctgtgatcctgcccagcccagcaggccttctgtagttccagcatccgccaggtgctgctggatcctgagttctagaaaaccagctcctcccttccccctctagccctaggatgctagcagcttcctgccattgctattctctgggctgcctctccattttttgcttggctttttatctccttggacacctttataactagttccccatataaactccttctactagatattttggcatgaactctgggtttcctctggggtccctggtgggatcagcctccctccagcacgggcattctgagagcctggtagcttcctggaaaggccaatctgagctgaattaacaaatccctaggaaggtcaagaagatggaggggctgggaaaacccatgttgcctgcgagtgcagtgcctccatcctgtctggttccattccaggaaaaaaagttatataggaaaagcctcacaatcgcaatgtagttaaaaactgtttactgcctttttctaaatgagggaaacaaatgtaaggcccagagcagcctcccatcaaatcatgctcttgctcagatcaaacggcagcccgagtgaatattcctagagttcctacttgggagctcacgctagctactaagtcctccctgccaaaaagacccgattatacaaagtggggcagcaggaaagccagtcttgtagcatcaaagaaacacactgtctgaattccatcagccacaagcaggcatcctccacccagggataatgcagccagggcactgtgccccagaatggccccacccatgcaggagggcaccttccctcctcactgtgctggcttcttttaacaaatagccctatctatgagctcccttgttccttccaaccattctaaagatagggcaggcaccaaggccaggggtatgggcaggtcctcctccctgaggaccaaggcacagagagtttccaaggccacacagccacttggaagcagagctgggattagaaccctgcctggacagggaatgacttcaacttacacacatgaacaaacacgaatctcaactccctgttatggtggggttccccagacacacatgcatggtagagatttcagtgcaaatttaatcatttgaaaatactgacattcaaccattttttaacctcaaaaatggcaatttcatgtggcttacatgaatagtttatttgggtagtgatcccaggggagaaccagctggggagtggggaaataaaatgggaaagtgagagggcagggtttgttaatggtcaggacactgctgcagacaaccaaggctcaatgccactggagacctctgggagatggggcagaaccaccctgtccaacatggaaggcaccagccacattgagctatctacatttaaattacttgaattgaaaaacttagttcctcagtccactagccaaattccaaaagctcaataaccacagatggctggtggctatcatattggacagcacacatacagaacatttccatcattacagaaaatcataggggtagcactggcatagaccatgcctcagagctgtgtcatctgaggggtagaatctggggtatttatactcccattagggtctatcattggcaagggctgcacctgggggtatttgctgcaggcacttccagatgtcttggctcacactggtagggggagggaaggcactgacagtaggggcatttgagtgggataggaatagagtggcctgggggcatgggcagggcattcacagcctctgccacaatcaccagcccttcctgcacatcacctctgctcttgttgaagcacctctggatgcaggcattttgacagcttcttcgcaatgggaatgtggccccagaatcctctgacctgatgacaagccattctccctggagacaacacacagagagagacacaatccaggccttccaagcatttgtgatctacagcaggcagctgggacacagaccacagcatgcagcaactatacaaacactgactaataagctaaaatcggaaatctttatggagaaacccttgtgagcagtgcctggctaacagcatgtaggtgttgcctccaagaactgtctagcatttgagagacacagttggagactgagcgtccccattaggcaggctggtccccgaatacccacattattgtggtaatcaaaacacagctttgagacatcactgtgctggtcacaaacctggcaaggtcaagaaagtgctctgaagaccagcacccaaaatcttcacagcttagccttcctcccaggggcccgctcttggcatagcacagtggccagaacacagactctctggagcccactgcctgaggtcatgtctcatctcctccttcctcactgcgtggccttaggcgcactatttgatctctctgagcctgcatttcctcatctataaagtggacacaataacaataactttccaatatggttgtcaagaaaattaaatgagcccatgcttttaaagatcttataagaaggatggcaaactttttccataaagagccagatagcaaatattctatggcattgcaggtcacacagactctcacaacctctcacttcggtccttgtagctccaaaccagccataggcaatatgtaaacaaatggatgttccaataaaactttatttataaaatcaggtagtgagccagatttgccctgcaggccatagtttactaacccctatcttagaatgattcctgctctacagtgagtgctatatgaatgttcgttgataaagtctgctgcgctctcccacctctcagattcttcctgtattattattctctctgcctccctctccacccatcctttaagaccaagctcaagtagccttcctgaaacagtgtggagatttctcaaagagctcaaaatagaactactattcaatctagcaaccccactaatgagtatctaccgaaaggaaatcattagaccaaaaaaacacctgcactcatgtttattgcagcactactcacattagcaaagtcgtggaatcaacctaagtgtccatcaatggatggctggataaagaaaatgtggtacacacgtgcacacacacacacacacacacacacgcacaccatggaatattactcagccttagaaaaaaaatgaaatcatgtcttttgcagcaacacagagggaactggaggccgttatcctaagtgaactaactcagaaacaaagtcagacagaaagtgatgggtacactaaaagcccatgttgtcacttataagtgggagctaaactgagtacacatggacatacagaatggaataataatactggagactccaaaaagtgggacggtgagggggtgtgggataaaaaattacctattgggctgggcatggtggttcaagcctgtaatcccagcactctgggaggccgaggtgggcggatcacctgaggtcaagagttcaagaccagccttgccaacacggtgaaaccccatctctactaaaaatacaaaaattagctgggcgtggtggcatgccactgtaatcccagctccttgggaggctgaggcaggagaattacttgaacacgggaggcagaggttgcagtaagccaagatcacaccattgcactccagcctgggtaacaagagtgaaactctgtctcaagaaaaaaaaaaattacctattggatacaatgtacactatttgggtgatgggtgcactaaaagcccagactttaccactacacaatatatccatgtaacaaaaccgcacttgtactccctcttttttttttttcaaaaaagaggcctccctggaccctccctcttttcttagccacatccttagaccacttccaagttgctcttctgtggtgacccttgccccaccctgctatttgtggggcaacttgtttcgctgtagaatttcattgttcctgttaaatgatgagatgatccaatgtcttcattttacagggagggaagcaaggcccagagaagccaagcgacttattcaaggtcacacagtgacggcagagtcaggaccagacatggatgtgtcttgattcatgattcagtacagtcttgggcttaaggagatttcaatactgaggagagtggggacacagatcacccagccttctacccttgatttagggctggactaggtcacccctccacagaggttccttacttcctgcctcagcacccctccaggcagaacacttacggggcttgttgccccaactagacaggtctggctcacttctgagtctgtcacatatccagcatgggcccaggcacgctccagatgcaatagtgttgaccctgtgtgctttgtcttcctcttccttccccgtgagtctgcccattgccccggggacacccaggacagactcacagatcttccccaggggacatgtcctgttcatgcctatctaagtcatcaaaggcaaattccagagcagcctatagccagggctgtgtggggactccccactgactatggggcttcacagaggcacagcccaaagtaccatgctcacagacacacaaattcagacacacacatgcacacacacacacaagcagacacatgcacacactaatataaacaacacagacacacatacacatacacacggacacggacacacacagaaacatgcacacactaacataaacacatacatgcacacacatacacgcatgcacacaatgaaacaggcacacagacacatgcacactaacataaatacacacagcacatatactcagatagatgcacacacctaaacacaaatatacacatgtatacccacactgatgctaacacatacacacatgagcacacacacacatacacagaaacatatatacacttaaatacatatatgcatggagaaacaaatgcatacatgtgcacacacacacttagacgtaaaaacacatatatttacaaacaaacacaaatgtatgcactcaaatagacatataaatacacatgcatacacacagacatgtaaacatacatacacgtaaacatacacacatctatagatgctcatgtgctcacagagacccttatatacctatgcacacatggataaacacacacaccctcacacatgcacttacacactgtgtgatgtttttagcttttacctttacagacagacatgggagctttccctggaagatgtaaggtccctgggaaagggactgtgccctgggctctcccccgggagagagtcccgcccacccacagcatctgcctggtgtcttgaacacaactagtgctcacgtttcctcaatggacggatgaatgaagtcgtctcatgcctgggccttgggtccatggggagagcttggctcaggaagccggtgctgcctctatcacctctgagtttccaagccatactctctcaccccatcccagcttgggaaacagccagcatcttgctggcctcttggtggagtgttgctgatccatgcctctgccagaggtgggagaaacctcgatgaaactcaaaccaagtcttgacttatctagggatggctgaaggtcctcctggggtggggagaaggtggaagaaaccactgactaaagtggtcctggccccattctcccagcatgtaggttttctggctggactttacaagtaaaaaccacagtgaggagctcacttctacctgaggtaacacagtgcatggcccccacctgcttcccttcatatcactatcttgcaaaactggctcagagagagcctcctggccctgcgtagcctgggaagataccacccaccatcatttgttacctccccacagtgggaaggtgaagggcttaggagacctgcttcttggcaccatcacactgtactgtgttgtcaccctatctggacctcagtgtttcctctgcttctataaaacggggtgaataacctttgcctcctaaataccaaggatacagcatcaaggagaaaggactctgacctcacaggaggtgggaccaaggagaggggcaactcacaaaagcctgaggaagaacattctttggtggcacctccctgatgagcagagaggagccgctctgcaagttaagtaattgatggagcacacgctaaaaatacaaactaggttagcactcagggtggtttattgctccaagagggagttaattcaggcactcaaatctccatggaacagggactgtgagcccagagcagcagactcctgagccaggaggcctcatgcaacccagctgagaagtgctgtttacttaaaggctgagcaagacggaaccagagaaaatgggctggggaagcatagggggtggcagagaagggagtgcccaggccttaggagcatgagggaaagaaaggaggcaacatgcaaattagtaacaggaagtgggacaggcgacaggagctggaagggctactccctcctagattgggctgcaaagaccccagcctcccagctttctggagccccttgctattccaagtaagctccagagaccagcggcatctgcatcaccagggctctcatcagaaaaacagaatctcagaccccaccctagacctcccgaatatacattgccacaagatcctcagatttcctgtgcacactaaagtttgagaagcacaagattaggagtcaaaatccctgagttcctggtccagctattgctatcaaattgctgtgtggttttgcaggacttgcttgacctctctgggtgctagaatttcttcctctgggctacaggatgagtgaggcttgtttctttctcctgggttctgagaggctcaagtcagacccttcatctgcaggcctcggaagcatgggagggcctttacagaaaaacgtttccattttctaccaggctgcccccttccgctttcttggagtcattagtacacagagaggtagatggggagatgatccttgaaggacacactgcagtcaggaagaagacttcttaatgtcattttaagccttgatatctctccattaaaaaaaaaaaattataaagcagcctcttgctaatggggaagcagcgggtctgagtcatgctaagtaagccagagcatttcatctggaaatccctggtctggtgttacccattgcctttgggacattcaatatcactactgcacttgagaaatgtggcttctggggctcagagaggttaagtgagtgggtcagagtcacacagccagtgagaaacagggccaggacgggaagccaggctcccggccctctaagagaaactcttttaagtacctcaaggtgcccacgtccttgacagctgacccagactggtgtgaggacaggaagggaaaagacattctgactattgcctgagttggacagagttaagaggataaatctgggaggatatgatatcacaagggttcagatagaaagtttctaaattattgcttaacttgtttcatcaaatgaattgcttccctccattagcccagggctgaagtggccaattacctgccttctgcacaggacgacggccgtgtataaatcaacttgggtaggtaacaaaggaatagccaaaattctaaaacaaaaatagatgagagacttaagcacaccccaaaataaaacacacacacactcggtaactcaagtattaagttctgagacggccaggcctgagtccctctcggcctccatccagagaccaaacatacagtctctgatgatgctgagcgtggcaatgaggcctttgcataggccacgatccctgcagcaaactgcgttgccttccctgggctttgggaaggacacttaaggctggagattcaactaagtgcaaagctggtacctgcagacccaggggcaccagtcagtctacagctatggagggtgttttaatgcaaatggtaaggcaactttgctggtccctccttctggctccaggatggcacctcctggggctgctgggcttttcccaggtcttaaaaggaattctggtattacagaaatactcagagttttggagttagaacagcctgagtttgattctggatgctgccactcactagctgtatctgccttgggtgagccatttaaacatactgaaccacagctttctcatctgcaaaatggggataataacaatgccagtgtcagagggctatcaagaggattgaataaggttaacatatacaaagcaccctatcggcacctggcaaacagcaggcatttaatgagtgtgggctccctccaacatagactagaaaaactggtcgaggggtagcctctccctaggaatattctcttcctttatacattacattaagagggtgaaccagtccaagccagattcccaattccatccttcagcccaaggctgctccattgcacagcttcaggaggcactgcccatatggtggtctagatgtgtgacgcttcccggggctgggcagtccacaacctgcctcagcctatggagacacccatgggatgctaagagggaaagaagagatccaaatccacccttggcagaaaatgggaccatcccaagaaagtgttcctggcaggagctcagtgggcaggaagtaggatgcccagcaagggcatacccttggcgggagcatcaggaactaaggcaaaaatagaccatgaggcccagggctgcatccacctcttcctggcccagacctctctgcccctctgaagcctggctgccctcactcctcgatcctcagtgcctagcatggactctccacacccactctccctcacttcgcctggtctccctaactagagagcaagctccctgtgggcaggggagtaactgatatcactgtggtcctcttgagccaaacacactgtgctaagaaagcccaggcctgcatcatctgctggctagctgcttcttcatctccaaagcccaattgacacagccacccatgtatctcagaggatggttagagagcccaaacgatgctcactcagtctttcaacaaacatgcattgagaacctactgcatgagctctggagtgcaatagtgaaataggcagaaaggattcctgtcctcaaagagcttattctctagtgagagacaaaggccaatcaagtacacaaacaaatactacatattacatatatgttaaattgtaatcaactacaagaaatgagttcactgcattatataatcaaccattgaaggcttcaatagtcacagaaagactgatgcaagagacaggctgaatgtagctctagtgagagagtaaggagccagaaaggtaaggaggggagaatatgagcaaacaagcctcctgtgcaggacatttccgtctgctgtgaccacccttcacagaactgagggcttgcctgttctgtcacgtgggatgctgatgtccatgagggaggcaggttatcacctttgatttgaaagccctagaggcagtgaagttgcaatcagatagacaggacctgaaagaaagaaaaaagggagggaggggggaaaggggaggagaggaaaaggaagaggagaaggaaaaaaagaaaaagtagagaaaagaaaaaagaaagccagacccctgtgctaggaaaaatctagctagaggaacgcagagcctagcctgtgatcttaaggtgacttctaggccagactgtgaagggcaccatgtcataaagccattgccacctccatttgatgtgcaccatcacctctcctggctcttggccttatagattcaccagtttttaaaaaaactcttacattgcagctgcttctcagaggctgagactcagtgactgtgtcagttttcatcttaattcatgtctgtactgccacactgttggcaggacatgtttcacaccaaataactacactttaatcaagctctctgttggttgcattttttgatgatggaaagtccgtctccgaagcagttgtcttcactaatgttgactgagcagtgctcagcagatgtaatgctgagcgaataggggatcccaagggactccagggtgccagtgcgatgatccaacagggttccagacatggcaatttagttggacttcatcctcagtcatagaatccagtggcagaactctatgtcacagcatcacagttgtgtggacacacagagctgccagagactataaaggccatagccttttccaccagcgcctgcatttgcccctagggaaagccaactcgaggtcaaggttagttcccaagtttccagacttgagagaggacagtggtcagagagtccagaagtttctgaaaggctgctccaaaagggcagggaggcacagcagggccacttggccactcgccgagttctacattcacagggaccacgaattttgaccttgaagctattcctgattaggttatgtacacattcctggagatgtattcatggaaggaaaaaatatggcattgatcatctgatttaaacttttatcctgttaccagatctcattctggtagtacactaggaattaatatgaagtttgcaaattaagtattatcctttgaatagtacaatcatattgtttccttgtttttatttttatttttatttatttttaaattttttgacacagagtctcactctgtcgcccaggctggagtgcagtggtgcgatcttggcttattgcagactccgcctcccgggttccagtgattcttgtgcctcagcctcccaagtagctgggactacagatgtgcacaaccatgcctggctaatttttgtatttttggtagagacagggtttcaccatgtgggccgggctggtctcgaactgtcagaactgtcaggggattctgtcagaaccaggggattctggagtcagaatgcctgccatcttctcctatagctctgtgtctacacacaagttacttagcccctctgtgcctattaagggctgatttatgttccccaccaaaaattcacattgaagtcctaatgcccagtacctcagaatgggatgtattcagagacagggtattcaaagatgtgataaaattaaaatgaggtcattagggtgggtcctaatgcaatatgactggtgtccttagaagaagaggaaattaggacacagacatatacaggagggagatgatacatacacagggagaagaaggcagtcttccacaaggcaatgagagagtcctggaaccgatccttccttcacaacccagagaaggaaccagccctgccaacaccttgatctcagacttctggcctctagaactgtaagaaaattaatttctgttgtgtaagccacctggcctgtagtactttgtcacagcaggcctagcaaactaatacagtgcctccctttcctcatcaagaaaatagaaatgataatagtcccttcctcacagagatgtgttgagtacccagttcccagcactcagtaggtgtccagcaaatgtttcttgcactacttgtgattagtacagagtcttaacccaacctggtctctgcatgcttcatcttactcttctgtgtgagaaaagaggcttataatgaaagcagagaacagtaaattctgcagacaagtcacacacttcacaatccccaccaccctccccgaccacttcgccccaagcaccttaaggttgaatggtttgagtcccaaatctgcacttgcataaggtttcttttgctctagccatgtactttgctgactgttgtaggacccgcctgcccatcctgtgttctctccacccaataccttcaaaggccacaataggaaccccgctactccttggtttatcaatattagacaacttaggatgcagttagagatccacacgccatccaagtccccacattacagaaattagaagcctctccttccagtttattggagaaggaggatttctggtcaagacgtccaccttcaagatgaggtgaagagcagacaccactctggacagtttgcctggccacctaaggaaaacacagcgtttagagggcagcgccagaactgtgtctcctcaagaaatttgtcttgagaagggtccctgaatataacggttgccagaggggactccttggggcctagagcaagcttactgggggtcctggaagagttctcagaggtgtgtgaactcactggcagctgactgagaaactgggagtggcacaaagacctttagaaaccaataaggacttcagaggtatcacccacaagcccagaagtgtggccaaactgaataccccagctctctgctgcctcagcaaggagccagggattcagtgatggtgtcttcttccaaacctgtatggcatggtaattaaaatcaaggtcatttagaacccagaaaccaaagccattctgactctagagggaattttaatttgttaatggatcttccggctgatggctgggggaaaagatagcaattcacaatgggtttgaggccaaaaatggcaccacagtggccgggaagccgctgatagctcctcggtcagtcttcaactgcagcaaggaacaggctgggctacccagggatacagatttttttttttaactttttaatcagctaatagcagatgaagacctaacaatgctgccaagattctgctccttctgtcagcagtggtgagaaggaggccagggtcggatgcgtccggctgcctttgctctctgaggttcttttggagggatgtaggaatttggggctgaggaggaaaccccagggccatcttctccactggtcaccaactgcaaggatccaggaaagggaaacaggtggaattctcagttccctatgccaatcctgggggagggcctgagacatgtactgtattaatttaccccacaaatgattatgggctgcttaaacggtgccacagatgtaatggagactcagcaaactgaggaggtgaggcccggaaacgtgtcactaaagctgcttactgtgtgccgcaaagggaagactccgggtggcctcagacagagggagggtagggcagcagaagagcttcatccagaaatgtaaaccaaaggcccggcaccctaccttgaacacccagtgctgccggaagatcctgtccccacatgagggctctgggcaggggatctcctcctaaccagcgccagcgaccacaaagggtgctcttcagtggagaagaaaaagaagaatctaattcctgacttttatttttagctgcaagtcagacagaagagcagaaagaaggcacttgaccataatcctgatcatactgaacgagtaatttaatcatttttaaagcctgtgtgcaggctccgccatcttactggggtctaacttgggaaactctcacctcatttcaagcaaccagggtttctctacaagagccatcaaaaactacttctttagaagcacaatttctaggcatttgttttgtccaaaaacttggattctcttactttgttccttgagctaaatcaagcacaactatgccagctgaggcagtgaggagaaaaccggggtggggaatgaagcaggcaagagggcctcctgccctcagagaggcagcccggctcatccaatggatagacgcacaccatacacacaccacacaacacacatgtaacacaacacacactacacactgcacaccacatacataacacaactcatactacacacacaacacatatacaacacacaatacacaccagacatgttacataactcacactacacaccacacacataacaactcacactacacacacaccacacacaacacacaatacacaccacacatgcaacacacactacacaacacacattacacacataacacaactcacactacacacacaacgcacatacaacacacaatacacaccacacatgtaacacaacacacactacacagtgcacaccacacacaactcacactacacacacaacacaacacatgtaacacaacacacactacttaccacacacaccacataacacacatcacacatacacacaccaagcaccacacacaatgcaactcacactacacacacaccatgcaccacacacgtaacacaatacatgctacacacacacttcacaccatacaccacacaccatacacatacacacagcacacactacacacacaccatacactgcacacactccataccaaataccacaggtcacacacacacaccacacacactatacatatacatacataatacacacccaacacatatagacacatcacacactacacacacacaccacacacactatacacacatacacattatatacacatatcacacatacacacataacacacatacacgcattgtccacacaccatccacgtacataccacacatatacacacacccaacaaatatacacgcagcacacacatactatacacacattatacacaacgcatgtacacactatacacacatcacacatatatacacacacataaacatacaagtggtatacacacactatacacacaccatatatatatacacaccacatacaccatacatacaccacacactacacatcacacacacataatgccacatacacacaccacacacacatacaccacacaccacacacatgacacatattcacatacatgtaccacatacacacatgcaccatacacataccacacacacacaccacataaatacccacacaccacgcattctgcacacactacataccacacatatcacacatatattatatattcactgcccacatacacaccacacaaatacaccacacacacacacactacacacacactatacatacatcacatagacacagacacatacacatagcacacctaggcacactatgcacatgtcacacacacatcacacacacacagagagcgtacatactaaacacacatcacatatacacatacacacaccacacacacatactacacacacactatacaaacatcacagacacagacacatacacatagcacacctaggcacactatgcacgtcacacacacatcacacacacacagagagcatacatactaaacacacatcacacatacacatacacacaccacacacacatactgtttatttccttgctttaataaaaaaataaaaagagagagaactttaaaaggaagcagaggaaaataggcatttggaaaattagccccatcctaccatgatagctcctataaaacatcttctagagtctgattttcccacatctaaaaattatttctttttattctgttgttgtttggcactacaatataaatatctgtgcgtgcagaagcagcttttagtctttcatctgtgacatctgtggagagcgctggagcttgtgtttattcataggcatcagtccgttccacccttcaaacaacaaaggaggcaggtggaacccagagatcagaggagtgaagacattagctcaagggctcaggatgggctccaggtgcacttactctatgctgtctgacattcatggtgggctcgtactaggattgggcagggtgagtttggcaaaccaaaacccaaatgtgcacttcccagcggggccacccaccagggtgctgtaccctaaccctccacggctgtggcctgccctgggtcacctcatggcctggtgctgcccttcacacgaggaaaacccttctgtcagttcctagtctccatctttctcctccctgattccaaagtgcaggtgcctgctgactgagttctttttagatgaagtctgttttcaccataggccctcaaccaaaggccagttgacttcaactggccaactttcatctcaacccagaattacagctatccccaggaggcaggcattggaggagttgctggaccgcagaactgaacactcacatcctctgagaaacggagcagtgaaggctcttgcaattatctcctgaggggggctgatgaactgggggccccagcctggagcagtggaggccaagaagagctttagccctgtcttcaagggcctgaagagagtggcccagtggtcagatgtattctgtccatccccagggggagaccagaaccaccagacagaagatttagagagaaatctctctcttgcttttcagtagagcctgactttcacaagataggaggggcctccgtggatggaaacaggctccctggcacaggaggcatttaagaagaggtggatggtctctcagtgggacactggagcagggggacagacatcgggggaagggtgggccagtgcgacctttccaattgcctcccaccttgagaatccctgactcgacagagtgaatacacagccatctgagacctcctggtcacctgcctgcagggctctcttctgggcctaaaaataagattcccagagtcctgatccaaattagatccttaataacgtgtcaccatggctataaataagtctctttgagggccagttaatataattattttaatcagctacactccctagaaggactgccagctagctccccgctcagcctcgctgcgttctgaacaggtgcgctcctcctccgcctcacccagggccggtccttagagcagtcacaatgatgaagggtgggtgggcagtctctctgcttccctctctctaatgtccctgagacactccttccattctggggcctacattctcccttgatcattcaccaagacttccaacaggaagacaggggtgaaaacgcaaagtctacaagagccagacacacagcaaagacatgtaaatcacacacggcatgatgtgagagagagtgttacggactgaattggttccctgcaaatccacatgttcatatcctaatccccaggacctcagaatgtggctgtacttggtgacagggtctttgaacaggtgattatggttaaatgaggtcattagggtgggccttcatccaacaggactgatgtctttataagaacaggagattaggacatggacagaaaaaagaccatgtgaagatacagggaaaacaaggcggccatctacaagagccaaggagagaggcctcggaggaaaccaatcctgctggcaccttgacctcagacttacagcctctagcagggtgagaaggtaactgtcggttgtgtgagccacccaggcgatggtcctttgttacagcacctcaggaaactcacatggggcgcggtagggtgtgccctgtctggaggttccacattcttttttttttctctctctcccaaagactggacagccaaacaacacagagccctggacttctctgtcattgtatatgactccctgagagaatgtaaggaaagaaaagcaatagggtgtcagagaaaggacattggcctggccgggagagctggtgggtttagccaggctacctgagcaagctgctcagtcttgggaactattcaattatgttggcccccatcctatcatcagttaactgaaacacctggcccacaatgacctttaaagagccttccaggactaacaattttgcccctgggtagcaaggggcagcctcagatcatgagcctagaagggagaagccctggaggacagagtgggacaactgcagaaggagcacacagaggtgtgggtgatgtcaggaggctgcttgactctttcctggagctaggagctttcgttcctgtcccagctgctctatttgctaagtgcctcaacttgtccccctcccgggcatctgtaaatgagataataggagtgcacgtgttgtgtaccagtgaaagtctacactatgccaagcatgctcaccattacgaaagaggacaaggacaggtgggtgcccagtggcttctcaagactgacatctacatttatcagattccccaaggggcaactccctgggcaaggcaaggtgggtcttcagagttggggccggagtgcctgtcttctccccaccacaaacctaggtgccacattactatacagtcctaaagatgctttaggattgtggtttcgtgctgaaggaggcaggggagaaatcgtaacttgcatctcccaaaggctagaagtgaaattaagatccttacacacgcttagtggtctgcattttacatagagctttcaccaatacaatctcccaggtattattattcccattttacagatgaagaaaccaaggcaaggggagattaatgatgaaaataaggcagtgtaaaaaaaagcacaaggcttgggttcttactttgacctttaacaaagtcacttaatatcttgttatcacatggcctgcaaacaaagtcctgtagccagtacaagcagggtcaaaacatgacctgaggacttccacccagaacacgccatatgcacatttcacagattcaaataatctcagaactggaagggcccttggcaatcacagatctgattcctttggatttatgccaaggaaactgaggtctaaagatctccttgctcagggtctcacagtgaggctctggctggactaaaaccagagtccagggttctttttcatagaccatcctgccctgtcaatttgacttcaaaatcttcctcttcaacacaaaccacaaccacaaagagaagggtcttctgggttatctgtattgggttgcagaaagaagttccacccgtacccccaaacctggatacttcctccaggccgcacggtgctggcctcctccagcgactttgagcaggagagcaaatgagtcaagctcctctcacaggatgaggctgctgggagcagctcagaggactggaattagaaattctaattattagaactctcggaatgcaccaaaggacaatttataattagcacatgtcaaaaggccatccgcaaaggggacacattataaatcagaaaacaaagatggccccagaaagggactggggagctgagctgtttggcctcccacccctcctgatggccctaaatccaatccacctcccactcctgtgagccctcctccctcctatgccagcctctctcctgctgctctgccctttgcaagcccagcattggtgcttcccgctccctaagccctcttccctctgctgctcggtcagggccactgtccgaaggccttagcacagggatccctctcttcagggtccatgcagctctaaccccaggtcctgagcgggtcagaggcttttggctcctgctgtcacaggctgcaaataaggatttaatgactagcctttttatgaggaagaaaatgtctccagtggactgataatgtcatcgtctgctgctcaggtgcatgtgcccaggtaagcctcacagccagaaccctgctcttatgatgaaagctcagggcacaatcccagtgcagacttggaaaggccagcatgcaaaagaggtcggggcacctccttgtttcttccatgaatgaatgaatgaatggattttctactgacttatatgccataaatattttcttgagtacttcctatgtgttagtcacagcacttgagattggagaggaaaagcagtcaaaaacacagaaataaataagacacgaccctaccctcccagaattcatagtagcacatacttgacaggtgaaaacatttttagaaaaacaaaaacgaaaaccagcaagagaactggcatctgaaggcaggacacctggattccaggaaaagctcttagctgcatgacttgcctcctgccggtcatttgtcttccttgggcctccatcatctgtgccatggagataataccaacttcgtggatcccacaggggttgccatggaaaacatgataaaacacaggaacagaccctctgagaaatgtctgcagtgtaactccttatcataacacgaaacactgaagattctgttggctgataggaataagaattctattttcccacacttgccagtctgactcaagatggcacctagttccttggacaaagatcccaagggtagagaaaggcaatttatcaggccaccatatgtctgtgcttaccaaggaaccttctagatggtgacattttctcatatgctgtggctcacaggggaaagactgcctctatgtctagggatgacaaggttttattccaggagcaaatgaaccccatctgtgtggtagtggctgcctggagcactgtgttaaaaaagatcctgaagttgcatcttggcttggctagaaagaacatcctgatagattatggatgtctgttatgaatatggagttggggagtggcactttgttacttgtgacctaggaagataacatgcccactcaaccacactccttgttgcacacctttctttagagctgtgtcctctggccattcaaaggtgagctgagtattggtcaatgccctgaacacgattccttctgtgtgaattgttaatattaagttcttagagccagcaaagcctaagacatatgcccagcaagaaactgctatttttaggaaattagctggtccttcagacccggttaaatgtgctaggtggtctcagtcatgttctttataaactgagaagaatgcctcacaaatttgggtgtcattagggtctgtggatcccgggcactgccacacaaaatcacccggttcaaataccctgcaggtacatgataccctctgccgttaattctatgccattttgttgaagtctattccacttccttcctttaccacttctcaggacaatgcattctctgagtttattatgagctttatgctctatgaattcttgccatttttctaatatttaccctgcttgcgttttaaaggggacctctctcttagcatgtcaggatgtggcaaagagtctgtactggcttagttgctctgctcacacttttataaaagtctattatgtctgtgttaattcccaacagagctgagctgcagtcaacccctgaactacttattaaaaagaagcactgagcagatgaacgctctgctcatgactgagaggggaagagaacagactgtgtccaagtccatcaacacatcatctgtgcaccaggaatgctccaaacacaaacagccctagtgagtcacaaggatagatgaatgctacggtgattcttacatttgcagtcaggaccacagagtgctggagacaagaggcagcttagaaaccatctagtgactaaagatgcagaaattcaggcccagaacaattaaccggcccacagtgttactccaagccaggtatacttactataaaaaagagtatcacaaaactctacatgtgaggtatttcatttatgtctctttttgctatttcagatggtttcctctcagaactaaaagcacattgtattgcacattgtagatactcaaagtctgttaaataaataaaccaatgaggtaatgtacataaccctgcagaaggatttcagtacaatgctatttataatagcaaaaaagaggaaaaagtaaagagcaaatataaggaaaaggagtgagcatccatataagatatagtcatttaaaatatgtttatagagtcccagtgtcacttggaaatgctgataacgtaatgttaagaagaaaagcagaacactaaatcgcacatattctaggatctcggcattataaagaaaaatgcacagtaatatatttgggggaaaataaaacgaatcatgaacagtagtagatgtttctgttgtgattatgggaggttttatttctgcttctttgcactctgctgttttttgcagataatttacaatgtgcccataggattttcataagcaatgcgagggtattaagaaatagaaaagaatatccacagatattattcagccttgctgggatttggaaagagacagagatcatttctctcttttcacataaagaagctgatgaaacaaagagacagagacactagtgatgaaggcaggcattagctctctggtgtggagggccatccaatgccaggcaaacaacagatgcgggataaaatccactcaaaccacagtgggagggggcaggaggtgtccagtcttcctcttcacaaaggttccatccttaccttatccaaaagatgagcaatacaaggctaggctcagcctttaccagcagagcctccccaaagactctctggcccctgcagccaatgacaataaattaactatcacagtgaggtttttccccttcgtcaggcaatgtgctatacacattgtctcattaaatcctccccatgtctctgaggcaggtcttactgtgcccatctgagggatatagagaccaggactcacacaggtaaacccaggtggccaaggtgtcacagtttgtaaccggaccccagaagcctaagccctcgcccctgtgccccggctggtcattcgttcctccagatctttgcagcactaagaagatgctgcctggtgacatttcctgaattgtttcccacgggtcttgtctttcaggctaggacaagttgtttaacctttcacgtgcgtctgtctctcttgcttccctcaattggactgttagctcctgagggggatgagggggtcctgctttataattccttgtgtgtcccacggagccaagcctggtgatgtcttcagtacttgacacttcagatctcagaaaatacctgctcatcgattattggattgaataggttaaggaggagaaccgtctcatgggcagacctggcctgcagccaagacagaagctggatgcgcctccctccggactcttgaccccaccaaatacgacgcccatatatgtcaactgtggcattggtgtttgtcccccacacccctaaaccacaagccaataaattgcagggcactcagacatcaggatgtgtccttcacttgccaccagacctgagctggctacaggccaatgacagcatagggctggccctgcccgcctcccatctggcagcaaggatccagttccagattgtgacctgtggttgagtctggcacagtgacccagggctccagcaggcaaatcccagtcataaaaccctggtctgaaccagccacgtgatggaccccagttatctcttcctaaattgcagcagagctgatcttcttccagctgagccaagggccatcagacagggacacgtttacttttactatcctattaaagcatcccagaaaaaaagaaacagtccccatatcctagagcaagaaataagcaaatcattatctacaatgatatcctttaagtctaagcttgcccagaaggtgctgcacatttggagaccaggctatggctcccctctctgaattcttttgaaaccgcagggactgttacaggcgcctccaagactctggagccacagcttgcctagcgcagcttccccctcccggcaaagccctccctgacaaccctacccacagtaatctcaactttcatgaaccttttctctccccatagggtgaacacataaagacacacacgtgcagccgggcacggtggctcacacctgtaatcccagcactttgggaggcggaggtgggcagatcacctgaggtcaggagttcgagaccagcctggccaacatggtgaaatcctgtctctactaaaaatacaaaaaaaaaaaaaaaatagccggaggtagtggcgggcgcctgtaatcccagctacttgggaggctaaggcaggagaatctcgaacctggaagggggaggttccagtgagctgagatcatgccactgcactccagcctgggcaacagagtgagactccatctcaaaaaaaaaaaaaagatacacatgtgtatgcacatacacacgcgtgcacacacacacatacacacagcgtgtacatgttatttctccaatgaaagcatatttcccttaagggataggaccaatcacttatctttccagagtctaactgaaaaatggacccaacatccttgaattaataaataaatgaacaaataaatttgttgatggactggtcagttgataatgtcaaggaactccctgcaacagcctacacaggttcaccctcctccaaaatcatacctttccaagtccaaggaaatgctcaattcaatcatgctgttttagaaataaagtaatgaatgatattaacaattgtttagaaactaacaggtgcctggccaggcacgatggctcacgcctataatcccagcactttgggaggccgagacgggcggatcacaaggtcaggagatcgagaccatcctggtgaacacagtgaaagcccatctctactaaaaatatagaaaaattagctgggcatggtggcaggcccctgtagtcccagctacttgggaggctgagacaggagaatggcgtgaaccctggaggcagagcttgcagtgagccgagatcgcaccactgcactgtagcctgggcaacagagagagactctgtctcaaaaaaaaaaaaaaaaagaaagaaactaacaggtgccaggtactaggcttttgatataaatctcatacgttaatcttgtaagtgaggtagtattatcattattatccccattttacaggtaagaagaataaagaccagagggctatccacaactgaagtatagacagtgggtgaggaaacatgaaccaaatggttcttccagactcagggccagatccctggcacaaagtgcctaccctgcattgccttcagctaacgtgccaagcagacagttcccatccttcaattttatttaatcaaagcaaagaattcataagaatctgcccatgttcattattcaggcagattaaatatttgatagccctgtagtttaattttttatggctcagagattggagtgaagtgctccctgggaagccacactgtccctgggacagggcagcagctggccaaggaggccagaggccgaggctccacagggctctgctcagcacccacgtgcatctgtcctgactccagtaagctgctcatgctgggtcccagggccaaaggttacagacactttgtaagtttgcaagagaatctacaaaaaggaaagaagggctgtggggacaggaggcttagggcatcacaaaatcagaaaggaacccagatgaaccaaaacatccaggtcccaggaaggggaggcagcctcctccttctgtctctgaccacgcagcagaaacaaagcttttggacaaatgcatgagacggcataagggcaggatcaacttgtccatctctctgccaactaaagcaccacagggccatttgggaccttttgcctgccccttccagccacatgtaaccttcacagtcactacatattcctcccagttcactgtctccctgcagaagcttgaaagtccacagagaacaagaagagctgggagccaagagtccttcacagcctcaatctgttctcctctggcctaaagaagctctctttcctagtccttttcttatcttcaaaatgaaattccagcagtttttgtctcagctaccccaaaatgcccaaatgtcatgcagcatgatttcaatccctgaactgctccaacccaccccgatgcccccaagtctctctcttgctctccttccctcctttcctccttccctttctccctccttcccttcttctctcccccatccttcctctcttctctctctctctctcacatacacacacacacacacacacacacacacacacacacacacacacacacaccccttgttcttctgtgcctaccatagaacaagacctaatatctaagaatttcactggtacccagtcaacatccaaccaattaatttgttcaagggtttagaggggccaggagaggagactttttcactccagcagcccacggagatttctgttttaatttctttttaattggcagcgccactaacagcatatcagaaatctctctgctccgacccttctcctctcctctgttctcttcaacttttacaagggaaggacatccggcagttttctggaaaaatagagacatgtcacagcagagcccagctcctttttcctgccatccctattcatcaccagcctcctgaggagccggggtggtgacacaggctctcacttcatccatgtggggctcatcggggcaggtgacgaggagaaaggcatgcgccactccccccagagatggggcctgtcgcctcctgggaaaactggggtggagggctctcttccccgatcacctggctctatcttgctctacagacacctcactgggccctcagtactctcatgagaagagagcagacttccagccacccctgcttgccactccaggcctctctgctgatgggtgtatggccacgggacactggaaataacaggagtgtgtggtgagggagaactgtttgcccattttccacattcaagaacctggtgaaaagatgagcaaggattatctccacactggaaccattcatgctgcaaaaacagcactgagacattgaaggggaggaggcaatttatttgctgtcttgacactgtcgcccaagcaattctcatcgtgacaaaagaacactctggacaatcactgcccctcctctttcaggaaaccacactgagttttcatgacttgcaggtgacattttaataaggaatcaacatggaaccacaggggaagtaagctgaggccaggatctaggaggaccagggtgggaggggccaaaaatggcactcaggaaacaaagtcacctacggtgcaaaggctctttgtgcctgcaagtctggcaccgtgggatttctggcttttttctcctctctcatttactatttgggcagaggggaagtattttccagaaaggacaaagtagaagcagcctcagtaaagagctctctagaaacttctcctattcagttggtgttttacaaagtgcaaagcactgcaggcacctccattcacttatcccgttacgtgggtgtcgttatctacatcttataggcaaggaaaatgatgtgcccaaggtcacagagctactgaaagaaggaaggagaaatcagacatttctgtgccacctccttatagaagttgccgtcccccatcataatccaattaatggtaaaaatcacaactgaggctagatatgcagtaactccttgtgctctgcacagtgctaagcactttacatcagttgtctcctattttaatcctcatactaatgccaggagagaggtgttatcactctcatttgtcagatggggaaatcaaggctctgggccatcagtcacttgtcccaggccacagaagcagcaggagcagaaccaggattcaaactgtgtgcccctgcctgtgtatctccatggttctcaatcttgcctatcatcagcatcacctggacaaatggtccaaacaagacatgctgggccccacccaaagagtcgctaagtcagtggggctgaaagcaagcctaagaatctgcatcgccaacaacttcccaagtgaggctcttactgctgatatgaaaactccactttgagaacctctgctctgtctagcctgcctcttgtcacccacaagctaatgtgagcatcctgttagacaagtaatggaacaagatgtgcaaaatgtggctgcaggaagttcacttcctgatgcacaaaatcgctccaagaaatcacacaccatccagaaacacttaagcatcatctgcattaaacatcaactaagggatgttctaagccaatttactctaagactcactctctccttcttctgaacctcctctgctgaaagtgaccatcttccagccagcccacctcatgatcattaaaatacagctgtggagacatagggagcacttctgaatgagcaacccccatcagtgtccactcccacgtgtgtatttgtatgcccatcatgcaccatatggtgctcatattacatacgcaataaagtgcacacagatgtaatcattttaaagagtgataaacgtaaatagaaatagatgtcttaacattttcttcccctattccaaaggatagttttgtgcatcccactttggaggctgctggtctagaattcactgttcccgtttctaatttctgatcattagaatttggcaaccaccccctgcccctgcaggctgaccgagcgtgtctgaagagttgctgtgctctgtggttcgaggaaaagccgtttcctttctgttagcaagcccctagagaacacaggctgaccctccaagacttgcccagcacaagctctgtaagtaaggatggctcagccaaagcttcttgactgtgggggtcttttctccaaaagagaataagaagcatctcagagcccatagagaagacagtggctgtctctaaaagcttttgacctaacaagcaagagcaggagactgagccctcacttctaaagcagcaggaggagagggaactggatcagggtcagagagcaggccttgggatcagcctccaccaataaccatgggtgagactgggaccacactgtgtcccccaaggaccaatgtccttgcttgtcaaatgagatatagggtgaccaaccagtattgtggggcctcccagaatgccagagtttagtgccaaaactgaaacacactagaatgtttggtcaccctagctgtggaccaggtaccgggctctgggcaactataagtgtttatcagccctaccctgacctctgctgtaaggtatcctaggagagcctgagggagctggaggccattccctgctcactagggtgttgcaatcctaacaagatagagataatgataagccatgccaagtcaaatgtcaataccaggtcaaaacagaagctggaaagaggacataatgtaggctgccgtggccaggacagaccttcaggaggagggcagggtgcaggaggaggcagattaagcacacactgaagtattctttcctcaacctcacctcatctcctccctccccttccccaccaccaagtagagcaggaccgcagagaatgaacttaggctctggagtcttcctgtttgattccaaatctggtgctacacttttccttttggagtgatctcgggaccattactcaaactgcatagctgaggtattgttttctttaaaatggagccaattataccccactttccagggttgttctaaagattcaatgaagtaatgcacacagaacactttgaaattgtggctgagagcacaagctctataaatattggctgttcttaacctctcttgacccttttcaatctgttcgtgaatctaaggtattttcaaagaacagtgagctctccatgagaatgagctatcctgaatatttctgttattaatgatgggtacagccggcttagttctgcttctatctgtcactcctgaagccagggaggatgagagggtgtgtggagagaaagtcacagggaagccagccctggccccgggcaaagcccaagggtttctcctggccctgtgcataataagaagcagcttcctctgtctccatttccagctcctagccccaagcaggcaagtcatggaggggtttcccttcctccctagtcccccaggttctgaagaaagaaaggttcagaggccttctccctctgcagaaagggtatgtcacctcaggccatgacaagtccccagctaagcatccgctcaggaccacttaaagctcttgaaaatgagctgtcttagctcatggcaggtttcaagaatccctgcaggatgaaataccagcagtgttccccataaactcagtcagcgatgttgatggtaggaaccaggaaaggtaccgtcctgcctaactttctctccatccagctcagccctagaactcaacacatatagtagaatctagatgagtaaacccccacacagacttggccctgaaattccaccattaggcattcacttctttgatatgaacttcttttctgtaggtaatacatttttttttggttgcctggtatgtcaactggaacacacttaaatgaagaagaccaagattcacctcagcctctccccttagaaatctcgcaagtcaactggggaaaacaagccacacagaagtgtaatacacaaaaagaagtgtatacttcttcaaaaagtatatacttttggtgcaatacacagaaagagagagaagtgcaatacaaaagagagagagagacactatcacacttgccctcaaagggatacccccaacaacactgcacattccccttaccacacccccattgcaccttcaacacaatatcccaataaaagtaattagattaaatggtcattgtttgtcatgggcaattctctcactgtactgtgagttccttgaggcaatttttctctttttatccccaaaatttcgtgcatgggacagagtaagtagtcaatgaagatttttaaaaattgttaattaaggaatattttaataaaagtaaaatggaaatgcaagacattttgagaagggcaccagcttaagccagtggtcctcagagatggccctggacctgcaacatcacctggggatgtgtaagaaatgcaaagttgtccctaccccagaactacaaagtcaggagtccccaggttgggctggtactgtgcgttttaacaaggccatccaggtgatgctaatgcccactcaagtttgagaaccaatgacttcattcagcctttatcatcagacaccttctgcaatatgggttaactgtcctcaactctgtgaatataggcatatattcattcaatatatgcctattaataagcacccatgcagcaaaggccaggtggagccagccctggtcattaggtggcccaacgatgtcgacaagatggcagacaacatggtgagtccctaagcagttactcccaaagaccctcaaaggctgttctgagccaacaggaagaaaggccaccaagttgtggctgtggccagctgactgccctttaggaggagctgtgaggatgagatttcctagcaggaagctgctctggggaagggggatggcatcctgacacctgggagcaacagcctggaccatggattgggaggcggagggaatggggcagggcagtgggccacccaccttgtgccattggctgccggaccctgagcactgactggtttggagcctggtgtctgggctggtaaggaagcaaaggtgaaaggggtgtgggataaggcaaggtgagggagcagctgagccagcatccccttctgatctgttgataggctccacatctaggcctcttctaaacaaaaaggctgagctgccggctcagcagcagctctgtgggtgcacagccctgcccatcatttccccctgtattaggaacaaccgcccaactctggcccctggggcaggcccagagcccaggggtgacgaggagacagcacctcagccctggaaggtaccatgtccaagtgctcctcagccagggcagccatgttctctggaaaccagtagaagtgcagaggacactctgttccccaatcaggggcaaagttgccacaacttctccagacttggttttccagggccataggtcacctgctgacacttcatttaaaccattctcctgttataaaaagggacagtttggccaacctctcaacttacaggccctttagcccagtgtggctagccggctcttcccaggcacccacaggccaggagctaggaatgcctgctccactcaaggcccacctgccccttcccatcttccccctctaggcagagggggtcataagggttgcaggagcctcagacaggggtagatgaccccagggcctacctgtgatctcagggcgatgggtagagctcacagggctgacagacaaaagatagggtgccagttacatttgaaattcagaataaacaagaaataattttttagcataagtatgtctcaaatattgcatagggcatacttaaactaaaaactaaaaaccaaaaacctatcttgcttatctgaaattcaaatgtaactggacaaccttattttctttttatttatttattttttattatttatttattttttttgagatggagtctcactcttgtcgcccaggctggagtggagtggcacgatcttggctgactgcaacctctgcctcccaggttcaagcaattctcctgccttagtctccctggtagctggaattacaggcacccgctaccatacccggctaattttgtttgtatttttagtagagacagggtttcaccacattgaccaggttgacctcgaactcctgacctcaggtgatccgcctgcctcagcctcccaaagtgctgggattacaggcgtgagccaccgcgcctggcctggacaaccttattttcatttgctgaatctaccatccttactctatcagcaagcccagaataggaaaacctggtttttccaaagcagagcttaatatcacaagagaaagagccttgaaaatactatagagtaaggcctcattcacatgggtgaggttgataatttacttcacaggtgagatgacagtatcaaggttctgtctggcctctggcctctggtcaattgattcaaactttggatcccagctctggtgcagctgtgctgcctaacctcagcaagtcactcccccttcctggtggtcagttgtctcatcttcaggttaggacagagtttctcaaccccggcactgttgacattttggtccagattactctttattgaggagggttatcctgtgtattataagatgagcagtgtccctggccgctacgcaccggatgccagcagcacccaccccaatttgccaatgtctcatgggaggcaaaatcatgcctggttgagaaccacggggttaaatgaccctatatcctaatatctagggctcccaccacttttaacagtcgagaattattgggtttacacatgaatttgtggcaaagattcctcttaaatatccaactcccataatgaatctaacaggagatgtgaatgaccagggtttgattacatgtaaactttttaaaaatgtatcctctacctcactcccctcaacctcattccagcattcagaaattgacctagcctgattccagcaagtggctccagctctttgatggccttacagacagcaatgacttaataatactaaaaaataaaattatcatcaccctgattgaagggaatgatttactggaacttcttgggcaaacagtttttgctagtttaatattaatatgactactactaacgatagagtgtgtagagtgcctacaacacgctaagaccacactaggttatgtcatttaatcttcacaatagacctaggaggttggtgctgtgcttattcacatttagcagttgaaaagaaattaggcagtttgcctaaagtcacagactctgcctgtgctctttccaacacagaaacagtctatttacatacagctctcacaggagtagggaaattcattcctccctgggcctccattccaggtaaatactcacagtctttcatctccaggaccgaaatctctaggaccacacagaaccccagtccttatagggctgccacgtacagacaacacactggcttgtaaatgtatcttgaccttgcttttaccttgaaccactctttgtaactccagggcctactgtaggagccctaatcagccctactgtaggagccaggcccacatcaggcactccctcaataaatggttgctaaataactcagtgttcccccatttcaaagatggagacactgaggtccacctctttccgtgcaagtcattatctaaaagaaaaccaacgctggctctcaggttttgtttgtcctgaatccaaaatcccccacagtgctgattcactttgttttcttaacttgctcttaagatcccacatttccttttgtattattagtggatggagagttgattggatttgagtgacctggttgcctggtggcccaaaggactggcccaggagaccactgaagagttctagagcctggatctggaactggggcctggaaaatcgtgtgtccgtgccctcagttactaggtcaccttgagtggggctgccacattgttccatggcccagtttcccctcggacagcatgctgagtgagattccccccacggcgtgctattattacctggcacaccaaggaattaggccactgctacaatgaggccaccccgccctccaagattcttcaaaattctgctccttagagcaggacaacagggcaatgtagggcagtggctccaatttgctgaggactgcaggatgaaagagggcatcttggggtgactgggtgaacactgttctgggacacccagctatgacagaagggaccacagaacaaaagggtgcaaactgtgggcctcaccctggggggaaatgggtttagaagtcatacacacacacacacacacacacacacacacacacacacaccctacatataccaccagggagtctaattttagtagccatttgccccagcaaagcactttgcaagtagttattttgagaaatggtattagccattcggttatttttaatgccccttctgtgacaggcatttgtgacataaacagcagctgaaagaccataaacccatagcccttagatgtgttcagggcccaggcagcagccccttgggatgtcccaagcccaattcaaatggagggaatgggcgagcatcttgtacgccctgccggtcccgcctcactgcctactgctccgttcactggggatgggcagcaagatttgactgaatgggaagcccctctggtctgtgacagccagtgtgctaatgacaaccttcagtgcttgccgacagagtgcaggtgaaaatccacactgctaatgaaggtccctcgtgggctgtccccaacctgatgttctcagaccctgctcccaacacatggcttccacactctctgccttcccacatcctcccctctgctcaagctgacctctcatttggatcagcccactcctcatctctcataacccagcccctgctgatctgcatgctctgattccccataatgaaagagctggatcacctccttggccttctgcatctaatagcttgaattgttggccacctgtgtacttgtatttcttattgaagccactgcatttactctgtactgaggatgcaccaggcatcattctaagcccttaatgaagttcagggaactttcctgaggatcctagctggtatcatcatcatctagattttcgagatgatgaaatggaggtatagggaagttacccaaggcttctttgcaagtagtgctctaagcaagactacagatgcaagagcctcacggtctaggtctaaccctggttctgcaccttggaaccatggacaagttcgtcagtctgtgcctcagtctttccctgagttcctgtaaagattaaatgagttaatgcttatatgatccctttacagatgtctggcacatgacaggcactgtctaagagtcctcgcttgtatgggagtggagaggagaggccagagtattgtaaggtaagatgtattagtgcctacaatgtgttatgcaatgtactaaagcattctgcatgtattatcatatttaatgctcataataccttgtgaaattttacaaagaaattaagcttagagaagtgaaatcattctcctgtggtcaaagccagtgaatggggatttgaaccaggtagctgaacacaagtctaagtttattaacctgaatcctctgctggttgtcttgactctctggaaactgatcatgtcttcagatttcccacagttcctggcactaggttgagcactctaaacagattcaatgccaattgcaggcttctgacaaggcttcctaaatgcagagccctggctgcagatcaggagaccctggcccctccaagggcaccccggctaatcagcctcttcttctgacttctgactccaccccaggacaggcatggtgcttcgaaagcagaagtaaggcagcagaacacttggagaagcctcgctgagggccagggcctggtggttcggatggcagcaagctgcccccagggacccaaaacccaaaggtcaggaatgtagtactggccagccagggcaggcactgctgtgtggtagaagagaagtccagaactgtgaggcgtcaagcgtgagttggaggcaggatggcagtgagaatgcacgcccaactgagcgagtgcgtgtgagtgaattatgtgtgtggttcagttttaggcactgggcagatttgcaaagctcatcaccctcctagagttgcctgcaaaaggccacatgtttaacaccacgtcaatcaatcaacggaggtgcactgggtggggagtgtgtggccaacccagcacggggagccgtgcagctgcagggaagagagcatctctttccccagtggctcatggtcatagccgaggacacaagactggcccttgtgggaaaattgaggggacctgttaaatgctgacctctaatgtggttccagttgagtcaccatatttcttgtgaacctccaaagcactggaagacttctgggcctcgcgtggctgcaggtgaaacatacagccaatcactccaccctggagtcttggtttcctcccctgcagaatgagagtgacgctgataagacatctcaggcagaggcgaaggaggtgagccctgtgggaatttcggctgcccctgtgccaggctgaacaagacagggcctttgctttctgggggctgatgagtcatataaaggggatagaatcaaacactcaaaagacaataaccgcaacacagggctgggtgaataaatacacaactggctactcagaatgggataaccatgggagaggacttttaatgccaaagaaactcaccacgttgcctttgactttgaaaagtgatctgtgcttaatctggcatttcgccaattggaccatgagcaatggggtcccagtcctcattacccagtgcctcctttgcttcaggccagggctgaataggtacttaggacattcctaagaaggactgtgcaggaggaggctagcccagctgcctggctagcctcagcacacacattccctggaacagcagcctcgcttactgccagaccccacaggggtttctgcaggggctggacaaacgggcacatggggatgaaaagggtagagtccccagagtcagtcaatgtcagtgaattggcagccgctgctcacagagctgtctggattctttgcagcccagagagcacctttcaccacccagatggggaggccttgccaaccctgagcccctcagggaggtcatacgtgtgattctcagacaccagagggagcagttttccagagagtgaagaaatgggatccgggaagcttggtgaattcgtctgctggggctgccatcataaagtatcaaaaactgagttggattaaataatagaaatgcattgtctcacaggtctggaggccagaagtctgacatggagatgtcgttggggtcagttccttctgagggctgtgagggcacatgtgttccaggcctctctcctagttttcttgtccttccttggcttacagattcatcaccgcaatctctgccttcatctttataggcattctccctgtgtgcatgtctgtctctgtgtccaaagttcccctttttataaatatgacaccagttattttgggttagagcccacgctaatgatctcatcttaacttgatcatctgcaaagaccttatttccaaataaggtcacattcacaggtacggagggctaggacttcattatctgttggggagacacaattcaaccaataatatttgagttcctcaaaggaaaaacagctttttaaaaagccaaactgaaattcctaacattactaatatactggaacagagtcccaagaagtaggctcaatgtgtgaaggagcttcccggttccagcccccacgttaccccagcccaggcctttgtggcctcccgcctgcactgctctgtgatgggccccttgccggctgccctgacttggcctgtctcccttctgctacctccgcatcaggctgccacaccttgcatctcaccaccaggtccacctcggtcacgacaccttcctggtctaaaggccccagtggcagtcaaccacccagagggctgactgtggctcactccttttgacttcagcacccttggtaatctgcaccaacagaaacatcggccaatgagtgccgtgatttctctgcccgttttctcattcatgaaagggagaaaaaacgaactctccatgcatctactcccaacacattcccctgagaagcctgcggggaagctccctgggagcccattgccaaagcttccacctcatggagctggcgtgtacacagacaggcacagcctgccgtgctgggccaccatactggtgactggctgtgctctggtcccagcccaaggggtgggcaaaagaggaaagccagcctcatgatgagcagaggacagggaagagacccccacaccagggactgacccctccattccctcagaggaagcagaggctactgagccaccagtacccccgcggttcctccctgtagttgctcatggaaagccaccagcctcaggaagtcttcctgtgtggaagctcactggcaccaaggcaggctgagcccctctgccaaaggttctgggcagccatcggtctgataaagacacagagccctccttggaggcctggaagccccacccctagaaggtggtccttgaaagctctgtcactcatttcttctccagagcccctgaagcatcctccatgcagctgtgcccacctgaccatacagcctggccctcccttagcagcaccctggactccattcctaccacctccttgacaacagaatcctgtctgtcaccctcctcaccaggtgcgggtcttcaagataagagaccacctcatgcatgttacaaggaatgctctagaaggagcaccattcaagaaagagaggacagggccgggcacggtggctcacgcctgtaatcccagcactttgggaggccgagatgggcatatcacaaggtcaggagatcgagaccatactggctaacatggtgaaaccccgtctctactaaaaatacaaaaaaattagccaggtgtggtggcgggcgcctgtagtcccatctacttgggagactgaggcaggagaatggcgtgaacccgggaggcaaagcttgcagtgagccaagattgcgccactgcactgcagcctgggtgacagagcgagacactgtctcaaaaaaaaaaaaaaaaaaaaaaaaaaagaggacaggttgagcgccctgtcagaccagtgggcccccaaagctatataccatgtttgtttacctacttgatttctcaacatcactgtgagggagctatgaacatcctcattttacatacaggtaaggtaactgaagttcagctagattaagtgtgttgaccaggacacagcactagcaagagcctgaggacacctggctcctgctgtcacctggctgtcttcacctggtgtcccacaagtacttcaaactctgctctccaaagctctgctcattgtcttcccactcgccatccttaccagcccctacccacactaccttgctcttcctgaatcctttgtcctcactaggacaccaccctctactctgctgaccaggcaaacaaaaggacccaggcgaacaaaaggaccagtgttgcccaaggcctctgcagaggtctgtgcatgcatctcagagagcgaactaaccatgggagttcagcactgatcctattgtgtccttccactggctttttgtctgagctcccactggaaaaaccctgcattcttacttgatgaattttcaaaagcagccagggctttattatcaactgtcttttatgaataatcaaagtccaatggggactccctaattagcctgggcatgaaggccatttgcataacatattgaatgcctctggagtgtcaggtacctcagtagacatgatggttcatgcactaaacctcagcatgtgaccaagcctatggccagacacagatgaacttgaaagtgatgcactggaagtcgatgccccttgagggtgggtgagctcacagagtctattcctgacactgttgctctcacctcgtgacaaagaaccaatgctgctttcttgcatccacccctgagttccagaacccccgcagacaggcttccaaaaactgtgtccccaaactaagactgtgtgatatgtaagaagaactggcaggggacccaacctatattataaaacctcttgatctcctaaaagagagctgagtttaacccgacttagatcaccaggacagatgctatcacagaatcttagaatctgaggttgtaatggtcttctccaattcaatatcaaatccagtgctcccagtcctcttctcctaggactttgtatttgaggtggggaataagggagaaagtggaagatgtggctaacttgcaggtgagtaaaggagaagtcaggaagaagtagtgacttgtcccccaattcccacactcaggagcatgggcagtggagggagaaggatgctgccactggcttcatttacatttgtccatttacaaataccatggcaacaagagctcaggcatgcaatgccctcctgcccagattcctgcttcaaaatcaaaacaaatccagtatgcctggaaaacctgccacagctcagcaaactaggaacaggtgccatcaatgtgccaaaaacctaaaggaatctgaaaaaaaaaaatcagttatgcagaaaaagagaaggcagggaggccccttgggcagctttgctccctgagaagcggcaggatggttgtgaaacaaggagtgaggcccttgaagaacctcacatcagagctgcctacatcagtagggctgaacagggaggtgagccaagtatcaggcaccgggactccctggtcactatggatcacagcagtgttcagcagcagcagcagctctgagaagccctgggaatcacatggcagatacatccagaagaaaactggccagggcaggggcttgtccctgacacagcaggtggcagctccaggaaggaggacaagtccaagcacagtttgtacctggcatgttggccaggttaaacagcaagccagatgcaaacagttggcacaaggtgcagtggctttaccaaacacagagaagaaatatcacaggattaagttccccttctggaactattcatggttccagctcactcacccagactcacaggtctctgcaaggcttcacttcatcatccagtgctctagtgcaagatccgagagtagcattctatgggcaatgaggtgcacagcagaggagcccaagagaattgaccctccctatttacaggcaaacactgactgcattcatggatgcaaaacacgaaaacctcccaccagaccttgaaaacattcttaactataaaaggtagagaatgcagcactcaaaataaataaatttgaaaaaaaaaaggactgggtgggaaagtgccattatcatcatggccaagagcacaggctctgctgtgaaactggctggacctgagtcctggcccccagtcagtacccagatgaggctgagtagggctcaaccctctggacatgcgtttccccaatctatataatgaggacaaacaaagcacatgccccttggagttgttctgaggtaatgcacacaaagtgcttagcacagtgcacagaggacagtctgtgctcagtaaacaactcgtgtgatattgtgataattgaacttggagaaaccatctattctatgtctgcagtaaaagtcaagagaacttatttctgaaacaagatgtgttatgaagggcacatttagaaagcactctcaaaatgaagaggaaaaaaatacagaagcagaaatactgtgaggtctaagacagattatacaaaaagatgacagatatagaggacaggcagccaattcagaataaacctaactgaaaagacgaaaacaaaaaaaagtttcttaacacagaagacagacccaagtctgaaagtcaaaatgctcagtaggcatgtatatatatatatatatatacacacacacacatacacacacacacacacacacatatatatatacacatacatacatatattttaatttcatggtgaagaattatcagcatccaaacagaagatatcagattatctatgaaaaaaaaagagaaaaatcaagctgatatctgatgtctcctctgcaaaacccaacagcagggccaagttgtcattcatattaaaagaaacaaagtgcaaagtgcgataaagcagaatacgttgttcaagaagattaaacaggtgttaaatttttcatatttgtaattaagacattaatcaaaacaaggaattcaacaacaggagatgtccatggtaataaagatctggcaatgaaccctaagatctattaggtttaaataattgttacaactgtgattacaaatcaaaatgaaaatgaaaactaaaatttattggaagagaagataaaatgtgaaaaatataataataataagtagaagttttaaatatcagattataccataaaagcatgagtgtaatattatggaatgggggaatgaaaagaagaaaaattatttatcttacgtggcaaggagtaagaggctatttcactctatacattaaccattggcaaaatatggttgaacaatagttttaaatacttgagaggcagcatgggtagacattccaatttaataaagaaaagtataaaataaaaaatttaaatatctattacagatagacaaaaaagactgcaaaaagcattttttaaaaaacagaaaggccaaaacatattagttattacaatcaaaatgtgtggtacacattatatatagtattaactatatgcaataatatataataaataaatatataaaattatacactgtttataagaaatataccctaaaccaagtgacaaaataaggttaaaagtaaaagaataaaccagaatatgccaggcaaaaatcaagtgaggctcacacctgtaatcccactgctttgggaggccgaggtggcaggatcacttgaggccaggagtttgaaaccagccagggcaatatagtgagacaccatctctaccaaactgtaaaaagcaagctaaggagtgatgccaagttaaaggcaatggtatccaagcaagtgaaattcaaggcaaaagacattaaataaggcaacacaggaggtttcacattgatggagataatccaaagtgagtatctaaaagtcaatgacttttaggcacaaaggaagcctcacaacacaaaacatcaaattgtcaaaaataagaggagacaagtgacagaaacccagtagcagtagaggagtttactgaagtactattgctctctcatatattaagttgtccaaaactaaacataattatgggtgattagaaggctggaatttctgcgttaactggtcaactggagagaactggtagaaagctcaaccctctggttttggaggttggaaactgagacgggatgatgagtcagtacagcacagactagtgtggtccctgggctttacctcaaatggaaacttattaaaaacacacattctcagacctatcgcagacctgaccgaaatcagaaactctggagtggggccaagccctccaggttgttctaatgcaggctcaaggctaagacccaccaaggcaacaattaagcccataggctctggagggccagggccaaatcctgccccatttcagcattgttgggtgacatcaaacaagttgcttaacctctctatgcctccattatcatcatccataaactgagaagaagaagaatagtgcctcctcttggcatggccctgaggacaagatgagatcatgtggacacaggctcacagtgcctgcacggtgtgagcactcattgatggcttgctttggttcaggaatgcttggcagagctgtgcctccagccccactgctctcctgcctcccaacacccagaggtgttgagggtgaactcctctgcacccaatcctctgtgcatgtgcctgaggaggatggactgtcccctgacaatggatggatgccacctcatggctgatcactgctgcatgaggcagtgtcataaacccctccttgatgctctctggctggagcggccagttgagtgactcatggagcttgtcatctcagggcctccttccctgatgcacacggccctctatccctgccccccagcctgattcctcctccccctggcaagactgcagagctgagcagaggctgacccgatctgggcccctcgtctctgcagaagagagaaagccagcatgcagcggactcctgggcaagttccaggatgctgtcctcaagtaccacgtggccactgctacccatggtggggtgggagcaggggcaggcagaggccttgggccacagaacaaattctctctgtctgtgagcagaccagggtcaggtgtgtcctagttaaatcaaaatgtcctgtggggcaggaaacagtttttccactcataaagatgcagttcaaatttgagatgtgtcagggatttcactgtggctgactgtgtgtcatcatgattagatcatacactcgagcattttagagctgtaagtccctatggaaatcaccctgtgtatccccctcctctgccaggtgagacccatgaaggacagagaggccctaaggcagccccaaggtcacacaacataaaaatctaacagcaagaatggaaaagaaactgccttctaccacattgggttgccatgaaacctaacagctgggggcgcctgggaagagagaaaaagtcacgaagtttcttcctgacactcccactgacaatcgtgattctgacaccagaaatgccttttcttcatagcatttcccttacatggagaaatacacctcttgtcttgcttcattcacagttaaatatgcttaggaagacgaggagacggaggcccgtactcttgagccacccacctctgaatccacctgcctctggatccaccaaaatacctgcccttcctatttgcccgaatgctctcatgtttcagagccctctcctccaggaagccctccctgcaaacttcatcttaccatccccttttccatcctggatactctagagaaatcagagctcagattgaagctgagtcctcagactttcagttgcgtctgatttggaaggagaaagaagaacccccacatctctggcacccccatggacaccaagagaagaacttcagtccatctgacagcaaagcctgaactctttcttcactgagttcaaatttgcctctaccactcacccaccctttgtcatcaggcaagccacttacaactctccgagcctcaattttcccacctggaaaagggcaataataataataccttcctcctaggttggtgtgaggattaaataagattacatgtgcaaaagctccaagcacccacaatagataccgaactggaagtcactataataaaactgataatgacaacgatagtgatggtgataaatatcattagtgtataatccatacttggaccaatttgggttttttgttcaagaccgctcggtgagctgagtgtggcggcacatgcctgtaatcctagctgcttgagaggctgaagctggaggaccgcttgagcccaggagtttgagacaagcctaggcaacatagctagatcctctcttctaaaagaaaaacaaaacaaaaccaagaccacttggcaactctatcaaagaaaggtaaacaggtaagagctttttgggttaaaatgttgcagggatctgaactcccacccctctaggccagggaaggagaatgggagtggtaagagacttcctagtttaaaaatataacaataaaatccatcttccaaataaaaactgacctagtacacattttggattttttttctttcttccaaagctctgagagttagttgaatcctttaaaaagacagcatgctcacctctttctccctagcaccaatgatttggagagacagatcacttcacttctgacattctagatacatctatatgttgggattctccgtccacccagctagggcattctatgaagccaagaatttagttctaagctcccaaaggaagctctatttcaaaaagccgggtggctttatttcaaattgaagaggccattaaattcacaatattttgccaaatgaatttctcagtgatcctgagcaatcctctgaagtcagctgtccttgtgcagtcatgggcccagcacagagcaggcgtacatactaagcacctgttccagcaggtagagacagtgtagtgactgggacaagcctctgccctcatggatccagcactccttaaacaatttctgaagaaactcaggggagccagtgactggtacattctctgtttgagctgccacaagtgctgcgggatttttcagtgctggaaggggtccccaccatattagcaacaaggtatcaagtgccaaacactgtgcgacatcttacctaagttttcactgggcattttctgtttagtaagtcaggcactgagggagggaacatgtgacatgtccaatgttcagcttggcaaacagtgaagagggggtccaatggggggcagggcgcaggtggctgggatatggtgctggagggtctctccacatagggatacaattgggtagcatctccatcagctgacgtgttcccaattgtcctttcttggttatctgcctgcctggcaagaatgtgtttcttacactgccgccatgagcttacacttcactcactatacaatttattccactcacttttcacagtgatagcaggttgcccatatggctttatctcttctggaaagggagagtgagcatgtcccttgccccatcaccctccagatatggtgtctgtgcagctggcaggattggaacccagttctgtttcactgctcttcaagtgtaaccttcatcatagtctacaccctgcagaggagaagccatggagtgggaaggcagtgatggggaaccgagcaaccgagaggggtgccagactagcccagatccttgcaaactttcccatgacagccctgaaggcagaaaagaagaaacttttacctcctacctcagggagtctggattagaatttgaagcaagccttccacaagcagacagtttctttatatatattttaaattttatctttttatttttgttatatttttagagacagggtctcactctgttgcccatgctggactgcagtagtgcaatcatagctcattgcactatgatgcaatgaactcctgggctcaagcaattctcctgcctcagcctcccaaatcactaggtattacaggcatgagtcaccatgtccagccaggaagcttctttaaattgttgcattttatcttttaaaatatgtatgcatattttattcctcctcatgacaaatgtgattgaatacaaaataatattcattcccaaaccttcaagaagaactggttctccaggaaaatgtgccatgattatactgcagcttctagcattccctgtgaggctctgggctgtgcacctctaatgctggaaagtccaaatccaggagactcgggtctcctgagattccttggccatctgttcattcatgccatccactcactgattcagggcccagaggagcaccagggttaacggctggcggctgagtcagcagctctcaaggcaatcaccttttccacctactcatgaatcactaacctgctgcccccttgctacgtgcctggaaatgcataaatgtgcttaaaataagtggtacctgggtagcaagtttctcaccagcaggaaccagtccaagtgagtacagggcaaatagcagtgcggggtgaaaataaagactgactaccactggcaacccttggtcactcttcatttattcatccaacattgctgaatatttgccctgtgcaaggctccatgccctggcaatggggggcacttgaaggcaaataagagctttacaaggctctaggagatgtcactagtattccaaaaaccctaacagaagatacaaaagattagtgccattagagaggaaatggggtagaagctttggttggggggaagctcattagttagaggagagagatgttacttctaacttagaacatcaaaaacagaagcttcctggctttagccccaggccatgaagaatgagtggaatttcaggatacacagacaagaaagcagaaaagataaaatgaactcccacataaggcaggagataggggtgactagttatgtgggttgcagcccaggaacacagggaggaatgatggagatctttgagcaccaagaagagaagtttggactttttgttttcctttggttaatgaggagccatgaaagagtatttgtggaggaaagtgaagtaattagctaacatttagaaagtttaagtgggtagtaagatgtatgactaatcagaaatgacagagtcacgagaccagctggaagagtactgcaagagtccaagcaagcagcaatggaagcctgaactagaaaagagacagcagcagtggagaagagttgagccacgaggatttggcaactgactagagaaggcaccaggagaagcaagtccctgaaaaccatgctgcttgggaaagaccaactctttctctcatttcctcttagggaattgtaaaaggaattccctatcaccatttaaatttggttaaattcaccaaagagtgatggggtgaatcactctttggtgactaacccctctggctcttgtgtagagctaattagagtttcttctggaagatctgaaaccaccaacagtgagactcctcagatgaccctgatgggcaggtccatgattcaatctgtttcttccagcatctccccactggctgcagcacatctaggggttcaacctaagggagcccccctactctgggtatggttagagctcctttcaagatcattctaatatcaaaagagggaatcttcaaggagccttgttggcttcttatacttagagagaaaccaagaacacagtcagagttgatgtttttaaataccaaatctgtatgcatctatcagagagacagagagagaaagagagagagagagttagagagagacagagttttgaaacatggagagagggaaagagagatgttcctagagagagagagagagagagagagagtgtgtgtgtgtgtgtgtgtgtgttagagagggagagagacagagagggagagagagagagagagagagagctttgaaatatgaagagagagagggaaagagagatgttccgagagagagagagagagagtgtgtgtgtgtgtgtttgttagagagggagagagagagagagagagagctttgaaatatgaagaaagagagagaaagatgttccgagagagagagaaagagagagagagagagagtgtgtgtgtgtgtgtgtgtgtgtgtgtgtgttagagagggagagagagagagctttgaaatatgaagagagagagtaaaagacagatgttcctatgaagccctcagctcctaaccctctctctggctcagtgtttgaagcccctccagccgcccatggcaaaacttccttccagaggagcaggccatgcatcccagacccatgtgtatgctgtcccctaagaatgagagcagtgctctgtttcccaaatgggcaggggaagcaaacttttgtttccatagtctataaaacatttttaaatttaaaaacaaatgctttgcagcctctgaattattagttttttattaaaaatacaaacagctctatggaacaccatgggaaaatgaggactcttgcaacttcgtttggctccctgttaaacagaataatgttcatgaggaagaaggtactgtttgttccttaaaatgttgtattgcgtacaatggagaagagcaacgtggagatgactttccaatgtgttcccttgaaatgacctgaggaccgaatcaggaagctcagtctgaccagctcagcagactacccccactgccccatcccagagctgaacttgcagtcagccctgataaaaatctctggactagaaccagagcaccaatatcaagggattatccatgaactgactgttctttcctgcaggcaggctccacgctcctgggtggccagagtgccaatcagccctgtcccagtgctctaacgaggtgcccattcactgcccaagagacaacatgcccaagctatgacccagctccaagatctgaagggaccagactgccttcctgtttttctctgcatcccctgagctccctcttgaaaagggaaggaaagctaacagaaaagccactttctcacacacttttggtgagatttcatgaaagctgcatgacctttctggaaagcaacttggcaatgtatagagaatcttaaaaaacatgtgcatcctttggcccagcaattctgcttctaggaatctgtcctaaagaaacaagtctgtgatgtaaataaaaatggacatattcagttcttgactgcagtgcaacctgaaacactgaaaaactgaaaataactcagaggaccaacaatagggagatggttaagtaaactgcagtgtatctacttgggaaactaatatgcatcatttaaaagcatagcttcaaagaattattgataaaacaggaagatatttatgtatgcatctaaatgcatagagaaaagagtgacataaaacattcaaatatgaacagcaatcatctctaggatttaactgctgctttcatttttatttgattttattttgagacagggtatcactgtatcacccagccggcaatgcagtggcacgatctcagctcactgaaccgcaaccccctgggctcaagcaatcctcccacctcaacctcctaagtagctgggactacagatacgcatcaccatgcctggctattttttttttttttttgtaatttttgtagagatggggtttcatcatgttacccagggtggtttcaaactcctaggctcaagcagtctgcctgcctcggcctcccaaagttccaggattagaggcgcgagtccccccactcagcctgctttgacttttatgctctttttattgtggcaaaataaatatcacataaaatttaccattggaaccacttttcctttttcttttttttttcttttctttttttttttttttttgtagaggtgctctctccctctctctctctttttttctttttgtaaaggcatgatctcactacgttgcctaggctggtattgaactaagtgtctagttctatagcacgaagtacattcacattgtggtgcaactatcatcaccatccacgtccagaattttttcatcaacccatggtgaaaccctgtaaccaaaaacatctccctattccctccacctccagcctctggccaccaccattcgctttttgtctctgtgaatttgcctactccaggtatctcatataagtggaatcacacagtattgtgttttgtctttttgcgactggcttattccacttagcataatgtcctcaaggtgtgttcacccatgttgtagcatgtggcaggattaccttccttttcaaggtagaataatcactgtatgtctatgccacattgaacggacatttcagttgattctacctcttggttactgttttttgttgttgtcattttgttgggttttgttgttgttgttgttgttgttgttgttgttgttgtttgacagagtatcactctgtcacccaggctggagtgcagtgatgcaatctcggctcactgcaacctccgcctcccagcttccagtgattctcctgcctcagcctccagtagctgggattacaggtgcacaccaccatgcctggctaatttttgtctttttagtagagacggggtttgaccatgttgaccaggctagtctcgaactcgtgacctcagtgatctgcctgactcagcctctcaaagttctcggattataggcgtgagccaccatgcccggccctacctcttggttattgtgaataatgctgttatgaagatgggtttgcaaatatcgttttgatttcctgcattcatatcttttggttatataccccaaagtggaactgctggatcatggtaattctatgtgtcatattttgaggaactgccatactgttttccacagtgaatgcatcattttacattcccgccagcaatggacaagggttccaatttctccacatcctgtcaacacttgttgttttccaacttttttgataatagccatcctaatggatatgcatttttatgcttttatgtattttcagaatctccttcgggaagcatgtggtatgtttataataagaaaaacaaaaattaacgttatgttttaaaactgtgctagggaatggctcactggatgttatccactttactcctcaatgctgctgggctaacagtcctcctcccaccctcagcaaggcacagctaaattctggggatcattagttgtcaaacaccaactctatggcaagtggagtgcaagaccctacaaccttatggggctgatatcataacccaattagcacaatcccactgctgctgcttggaggcctggttctccttccatgagtgttgctcctttctccccactcctaccccccacttcaagctccaagcgatgacaggagtatagaaaggaaagaaaagagatttggggattcacacagtcctggggtacaatcgcagctccacagttgctcagtgataagataagcaatgtcaccttcctggacctcagattgctcatctgctaattgggtgatggtatcaggttcataagtttgtagggtcttgcactccacttgccatagagtcagtgtttgacaaataaggatccctattcatttctggaattgtgcatagcttctgccacaggaagaaatacagcatacctactagtaaataccacttaattgactgattgaaagaaacccgtcactgtgaggatcccaattcaattatttatgtcctctcctggaagcctctatggagtgcaggtttctcaaacatagtcctgttctcttctcctcaaacaaaggatctcaggatcaaataagcctgggaagcacaaagattgttatcttcaaaaacagcaaaagaataataattaacatatgaaaggtctgtaaccaagaaacctatgtttctctggcaagaccctgtctctacaaaaaaaaaaaagaaaaaattagctgggcatgggggcacacgcctgtagtcccagctacttgggagcctgaggcaggaggatcacttgagcccaggaattcaaggctgcagcgagctatgacagcgccactgcactccagcctgagcaacaagaaaggccctgcttctttagaaaaataaaaaaggagaaacctatgtttctgaaacatattgaccactgaacacctttttggcataacgccaattaacaacacatggagatgactttccatgtggaaacacatggaaataacatatctccaacacatggagataacgccgattaacaacacatggagtgagcagtgctgctccactcctcatccgacctgaaacctggaagtctggttcctcaaggacatcgagccttgaatttccacatgcaaacacctgtgagtatgttggggctgctgcagatcagcagtctcaaaattcatagagcatgagaatcaccaggaaggcttgttaaaccagcgtcctgggccccagcctcagtttctgattcagcagctctgggctgggacccaagaatgtgcatttctaacaaattcccaggtgatgctgatgctgttgacccagggaccccattttgagaaccactgatgcagacagtcaaaaacccctcacatacaagtttaatacaggaccatacaggaaatctgtctactttctgcaatgccaaagaaatcaagtataattcagaacttgaaacatccattctcttctgggacaagttcttaaaggaagcatttcatagtagttaagaaaatggactctggagtcagaaaagagcacgtttgcaagtcccagatctcccagtgcctggctgtgtgaacacagcaagttattaaaacttcccaagccacagcctctttatctctaagggagagaaaatcatggcaatgcctagttcatagaatttctgtgatgcagaaataaagcaagcaggatgcttggggaatgcctggcatctagtaagtgctcaataaagattggttattctttttaatgactgttatttaatcatcttatctggtaaatagctcatctgcgtactgtcagctgacctcaggatgtgactatacagtcgtccctgtcatgggcgaatgcaggctgatggcacaggggtaaaagaatttaccaagaaaatcataggtcaagaaaggcagatttattagagaaagtggggaaatatgttgcctgagagacaatgggcaagttagcctgagagaagctaacttccagaagacaaaagcttgctgcagattttagagaatggaacttgggctgattgataatgccaaggcagcagggagcttaacttgcattcctctgtcagcctggatgtttgataaattgaggtgtttgatggtgagcaggaagcccgggagttatgtatgttatccgggcatgaaggccaaatgtcttgggtcatatatcctgggccatatgccctgggccacaaagaaaggcagacctgtaacttatctggtttctcttttgtttaaattctctggacgtgaagaaaggcagatttatagcttatctgctttatctcttgctttcccctggtcccaccagcctgactccttttccctaattaggactccacagtccccccttatccatagtttcacttttcattttttcagttacccacagtacagtacaatgaggaatttttgtgctctgtaatgagacagagcacagtcacatgacttttattacagtatattgttataattgcacaattttattattcattactgttgctcatctgtcactgtacctaatttataaattaaactttattgcagatatgcctgtgtaggagaaaacacagtatatacaggtatcggtactatccatctgcagttccaggcatccactggggtcttggaatgtaacccctaaagataagggcatctactgtatttggagacagggtctttaaagaagtaattaagttaaaatgaggtcattagggtgggccctcatccaatataactggagcccttataagaaaaggagattagggcacagacttacactgagaagacagtgtgaagacatggggagaagacagccacctacaagctaggcagagaggcctgtgatgaaaccaaccctgtcaacaccatgatcttggacttccagatagtaaggactgagacggtatatccgacttgagccttaagtccaagccaccgttccactattaactcccaccaggacaagtgcagtggcctgaggggcccttctgcttccactcctgcccttactccctggccttactgttacaagagtgaacttcaccagtgttaaccagatcacacgcgtggctgcctaaattcctccaatatgtcacctaatactgagaaggaaatccaagctcctcaccatggccaacaaagccctgaaaaacggcccctgccagcctccccctacccagcatttcccccacccccaccatcaccacctcatgccctaaactccactcagagtggcgtttttgctgtttcagaaacaagcaagctaatccttgccaccaggcctttgcactagctggtgctactacgtggaacgctcttcccccaaatttcctcctggctggcttcctctgagttcaaatgtcttctcctcggagaggcttttcccatccatcacaaagaaaccctcagcatcatctcacgctattgtcttcctacaagttagcagtagcttatcactgtctccctgagagcagccaccgtagctatcgaatgcactgctgcctcccgggagcctagcacttattccaaggccttggagcttagtaaatatgtgttgcctggataatgtatgtgaaagagctttgcaaactgtaaagtgctgcataaatgtaagataatgtcacaaatatcaaaaagagccagccaaataattcaaagaaaataggaaacaaggggagaagagggatgaggaattcagaatgaagctgagagatttcaagtgatgattcaagaaataaaccaagcaaccaattttgttaaatatgtgaggccacagggcgagggaagcacaaaccactccaatgatccattcaggccatgtctgctccactcagccatagaaactgcataaattacaggcagcagcagttttcctggagccaggcagtagaacactctccttggtgccggcctgggaggaggatcctggcctggcaagcagggctgactcaagctcattgcattagccctcccctcctgcatctgggcccctctcaccgcagtgctgcctgcccaggacctgcactcctccagcgggcgggactgtgactcacagatggcctgtcactcccagtgccagcacagagcaccacccgtgcctatctttagaagtttcgcaggctgaaaaatcaatttgcccgcctggcacctgggtctggggcctccccgctaacatcagtggcaggcgaaatgtggcctcccctctgcctgccctgatgcgtcagaccttactcagggtcccgagggcctggcagtgccgcccaacagactcctgtgagctgctgcacccacaggtgtgctggtctgcccctcagagatagccaggcctcaccagaagatgcgggcaaacaccacgccctagaaaatactggcaagggggaagcgaatcactttgcatcctggctgcctgactggcacattccccaggtggtcatctggcacctaatccatgtgtggtcacagcaaactggcttgcccaggtggtacaagttcagcctcttcctccaagcagggaccagaggtaagagaacagcacacaactccacgccttaataaaaaggcccaggaggcagattcccaacgcagtgacaactcccagctggcccccaggcttcccaactactgaaaatggccacatgtgactcccacaagccaaagggaccctgtattactgggtatgcggagagagaaccatctcagacatttcaccatattaataatctctctttcaataaagactcgctgagcacctggcagtggcagggtgggtggaatagggtaagaataagctgaggaacaagagaaaggaaatctctggccctggccctgtactttctccttgcacctgtgggcgctctgtgctcagcctttgagatttccaaatcccctctgaccttctgcctcttcactcacgtctagacaccatttttacagaaaccaggagctactgcctgttttgtttttttttgttttttttccagtaatacagcctagggccctgcccaccccacctccttttctttatgagatacagtgaagtccagctgtcctgcagcagatgaaaacagagagagggctctcacccgctagctctagttgagaaatgagaatgccccagaagagcttaagggctcaaaagccatctctgagaatttgcagaagcacaatcctacatgtttgcttccttaatccaaaaaaggatccaaggtcatgtgtctacaggagccagcctgttacggtgagtgaggggtgctgcattcagcaccgggggatgggggggaaaggagagcgtgcaatggctctgcccaaaccaatcatcaccatgaggggacacaggcacacaaaggtacattttcaatcttttattttttcaaaaacagctagcaatccagatttttatccaaaatctcctttgtaaatataggcaattgatgaaaaaaaaaattaaaaaacaatgaagccacatgggctaaaccaaacacacctgtagactgccagtttgtcccctctcataggtaggatggggtgactgaattctggggagcacgttcagaggtcgctatctttctctgcttctccccagagaggtcttcctaggctgcctctcagacacacagcaccagccagagggcaaggaccaactgataagccaggaagtgtggctcccatcactttgaggagggaatcaggaactctttggaaacccctgctgtacaccttgctggtgccatttcccaaatatttgtggttcacccctcggctttcagtgtctctttccttctctgcctccccacccagggctaactcctctccttcctgaagactctgttcaagcatcagctcctccaaagagctgcccactaagcagtgcccctccctccagcccctgggctgggaggcttcccggcacctggcatatcatgcactctgcatgcccacacacaacttccaggcacttgattgaccctcactagcagggagctcctcaagagaagggctggttctcttccatccctgttatccctgcagccagcgcagatcttggaacacagagcagctccacacagaactgaaccagcaacttctccaggagcaaatgttttctgagcactggcctataccaggtgcatgcgaagggtgcataaggccactgagatgaatttgacatatccaggggcttcagaggatcacagtctcttgggtctgacagatgtttaagaaatccccatcatgtagagtacccacagcccacccccctactccgccccgccacagccaccctcctcccatccttcctgggtcttggccacacttgctcttccttctgcctgcaacatggccctttcctgaaatctgctccaaactccccttaacaaagagctttctctccatgcaccctccatagcactattttttcccattccctgtttcatttgtgcttgtgcacttatggccacctggcttctcctgtttccctatttgtcctgtctgtggtctgtctccactactagacctaacccaatgagggcagggcctgcatctgcttcgttttctgcagtatgcccggtgcagaggacagcgcctgacccatggtaggtgcacagtaaacagtggttacccgaatgaatttaagaatgagaaagtaagatacgttccaaaagctctgcatgctgcaaaggcctctgagcctctatatgctgagaggcagctggacctctgcctcctcctttgcacggtgggcagagcacctgcagaactttccacttctcatgcctcatcatgtgtctgggctccggctccggtgctgcaaagcaggtgaagggccccctgtgcaagtgtaagaggctaaaacgggggtgcctgtgtgagcggctggtgtggggtgggcacctgccggtgtacgggagactgaagggtggagagggcctctcatgcaggcatgtgtgagcagctgcaggtgtgtgagcaaatgtgcatcactggggaacaggtgtctgtggatgagggaggaagtgagggtgagggtgtttgtggacatagggatgtgtgttttttacaaaaaaaaaaaaaacaaaaggtgaggggaagccggcctgcatacatgtgcatgcatgtgaacatgcgtgtgtgaatgtggggaagggcgcattggtgaaaaaggtgctggtgctttttctccctgatgcaaactcaggctggagagactgggactaggcagaccctacccttggcactccaggaagagttcctccctctatgaagagctgcctgacctcattcaaggtgtacagaaagaaagcagtgtcaccggaacccaggcctccaccataaatgggccagaggcaattccacagcagtaaccgggcaggcaaaaccacccctggaaaacacaagctgacacgaaggatgagcctctcaggccccctgggcgtggggtccctggaatccctctgtccctggctcctagtgattttacaccaaggctgaacacatagatttgaggcaccagtgcagtgcaggacatgggcgtgttattaccagctccatggttaatgagcattgcatccactgggagcagccaggctggggatgctaagacctgctgggtggttctgctgagttggggctcatggggcaagaaggccagtttctgccagcccctcccagcagcagtgagacaaggacacagacactgaagggcccgtgttctcagcctctccccctccgactcctgcccatcttcctggtcacatctcctcccaccgtctgccttgcttgctgagtccatgcatttgttcatttccccattcaacaaggaggtatcaagcaccactatttcccaggcacattcctagggtgtagaactgaaaaacacaggtaaagtactgcctccatgcaacagacattgtagttgaggaaacaggcgataagccaaactgataagagaaatataaggtgtgttaagacaaatataagatggtgacaaatgccccagagaaaataataaaatagggaagggaggcaggaagaggggccgttaatcagggtagccaaggaaactctccagcagccagcctcgttccctccccagaggcttcacagctgctgttccacacacctgaagtactgttccctcaaagatcccccatagtttccttttccaggcaagttgatcttgttccactcattggccacttccttagaaagaccctccctggccaactacataaaacaggttccccattgcactcacatcactatccccttagcctgtttcatattctaaaaccagttctcattatctgaagttagtttattatttatttactatgtttctgcctcccccagtgaaatatgaggtctcaaaggagagaggatgtgtgtcttgctgaccactatatcttcagcacccagaacaggccaacacatggcaggccctgggactgaaatttcatagtccacttcttgttcctttgggttaagcaatgccctcccccagcatccatttaaaaatactctcaggcaagtgatacatgaagtcatgaacactctagtatgaatccgtcacttctctctaggggctgctcagaaatctaggagcacgtgttagtactgagggaaggggacagggccgaaggaagaagcccacaggctgcctgcccaagcacaggactggaagggaggaggcctgggtgtggtgccagctctgtccccagcttctgggtaacctctctaagcatccgtttcttcatgacttagagctgagagggagctcttggtcacctatgctttggggactccagcggggaggaaatgagtcaattaggaggacatgaagttggctgcctcctcactttgccatcaaagacaataggtctatgttctgatccctgcctcagacaaaatggagaaaacccaaagatagtgggaagccgcctgcactgtatgaatgcacgcttggagaagactgtctccctgctgcccagcacccactgtccacgcatggttactattagaaagttaatcatggaaaatgctgaggtctctttccccagccctgcacctctcagctccacactacaatttcatcttccatatagtgttaccagacagtgccattggctccgtccactcacttgtcccaggcctttatgacctttccattcaagccacacaccacgtctgctccacagagctgtaagacacactggcttcagcccgcctggcctgggccagcacgctgacattttccatgagtccacatcagccagtgaaatgctcagaggggattaaggcaaccttctccatcacccccgagttgctttaggaaagagaataacagcactgacccctccattggcagctggtgatatccacacaccatctctatccagagatgaaaggctccttctccatccttgacttgcaaaacagggattatttcccacctcacgctttctgaaatatcaccaaagatgcagctgtgtttgaaggccagcctcataaaaggcgtaggacccacgtgtcagtcaacactccactgagaagataattgattttttttttgttttatgattatttgcgggcactggttctctttccattagcctggataatcgagggaagactgtaaagagtattaatatcacggccaaggtcactcagctggctcctgctgccattccaacccaaaggctgaattactatggcttttactaataataacaagaacaataaataacatgagtgattataaagccagggaactctgcaattacctcaacaattaacacatcccttcgtgaaacacagaacagaaaaaattttcaaaggttcaagttagaaaacttctgcattctgtttggtgcaagtgacagtcagaaaagggccttgtttgagggtatgcagtgtgagagtatgcagtgtgagggtatacatgaggtctgcagtatgcagtgcagtgtgagggtatgcagtgtgaggtgtgcagtatgcagcgtgagggtatgcagtgtgaggtctggggtatgcagtgtgagggtgtgcagtgtgaggtctggcatatgcagtgtgagggctggggtatgcagtgtgagggtgtgcagtgtgagggtgtgcagtgtgagggtgtgcagtgtgaggtctggagtatgcagtgtgagggtgtgcagtgtgaggtccggggtatgcagtgtgagggtgtgcagtgtgaggtctggcatatgcagtgtgagggctggggtatgcagtgtgagggtgtgcagtgtgaggtctggggtatgcagtgtgagggtatgcagtgtgaggtctggggtgtgcagtgtgaggtctgggatatgtggtgtgagggtatgcagtgtgagggtgtgcagtgtgagggtatccagtgtgaggtctggggtatgcaatgtgaggtctggggctggctccagttggtttccaactttaccaggtgtgtggcccgggcaagtcacttcatctcagcaggttcctgcacataggggctggtgaggactcaaggataaggcacactaaagggcttggcacagtgaccagcaggtagcagcactctctaagtattagctgccattgttgtctttatcattaatgtaactacatcttaattaggaatgatgggatctcatttggcccccacaccaatccaggaattgagatgagaatagtgtttcctctaccatccatcagccaatatccagcagccaccccaggggaggccactggtcatcccacgccatataaagttcactgcccctggatggtaggctcaccccaagcctgctccctcatcctcattcccatcctcaacagagaggaaagtccaccactgtctccattttaaagaggcagcctgtgacatccaagagaccttccagcctcagggaaaggcgtgaacaagagctccagctgggtctttacagatgaagccccactttggtacctcttctcctaacaaccccagcttttggaagacatcaaaattccaaaggctcagctgcagaaagatcttccaaatttctcattatagttattccctgaaaggccaagagctttattcttcatccatttactcaacactttcatggagcaactgctacgacgtgtcagcctctgcaggaggcagctttaaactaagtgtgacagatgagaaagaaccataacacacaaagcagggagaacagtgattccagccaaagaaaacagcatgtgcaaaggccctgaggtgcataaaatttggcatgttctctgtggatagggttctaaatcatgtccaggacagggggacacctttgtgtcaccctcatctgaaagcaacctttaagaagccacaggacagactgtcttcaactcagaaaacctccctgatacccatcttccatcctccacccctacattctcactcttgtctggtttcctcagttaccatcctggtgcctaatttctggtggcagcaaagtgcaagattagaggcccacacactagtgcccggaagcttgggcttcaatcccagatccgccaattatggcttcagtggtttggggcaagtgatttaactgcctctctgtgcctcagtttcctcatctgtaaaccatggataacagagaacctctttggagatctgctgtaaggatcggacaagtaaaaagaagtgaggctcttggataaataaatatctaaggcacatagaagttccctgaaaatgtgggcattatcaatatttattttaagcatcatcatttttcttattatattccctttctccatctggtcccttgagagtgatgactcggttgaatgaatgacacccaccccagtttctcaccccatctcccaacaccaggatccttttgcctagtgggtggttatcacttagatgtgcccatccccaaacctcacttgatatagtgatttctggagaccctaagaggactcagggaccaggcacggtggctcatgcctgtaatcccagcactttgggaggtcgaggcaggtagatcacctgaggtcaggagtttcagaccagcctggccaacatggcaaaacctatctctactaaaaatacaaaaattagccaggcgtggtggcaggtccctgtaatcccagctgctcaggaggctgaggcaggagaatcacttgaacccaggaggcggaggttgcagtgagccaagatcatgtcactgcactactccagcctgggtgacagagcaagactccatctcaaaataaataaataaataaataaataaataagactcaggggacttcctgcacattcccatgagccatgagccatctccaacaccttggggcagagtaggggactctatgactccactggggaaggggtcctgcaatggggcctgagatgtgctttcccccagctgacactcttttccttatttaactttttcaaaaactcccccaaatgttttgccttttcatttgcctcgcctcctccttaacactctccacctgccccaaaatccccagtagtttcaaaattgaataactgtcgggaacagcatttaaagatgctaatttaaacacacgtgtcagaaaaggcaagctggatccctgctcctagcaacagcccctcacccacacctcacagctgctgctgcccagaaacagggcttgcttgagtgagctggcaggggggccggatacagggaagcagagttgtgggacctagctctgagcctgcttctggcctttccccttggatggaggtctttatccttgcagggcagccttcaaaggtgcaaactctgccaagctgccaattcctcaagaaaggggtcttggggcaaccaatggtttaagtaaacccattgtatcacattttgaacatacagaactgctaacacagagacctctaatttcctttaataaacccaaactcttccatttgagtaagcttcatacattaaatagcaacacctactgttaaagcataacaagtctcctttccatttttcacatcataaatgtaagtttgggtcccatcaaggggcagattcctctaagtgccaatgtaaagtgccccctcctctatgtagtcctcctgaatgaccctccatgccacaggtgggagtggtcttttcctcccctgaactctctcatgctcttcccagctatctttcattgtagcaagatcttggtcaagctcatgcatagcttatctccacttctagactgggacatccttaagaacagaagctatgtcttactcaaccttggacgtgccccccccccttgcaatcacaccacagaaccgcatagtaggtgcttaataaatagttataaattattaacatcagtcaccttggagctctccaatttaaagaaacagttttttaaaaatatgtatagtaagtagacactgccccaatagttggtcccattggtaaatatagcttttcatgtgttgggtttgcttcaaatggaggtataaaaacacacagaaagaccaagacagaagctaaaacatagggaatgcaagcctggtaacctctacctgggagagaaatttgcccaactgggcaatgtgcaggcaaggctgatgtcaagggaagatgctggagaagagaaatgctactgaaagagcacgcaagtgcctttgcatctccaggtaagtgcttatttcaagaaagtgtaaagcagctatgtttcttgatttggatgttagttccatgggtgtgttcagttttgaatatgcatatactttgtggtgtgttcaagttttagtatcatattatatagttcaacttgaaaagtaaaaatatttgtgggatctaaaaaatcaaattagagtagaaagagagttaccagaggctgggaaggggagtggcggattggaggggaggcaggatggttaatggatacaaaaaaatagaaagaatgaataacacctactatctgataacataatagggtgactatagtcaataataacttaattgtatattttaaaataacttaaagaatgtaactggattgtttgtaactcaaaggataaatgcttgaggagatgaatattcactctccatgatgtgcttatttcacattgcatgcctgtatcaaaacatctcatgggctccataaatctacacacctactatgtaacccacaaattgttttaaataatttaaaagcttttttaaaataaatgactaaacaatatttctcacatggaaacttatcctcgatgtccaagtgaagttattgtgagaataggggttgtggtgcaaaaattcactctctagagaacacagctgttaccacctataaagaaagcgaggtctccactcacaaaggaaagcagcaggagtatgtgagatgtcgaaggagaacgtggaatgcctaagtaataaaacagacacagaaaactttccatccccacggtaagagaagctttggcagagtttgctcttcagcctcagaccaacagagctccagcatccaaatgctgaagaagccaagaatgtgcaaactatgctctctcagaataataagaagaagaatattcccttctcctctgggactcttcaaatgttttgaagtttctgacactctcaaaaacatgcagaaaccgcagcctgaatttagaaacctcagcatggtggtatgtgtggtatgagttccaaattctcgacagccctagaaacctgtttctagaggagaaatgaaaataccaggcacactgatgcagcttgtgggttgctttattgctttatttagggtggcagctcgggactgagggacctgggtctcattatctatcagctacctccccactcacattttctgcaattgacatcatgcacaatgagagccacctagctggtaagagaaggctctaaagactactcagagggttatgcgggagggaagaggaggaaataatatgagcccatccacttcctctaaacactggggtcgagggctgtcatggatcacctgcacggatatgatccccggcctccctcagcaccagcaggctaagccgctgtcactgcctgaccccctaacccagtcaatacccaaccatcaagatcacagtcctcaaatgagctcactttcagtaaggtaccgtgttcgatttttctttggacaattttatctggacgatatctaccatgacttaattttgtagccaatgtatacacattaaaataagatgaaaacaatactttctggacctcatgcagttctaattaatataattccatatggatttatggataccagttgtgttctagacactgttgtaagtccttggaatcaggcagtaagaatatgaaaaaagagaccaaaatgagaattatctccagaagagaaagcacatccagcctggaatatgtccttacaggttggaacccgttctcttccagatgccttgaggcttctttaactttactctttctcataaccacccagaaagtgcagggttggagactcaatggttgatcaatacatttattgaatgaaaatgacaggccctacaagtagtttctggaagccctgccaacattttcccaccctgggttctggtactgctcccaggctgtgtggcattgactagagtgcttcaacggcccactggccccacacagctggtgcctggggcccagggtggatccatgagtttgggcaactcctcctcattcctggagctcagtttcttcatgtgtaaaatgaaaggattgaagaagattgtctctaatttcccttccaagttctagcattctgtgatgccatgtgcaccccagttaagtgagaactgccctttgctattcatggaggcaaaagatgtcaccctcctcctcgttactaacatggccccatcttgtccaggttcccactccttctccacagtgtcttgcacctcagataaactgaccccattccctcaccagctggtgggtcctgtctagtttacatcagggcattcccattctattgacactgactgatttggagccaggcaagtggcctggttttggtcaatgagaaaaatgggagaagtatcgggggctttggagaaagattttctctatatataaagtcctcaccagaagagatggtccctgccttgactctggacattgccatgtccagatgtgatgtccagaaccactgcagctatcttgcggccatgagagaaatcagacttggtataaagctgtcactaaggacagtagggtgaagaaaagaaagggcccagggcctcatccacatcactgaaccactgatccatccatagtggagcctttcctcccccaactctgttctcttatgggagatacatttccttactgtctaagccaatttgagtcagtgttcttgatcattagtaatcaaaagcatctaactaatgtagtggacccccaatttggaaagaatgaaaatattctgaaacactcaacactaaaactactgtacacagttgaatctttctaatgtctgagaaaatgctctacaacactatctggatggaggttaccctttcaaataaatgcctgacatcctttctttctcaaaagccaatagcatccagatatttgcacttttcggttgcttggtttctagacaaatgttagtggcccgatcattcctacaagaaatggcactgacttgcccttctccatggagacgatgagcacagccatgaactcaattcaaagagcagcagaagagtcaaaagtggcaccttgaaactgaattctctgttgtgttgattttctgagctttcaaagtgttattcatttttttctacctgtgaatgaatccttgatttctcaatctgcctactcgctgagatagatttcagcaaaataacagtagacatgggtttccttctcctctctctctctctctcttccccctctccaacttcccatcctccctctccatatctccccctctctaattcaccaaggtaacaaaagaaacaataattaagtcaatgagcatgctcgcatgtgcaacaaaaaatacctctcttattacattgccatttccttttcaaatcctttgggggcattgtgtacaaatatagtaaacagcattagagggaaataatgccgacacatacttctgggagctcgtcatgtccctttaagacaaggcccactgttcagttccattctaggccacagctcgggtttcaagcccaaggtccccttactgcctcatgcagtattaatatggccctggcatactcccaaatttacattatgaaccataatctgggccagctcccacaggacgaactggcttggggctcccctcttcatttccccagagggccttctccccatccatagccaggccacccccttccccagggatcccccactttcagcctcagccaggggaacacacaagtgcttttcaacaagtagttaattccctagcatggagtatcatctgtgggggctgcttacacaatggcagaggaattgcgctgtcctgcaggcagtcacagggggagaggggaagaaggcactctcagacattagagccagagccaactcagggtcacttctgtggcaggcctgaaagcaccaccaggatgtccaggccaggaggtcccatgggcatacccagatctgctgaaggaggcctctctgtctcttctctgtgtctcttcctctctctctccccagttataaccagaaggcaggtgcaatttctagaagagcccataaaccatttccatttattaaaagagaaagaaagagagagagcgagagagaggtgaggctggtggggagtgaggaggaggcacaaggaaggagtgcagaggggaggcaaggcaaggaaagaacacagggtggagggtggctgagtgggccctggtgcagccctcatccccaggggctggctcgggctccatgctgtgcgcacagcctccaaccaccatcaggaggctacaggctccatccaggatgttgtctatgggactcctgtctctgaggcaccatggggtgtgttggggagagactgcactctggacagcctgtctgggttcaattcccagaccctctactcacaagctgtgtgaccttgggtatgatgcttaaccactctgtgcctgcatctcctcatctgaaaaccaggaccaagaagagtgcccaccacctggggttgcttgtgaggatggaaaacaggacctggcacaaggtgtctagcccatgcctcagagcttgcacccaacagagcaagtaacaaggtcaaggcaacaacagagggtggacctgaaacacatcctcaagaatccagcaatttcctcaataagttaaacacagcattaccataggatctagcaatcccattcctaggcatataccccaaatcaaacacaggcctggcacagtggttcatgcctgtaatcccagtactttgggaggccgaggcaggcagatcacctgaggtcaggagtttgagaccagcctggccaacatggtgaaaccctgtctctactaaaaatacaaaaaattagccgggtgtgatggcggatacctgtaatcccagcaactcgggaggctgaggcaggagaatcgcttgaaccaggaggcagaggttgcagtgagctgagattgtgtcactgcactccagcctgggtgacagagtgagagcccatctcaaaaaaaaaaaaaaagaaaagaaaagataccaacaaaagctcgtacacaagtgttcatagcagcactattcacaatagccaaaggcggaaacaacacagatgtccatcaactgatgtatgaataagaaaaatgtggtgtggccatgcacagaactaaaggaacggagtactgctgcatgccacaacacaggtgaacctcaagaacattatgctaagtggaagaagccggacacaaaaggccacatatcctatcattctactcataggaaatatccaaataggcctcaagaagcagcaagcagatcacaggttctcaggctggatggaggagagaacggcagtgactccccattggtccagggtttccatctgcagtgctggacggttctggaagtaagtagcacagatggttgaacagaattctggttgtatacttaaaatctcacaatggtcaattttatagtgtgtatattttaccataataataaaaaaaaagaattcagaaagggcacagcactcagactcttctcccctgagtcctctcacgtggtgaagagccaggcaaaagggttgagggcattgttgttatgcactaagttcccccactgtgttcctgccctcccctctttttccccctgcaccactctgcctgtggtttcccagctcacctctgggcctttcctgtgctattccctctgccaggagtgcagcccctgccaccccagcaccctcccacctcagccagcctagctcctctcagcccttcaaacccagctcagcccctgcctgctgtagaaggctttcccttgttaagatctcctcctcagggctcccacctcactccccggcacctaccctttgtcaaagcaccatgttctgtgcatgctagacagagctccccacctcagctgtaagcttcttccatgcaagggccagatctaatttactcttatacccttagagccgagcacagagaaattatataaataacaaatgagttaaaactacagactattatctagaagtcatgagataggaaagaaaaattagttatgaagaagggactctcaattcctagataacttaaccccattctcacccctgatcccagaacctctccagggaaaagaatgaggacaccccaagcagagagtgaccaggccaaccaagagcccccacgtgggcctttgtcaggaaagtcaggggctgaagaaccatgacatcctaatcccagtttggagtggacagcctggccttggattcagtctccgctactttcttcaagggagccaagtactaggctctccccacctcttacctcattcaaacctgcagaggtaaaagccaccttatagaggaggaaattgagactccgggaggtcaggcgcatgccccgacaacaaagctaataatgttcaacaccacaggcatctgaggccaaaacttgtgacttttaaattcgtttcctcttcctccagcagtgtctacatggttgcctcctcaatcttctaactaacacgagaaggccagagacacaggcaatgctaaaggacagatccttgtggtgctggactaacccaccgaatgcagctgggtcctgttccaaaaactcacttcaaacaatgatgctattgaccaggatagacagagggacaaggaaagagagatccttggggaaagacacaaaatgattcatctcagccactgtgctcaactacttgtgtggctttgagtaagtccaggtctctctggggctttttaatttttcccttttgtaaaaaaattgtctaagtctaacataaaatgcagtaaatcatctccaaagtctcttctagctcttaggttctaacactattacaactaacagcttccccagaaggatctagaaaaagtggccatcttgtccacattcacttagtgcaagtcacgcctagagcagacagcgttgcctgtgagggtgatgcagtgcacaaagctaagtcaccatcaccttttctctgggagcttcttataccaatgccccaaacattccttgtaccaggacagacacaaagagaaagatgcatttattctgctcccaccacatgttctataggagacctgtagtgtaggtctcagtagtactccaaattctgtcattctctcccatcttcctgatttctgccccgcctgcctgcctgcactaatattcagtgcatattatccttgaaatcaacttgaaattgtctcgattttttcaaattagcattgtcctgggcaataatatctgtgaaatcacgagctctgatgtactagttctatttttccacaagtgtattcaaatacacaactataataagaaattcgtctgtgtccctcctcaaagcatcttgcatcccaccagcattgaggtgtggcaaaacacagcagtagctcacttagtctccaccagcaaacctcttaggccaaacaaagctgtttcctaccattttagaaaaaccgagacttggggaagcaagcgttcaaggtgacgcagccagaaagcaccacgcggggcttcaaacttgggtgtgcctgattctaagtcccaagtctttgccgctcttgtaagcatccagcttgtctacagcagatgggggtgaatgaaagtcaagagattgtaaataatgccaatgacctttatcacctattctacttaatcctgtcctaagaacttgacagcaagattttccacgataatctgaaatgagagtaattcatctatgcataaacaaagctgacagccagcatactgaaatggacagaaggagagcactgtatgagtccagaccagttagctccctgggcaggtgcccctcacccacgccagcaaggtcaaggtttattcccactccaggcaacgctgggttcaagctgtcccagttcagaggctgtaccaccgaccctgccagcgctcctgcaaatgcacagcttagtcacaagggactccggctgtgcatgtgcgtgactcagcacacatccctcagccctccaaggaaaacaatgacaagagcacatgggatcagcagtgtcatccgtgaacacagaaacacccggcccttcatgcataaacccaccaaagaaaagggcttccaacctagcctggaaaattcaagaactggaagggctggtgctcaaagtcatctggtctgacccctcacaagacagcaaggaaaaaccagagccaagaaagaggcaacaagggacttgcccacgggcactcagctgtgtcagtccagggctaaaaggaagtgcccctacagcttcctgcagagtcagcagccccaggcacagtacttctctctgcccacgtggcactgaggaaattgccaattacagagctatgccctaaattcaggaatcaataaagtgtaagtggagagcccagttacccatatgaattcaacaacaacaaagaaaaatgaagaggaaaactacccagctcattatctctctgaagtgttttccagtaacaactcaatacgaatcagaaataatctcctacgagaagcagcaactggggggaaaatgcactgaactgtgcttggagaaagaaggggctggccatgcattccagcacgatgagaatccccccgtgtgtcacgcaatatgccaactgcaggaggatcccccaagcaggcgtgtgctaacacgtcatttgactccaacacgagatgactttgagttcccaatgatgtgcgcaaaagggacagattctccccgccagtacagtgggctctctggaccttctgaccaagccaggaagggaagaggttggcagcagatgagggactgaccagcgaatgaaaacacagcgatgccagatgcaaaggacactccttgggtgggaaggaggtagggttggtttattttttcccagactttttcactcatttaagcctggagaatacctccctccaaattttatccaagaaccagccaatggccaaaccccactcaaaagagaaaacatgaacactaaaatattccatgtactgaatatttttaaagcaaagttaggattttctaggtttgtttccatgggggaagagggtggtaattaaatgatttacagaagaattttacaacctcttcattttacagataaagcaagcaagacataaagaagcaaatggttttttcaaagtaaccctgatagtcaatagcagaaccaaaaccagaatgcaagtgaaaaaatccagatttgccaaaaccttcctattggctctatgagagactaacttctgagtccgggctatcctgatgatactgacagggtccccaaaagctatcatgcctctctgagtatgttctcttggcaacctgaaatcactctcttccttagctcctctaccatctgtaattaattattctataacttttattgaagactttctcccctgcaatagtagaagctctactattatgctgggaacataataaatgtttgaaaatatttgtagagtgaatgcatatgtatttctgacatatgaacactcgtgcattcaacaaaccagggctgaccatccagggcatgacagtgctttcatccctcagtgttgctaacatgcccagtgttgagacaccccaacaaggtcatactacacatgcaggggattcaacaaggtcagacacaaccagagccccaaggagcagagtctactgggcagactagccaacacacagaagcggctgcatgacacaggagaaagggcacccgtgaagctggagctccgggtctagtttcccttccctagtcaatgattacatgacttaggacaaatcatttaacttctctagaacttgtctgcttcatttgcaaacacaagccaaacaagaggaaggcaggcatcccgggaggaggaacagtaaatgttggaagtaaaagccctaaggatcctaatctccttgagtacagggaccagtctttcttcccgcatcccaccactcttccccagatttgtgtgccaggctctgcccctcccccacctccatcactgcccggcaagagtcaccaaactctgacagcattattcttccagccactgacctccaaatatccctctgataaaatcaaatcctaacaaaggaggatgaactccccctgcttaggctttgtgggagagaactgcctgttgctcattggtaactcagggcagaaatatcagaaggatgaactgtggggaggctataaatgtgtgactgttccttaccacctcatggccacctgtactgtctctatagagccaaagctctaaaaggtactcatttgtcttagctccatgcctgaatgttctactcctgattacagagggagaacccttccctctcttgctccatctatgccaaagctggcccactatgctgcttggtgctggcctctaggccagcagcccctgccaagggcacacttgagccaggcagccaggtaactccaggccaggcttccccctcagggcgttaccaggctcctccccagcttctccctagcctggcaaacatccagccctatgctcatcccagaaacctaaagataaaatcattaggaaaacttctagctcagagatgattattgctatgttatttataatagccaaacagcagaaacagcctaaatatcctacactagagaaattatggtgcagccataccaagtagaatgtagtcataaaaagggtttacataggagatgtttgttatagtaactgggaggcagaaggcagcatacaaaattggcagagggtacagtcagagctaaagaagttgaaataatttaaaaaattggtacaagcaggcttaaagaaaatgcatcaaacgataaccaactggtgtcctaggaagaaactagatacgaggtcctttctctatccacgtttatgtgtatttattatagcgaagcataaacattaccactgaaaagcatctcatttttcctgaaggaacctaatatactcaggaagatcagggatttgggcatcaaaagttctgggttcaaggtccaggtctatctatacaataggcacaaaaatacaggtagatggaaggaataagatctagtgttcagtagcacaacagaacgactacagttaataataatttactctacatttcaaaatagctaaaagaaaatatttgagatgttcccaaaacaaagaagtgacaaacgtttgatcaatgttctttctgtttccagcctacaatctatacctacaacccacagcctacaacccatacctaccatttacagctataacctacagcatataactacaaactaaaacctacaccctgtacctccaacttataccctgcaacctacaactgcaatctataccatatatacctacaacctataacccataatctacaacctatatctacaaccacacctacaaactacagggatgctataagggtcgtggagattcaccaagtgccaatctttacatgaatatgttatatgaaggtggcgcatgaattataatttcttaaattctacacacatgcacacactccagtagcaaccacacatcagttactaagcacatcttaattccagaaggacgctctaacatcccaaaatactccaaccagggctcaaaagtcaaaaggtcccaccattgactcctgttcatctaccccacatatctcaggactcatcagatttggtccaagaagtttattcccctccttccgaaaaatacggatggaagtagttataattcagttttttaaaagacagctattatcaaaaagtctgaaaataacaaatgctggcaaggaagtggagaacagggaacattcatacactgttggtgggaatgtaaattggtacagccactatggaaaacagtatgaaggttcctcaaaaaactaaaaatagaattaccatatgatccagcaattccactgctgggtatatacccaaaagaaaagcaatcacacagaagagatctcttcactcctgtatttattgcagcactcttcacaatagccaagatacggaatcaacctgagtgtccatcaatgaacaaatggataaagaaaatgtggtacatatacacaatgaaatgttattcagccatacaaaagaatggaattctgtcctttgcagtaacatggatggaacaggaggacattatgttaagtgaaataagccaggcacagaaagacaaatatgacatgtccttactcatgtggaagctaaaaaactatctcatggagcaagagagtagaatggtagttaccagaagctgggaagggtagtggggaggggatattaagagggattggttgataggtgcaaacatacaggtagatagaaggaatacgatctagtgttcagtagcacaacagggcaactgtagttaacaagaatttattctacatttcaaaatagctagaagagaatatgtgggatgctcccaatacaaagaaatgataaatgtttgaggtgatggtatcccaggtgcccagagttgatcattacacattgtgtgctcacagcaaactatcacaggggcctcataaatacataaaactattatgtatccataaaaattaagacaaagaaaggaaaatgcactggcatgtgtattttgcggaattatttggtttggcaactactctttgtctagagatggagtttagaattgtccctcaggtttgaggccacagttcctggcatctcggagcaggaggacgccagcatccttcttgttagaatcagacagcatgggctttcccagagcttacttcctgctgtggtctttcttcccagtgttgggagaattccctcacttcactgatcttcaatatcctcattagtgacagtaatgccaatatttttatcatttagaatgtgctagatacaaagctaagggcttcatacctacgaactcatctattctgtgcaacagccttactatgaaaataacattaggtacgttgactgcctcccccaggtagagatgaggaagtagaggcacaaagaggtgagtaacttactcaggttcccacagcttgtgggcaggatgttggggttggaattgggtactctgtctcccgcactctgatatgtctgtcagctggaagcaaaaaggcccacttcagaagtcattgactaaattttaaaagccaatgatctaaacaccatagtgcaccctcaattggtgtcatcactggtctcctccccagagctgccaacatccacacctttctctcaacagccatttgaacacagggagaacacatgattcaccacagccaatgactgggaaaaaccaaacacaaagctcaccgcatggagtgtgatgtcttgtgtcccattcatttcccagtgatttgcaggaccttgtatggtgtctgggaaaaatgtgtattgactttagttcatttccttcgtaggttcagcctcttattattttatgttcatatttattttccagagatagccctaaacacgggacatcaccagttccagtgaaatctccagggggagtacatagagccccaggacagacaggaactgtgtcacctaacccaacactcccaagacttctgaatgctcctagaaccaaactcctcttctgctccattgcttcccctccacccccctgctcctttaatttcagtgacaggaaatgccttccgtttggtccatcctatgtcatgcatcactgtgccaactcaggggacacattcttcagccacaagaacaccaccccagcagaaccacattgagcctacagtgcccacaccttgctccaaaagtcacatccttgcccccacccagggcccaccttccccaaaccatggacaaatgccagaaccaggcctgagaagggctctttcagagtccaagacacatgagcttccttggaaagcatcttccctatggaaattccccccatgactgcagaaaaattaaaatcactcagaattctctatttcttcttagagtttcagaattgacttgaagacacctaaaatcctaatctcaccaactctccatctcctcctctgcctctaaaggaagaaaaaaaaattttaaagaatggacctagcattgagaaacagagaacaatctattattgtgactataacaactcctaaggagccatcagagtctcggtggcaccgctggccccatcgtcacccaaatcatcacagtgggccgttcggactgcaacacgctgcctgctcctcccggcgcacattcttcctggctctccctcactgattttttggcagggctcagcaggaatggaatgggcttccacgcccgttatgatgatggatgggcaggctgctggtggagtggggcctttggggaggcactgtatacacacgcacatacacacacactcacatactctcacattcgtatactctacacgtactctcacacacactctcatattcacatactctacacacacactcacacacatccacatactctcacattcacatactctacacacactcacacacacccacatactctacattcacatacacactctacacatactctaaacacacacacatacactagacacactcatactcacacatactctcatattcacatactctacacactcacaaacacacatatactgtcacactcacatactctacactcacactgcatacatgtgctataccctacaccctacacatacccatacacactcacactcaaactcttggccagcagcacccaggtgaatccactgtggtctcgtgggccaggattctccccaagatccttggtcgctgaagcagccccaaacccgctttgtctgggtctcttccaactctagagctttcattgccatcattacccccagctggacttctgagtcaaccagatctgagttagaatcccagctccacagcttactagctgtgtggccttggcaaggtcacctctctgaacctcaatttcttcacgtgtgtcttggagaatgccagtactaaactcccaggctaatatggagtcctcaacagcccagctagatggtgagtcccatctatgatccatcaatggcaccccctcccccaccttggtccctctgccacagactccatggatctccttaaaacctaaggatatggagttaaaatctgacccaacagagggcctctatgaacctgttctcgtgccacaaaaggcatctaatcccattgctccctgcctgtgaagggctggttgtcaagactgattcaggggacagtgtgtgtggagtggttagcacagggctcagcatgaaggctctgcatagtaacagctgcctctgaggctaggaggctccgtacataggtcccccctcctgctgagcagtaacctgtctccttcatgtcaccacccacggtcctacatctacccaagaggctgaacacactccaatacaggctggttggtccgggaggaccctagggaagaagctggagactctgagacttacaccattcataaaccagctcccccaccctaggtaagagcatatgtctctgaggaacccacttttctcttttctgttccctcaagagcctgcaaggccattctcttatttgccattcccaacttcccaatgagctagcatgataggtactaacgttctgcattttaaagacaagcaagcacctaagtcaggttgcttgtccaagataatgcagagatggagatgggatcaaaacctatgagtcatctcccaacaacgtatccactaaaatacctgcaattctagttttacaggtaagagaatagacatgggtgggataagtgagtggcctggggatacccagataatggagcatggaggtgaggcagaattgagcttggggaccgaaactctatcctcttaaatggcagatttgggagacattccctcaagaatgaacccagctctggcagggcccctcatccccaggtgtccccaccaaattcctggcccctgctattttggaagtctatcagagatgggcaacacagacactgaggagccacgggtgaattcccagccctaattttctgttctgtgctcagtctgtgggccctgggcttgggtatcgccctctctctgcagagtgtgtgcaccacccaccaatgcaaatgctgttggccgctgggagaaagcaaagcaaaacttgctgccagcccagctctgcttcgtaatctgccctttgcattgctggggaagcagtgggaatacagttgcagctacctgatggtacatctaaaaaaataaccagctaaaggggcccacagactcccacctgtcctctcctacccaccactctgggagagcagcgaagagctgctgtttcttttttctcccaccccaaggaaatcaatatgttgtgcaaaaacaactccttccagcaaaactccactttacacctacctccatctggaccatcccttggagcatccccctaattcaccaataattcctcccagaatcatcatgattgatttcacagacctgggttgctgcctgtcctgctatgtcccagccaggtggagcagagcagtcacatccacactcagtccccaaaagctttggatccagggtcacagccaaagagacacatgcctagaactggcttgcagagcaataaggcaaagctggggtgttttaaaagggaagtccaggttggtatccatataaaggctaacagtgattgagcacctactgtgggctaagcactctgcagaacttacctcattgaataatcagtataacattttacaaatgagcaaactcctttgggaaaaactggcactgttcagactataatttgttcatataactttcacaatgttcatcttcttgataccatacttatggataaaaataatacttagtggctctttgggtaaaaatggtaatattaattgtagtgctggcagtagtaagactagcactagcaattggaatttattatgcattttaatgactgtcaggcattgtgctgaatattttgaatacattatttgagtaaaaatactgttatcactttcaatgttcccagaattatgaaaatgtatctcaaaaatttaagagtaatcactaggagaaggctgggcatggtggctcatgcctgtaatcccagcacttcgggaggccgaggtgggctgatcccctgaggtcaggagttggagaccagcctggtcaacagggcgaaaccccaactctactaaaaatacacaaaaaaaatagctgagtgtggtggtgcacgcctgtaatcccaactactcaggaggctgaggcaggagaatcgcttgaacccaggaggcagagatcgcagtgagccaagatcgcaccactgcactccagcttgggcaatagagcaagacttcctctcaaaaaaaaaaagagtaatcactaggagaacagaatatgatctacagcttatgaaccaacaaaatttaaaaaaagaagaaatatggaacaattcctttaatataagacaggaaagggggaaagaggagcaaagaaacccaaaataaaacagcagaaaaaactcacatattgtatcagtgagtatattaagtataaacgaattaaacgtacctattaaaagacagagattatcaaaccagatgaaaacattaaacaaaattcaattatttgatgattgtaagaaacatatagaaaagccttattaaaagattgacaataaaaagacaaaaaataatatgtcagaaaaactctacccacaagaaaactagtgtaacatgtaattaatatgatatgaaactaattttgttcctcaaaacaatgcaaggtagaattaaaatccctattttgcatgagactgtgaaatagagaagttaggttacttgttcaagctcacacaagcagcaggggcagaaaaaggacccacacttggatttctattactccaaagcccattcttgaaactacgtgactctattgttctaagtaacattaccttagaaactattcagtgtgtagaaagtacatgttccaaaatcaaggcttgagataggagtaaggaaaatggagaatggatcatgagtcactaaaaaaataagaaagaacaatctactggttctcagtcttggaagcacgctagatagaacacctagggaactcaaagaaaaggccagtgatttggccctaccctagaccaattaactccacatgcctaggggtgaggcccaggcatcaatattttaaaagcttccaaagtgattttaatgtgcagccagagttgagaacaacttatccattcactaactcaagggcaagtttgctaaaacatggagggtatctttaggtcattgtgacaaagagaaatgagaagatcctccaaccttatccctttgcaatggtttgaatatttgtgtccctccccaaaaatttatatgtagcaattttaacccttataagtgggattactgctctataaaagaggtcccagagagctgcctggtcccttccatcatgtgaggacacagaaggctccatgtatgaagcaggaagtgggctcttaccaaaaaccacaagcaccttgatcttggacttcccatcctccagaattgtgagaaataaatttctactgtttgcaaatcacccagtgcaaggcatttttattatatcaacccaaatggaccaagacaaaaggaagaattggcataaagagagacataagcccttcttctgcatagtgagaggatgccatgcctgagaatatgacagaatccctgtgctaacaccccctccctgtttcttaaagagaacacaatgaaccacagaatctcagcactggaaagaatcttaggggaaacttaaaatggatcccagacttggctgattgttagaacgccttggaagttttataaaaatataaatttctgtggccctcccctaagggaatctaattctatagctctgtgttgagcctaggaaattgtatttttttaaaagatacgcagggaggcttttggagaaagatggcagagtgtcccaatacataatcagacaaagcaaaacaaaaaaacaaaaaccaataagtgaaggagaaaagcaagcagcaatcaaacaaggaactggcacacactcatactatcaacatctaaaagacctggggtgagggtgggggcaggaacaggatttggcagaagttgtcaggttcctaaccccaccccatgcttcagaagtattattgctgaggccaaaatctttagacttctcactaattactatatatttgcagagaagcagactgtgagtgtgacatcatttcttcctcttttctgacttaatacggagagagttggggaaacagattgagaactattagaaaaagagctataaaacagcagcatgaacaatcaagactctctctctttctctctctctcattctctctctctttctctctctctcattctctctctctttctctcacagaaacacaggttccagggctcaacgcttaattgaggggatcatctaaatggcaaggacatcccctcctatatcccctcattagtggaatgagccctggaacagcacatttaacaaagtcatgcaagagttaaatgtggtcctacccaaaggagcacacagctctgagtctgaccaccctcatctcccatgttcccctataatgctcccaggcatcagaaagcatctcaaactggagctgacaccatggcagaggtttcaggtaagtcacaaaaggagtcctaaagaatttgccctcaatatcagagtgattagaagaagtggacagagctacccaagttaaacatatgcaagataaaaaaaatatggcacttgtgaacacacactacaggaggaaaataaggaacataatagcatattgtgctattatgatgatgaagaacctctctagaagaaaacataaccaaagaaacaaagaaaattcctgcaaatgtttaatgctatagaagaaattaacaaaaacatatattcaatgaattcagaaaagttagcaggtcaaagaaaacaaatcaaagaccaaaataatcccattttagattgtcgagtaaactagaacagaaagaatacaactggaaattgaattcctacgtaggggacatgcttgagactaaacaactcagggacttgttagatattatcagccttaacaatgtaaaaataagctataattaaaataagaaagggggtaggaggtaggaagaagcaggtgattgctaattttttcatcatttataacatgggctcaaaagtctaaaattgaaactaggtattaacagaaagcaatgactccatcttcttaaaatttttcataaccttgatgagctcttctaaaagatatccatttcaatgaagacatatttttccagaactcagaacttcctttagatgtacttgtttcctcttagaaatttaagccatgtacgttaatactctttgttaaaattgggatgtagagtgtgatcccattattctaaaattattcctgtcaatctgtgatctacatatctttccagctgtgtgtgtgtgtgtgtgtgtgtgtgtgtgtgtgtgtgtgatgatagagagattacgtgagttttcttaatgttcatgatggttatgtctaggaagtgagatttttgagtaatttttaaatttcttctctgaactttgatattttcaaaaacaattgttataattgtttaaaggaaaaaattcccaagtggttgagagggtcacagctaaacttgaagagcacggcatctagcccaggaatctgattcctgaatctccaaaaatcactcctgagaagaagccacacaccaagctgctgtcaaaatctccagtgatgatgaagcactcactatcctcatatgccccatcccactgcagggcaacttcaattttacaggaccacaaattttctttctactgctaccctatcttctagtaataatatccacctttcactgaatttccctaactgtgagctaagcgtattctttaaatcttcagagcaactctatgaaggtatgaggtttcactatagttttgcccgtcttcctgttgaagagactgaagcccagagaagtaaattttcctgaggtcccccagctagtagtttgcagagctgggcttcagcttttcattgtggttgaatacaaagcctgtgtttttaaccaaaattctttgctagaaagtattgcatcatattgaccccaaatccacttttctataacttctaaccaatggcactgactctgctccctggggacacagcaaaaagtctaatccccttccataagcattgtcttccaacataggaagacaaaaatcatgtgaccctcatctaccccatcttcttcctccccaagtgatccttctgcaggtgcaaaatgtaccgagaagagagcatattttttctgacccacgatgaagtcactgaatgattagtttaaatggaatcatgaagtttctaatatgtacttaactatatgctatcatttaagttctgctttgaaggagttcctaatagttgggttcctccggaaaatctcctaagagggtttcatcccacagacaactcccaactccctgggttaactggaggggtgcagtggtgtggataaagtaatttatgtctgacacggaaatgtattatatgcatttttcaatttatcttcctaattaaattttttcatagactcatatttaaatgagtttccactcccctaacacatgaggactgacagtgagtggagggaaaataggataaaaatgttaagtagattttccaccaagtgtgaatcctccacacacgaatcactgagggaatcgctggcactctgtgggctgggtggaggggttttctttggtttataaactccccagaacctgattttcacatgcagacatgagagcctgtccagccagcagagtatatactgtccagcatctcctgtgccaggagccacaaggcagtggggcatggaggtgccccccgggccctgcctggaacatattctcccaggactttgagcttcctggcagggtcatgttccaggagccccgatttcagggaaatattctgctcccttggtttcacacagagggtagcaagcctccaccaaaatgcacacctgtgttggcagcgaggctgtggactgtggcctggaaaacatggcctcacgcctgggaaagcatgcctcagcgtaggaacagagacccaatatagctcagctcggactgagtcaggcactgaccccactaccctgtccctaaatcccccctgcagtgtccttgatgtcacctccctgatgtcctgaaatccaagccccccagccccctggggcacaggcacggctcttcactccctccctatggccattccccagttaccatctgaactcacttattccaggcccaggcctggctgtcccttggagggaaggagagacacccaacaccacagcccagaaggaacctccacagggagtcagtcaaaagccagacactaaaattacattttctcactcccttctcatttggaggaaagtctgtgtggggctggctgtgatcacacactttcatcacacactttctgcataagtgagagaactgtctcaactgcctcctcctcttcctcctcatcctcctcctattccctctccctcctccactgaattcccagctcactgcctcccactagttcacagtgtgctagggccctccagccccaccgagaagccacaggaagctctgatccacccccacagggaaaaagggatcagaaccaccacccagcacagatataggggccttgtgtaggggaccagccagggagcccctccatcttgaagaatctaagtcacgaggacaagcacaggagcaaagcaggcagcctgagctatccatgtcccaggccactgccggcctgttctgaaaaatttcacacaaggttatccccaatattcccagacatgtgtcccttccccggtgctgcatggcccccacactggctgagtatctccagtgggagaggaaaggacagaccgactcttaggaatgcctgctcactccgtggtagcatgtccccttcaggcctcctttcccatctttgaaagtgaatcctgggtggctccctgtcaggggagcacacagataacccagccccaaagatggcggggcagacctgggcattagcaactggagttctgttttcccttctaggctacctactatgtgtcgggctctgtgcttggtgctttgtaaacccactctcattccatcacccagcaacagtgagacccaaagctcagagaagtcaaagactttgcctgaggatcttacctacaattaatggcacatggtcaagacacaaatctcattccagaaaccaagatctttctaccacaccaaatgtttccctaaagagagcccataactccacacaggaacccagcccagcctggataacccatcagaacagaggaagaaaactcctctgtcaaaatgaaagatgctaatagcaagggtgtttactaggagtgttcaaatttccattaaaaccttcctgtgcaaagatgagctacgaaaatttccttcttggaagcttgtacctcctggaatccagacatctactttcaagctgctgaaggctcccactgcctccccacagggctgcaatcccgaccatggattattaaggagtccacaggcttggctcaatgaacagaacggctccgttatatttcaacctacccactaagacttaaatatcacaccctagttcagacagccctcgcctttcatttttcttggctttaggaagacagggagggagggcatacagagccaagaacccaagtgtctgagcttttacagtaacccaaactcacccaagacaggctgcccaaccgggcccacctctgtgtggcttctccagatcaacagaaatttggggtgaaagcctgcttttctccatgcagtaaggcatctgcatgaaaggcacatgtttccaggaccttccaagctctttcttgagtaaatattctcttaaaaaggttttgaagcagaggctaaggagaggagtcaacatggaattttatttctcttggattatctgactcaagcagcacccaagactagcaagaccaaagatgggctgacccaaagataaccatttacaacaggagtcagcaaaccaacagcctaagggcccaatccagcccgatgcctatttttataaataaagttttattggcacacagccatgctcatctgttctggggtgtctgtggctgatttcatgctacaaaggcatagttgagtggctgcaacagcatggcccagaaaagcctaaaatctctattatctggccttttacaaattaaaaaaaaaaaattgccaacccttgatttagaaaaactttcagatgtagttaggcctatttcttgagcctttttaagagcaaataatatctctggaatatatttggtatagtcttatatggagggaaaaggatgaaaaaaaatggcccctgagtttccttccaaatccacaggaagccaaaaaaggaatgaggtgcctggtacaaatgcctcaggtgacagacatcctatttacagaaaggcaatctgtgcaccacctcagggaggccaaaccaacatgcctggtgcaatcatgcagccttaccctgcaaccacgcccaacacttggaagcctaacgtggacaacgcctggtgcaagagggcatgtggtcagatgttccacccccacttagctcaggggcagacagaaggcttctccaaagctgtcccttggcaggatttcatgtagcagatgccactagtctacagtctctacagcctctgactcccagcatgtacacatgtaggtgtgcacagaggcccagagaagcagggtcaatggaatccatgaagctgacctggtggcagctcagggtttattccctgcttccaacctaccagcaggcacaactcttgatagatctaacagcacactggggatggagcactgcatcaggactgaggagactcagggtcttgccccagctctgtggctaactcctgatgcaaccttagaagagtcatatcatgtctctgggactcactttcttcttctgtcaaatggattaatactacccactccatctaactcacagagctcagtcatgcaacaagtaattattgggcatctactatgagtcagacattatgctaagcacttgggatatagtggcaatcaagatggacaaattccctgccttgtggagcttacactctggggttggtatggaaactaataagggatgcatagatgaatactttgaaaaatcatgatgtgcttcacttgagtcgtggatggtgatgctatcttcccactctgggccattcatggactagactcacacactgagcagacctgctgggaacacatcactgataaaagtcattcattgggaactattctaaatgccttgtatgtattaacctcaccatcacagagagtcctcaacactgaagtaggaactctaaatatgcatactccacaaacaaggaagctgaggcctggagcactggagctaaaaaggaaatatgtgtcctgtcccttatgatatctcccatactggctggagatgttgaatttactatattaaattcttctccattatcttgaggagtaaggccaggacccttcagatggagaggaagtctctctccctagatggggaagggaagttctccttccctagttcaatcatcacagaaaaggaaagcatctaacaggaaagtagcacccagaagagaggccttaaactccttggaagaggtgatcctcctatctgcctctttgggctgaactctcctagcaggggatttttagaagggtggataaccagttgtgggctgcagtgagaagagcgaacccagcccatgaagaaggccaaaaaaatgaggactctggcagggtctgtgagctaagatgagctatgccctacagggcagttatctagctctgtcagcctccattcatttccttttttctgtctccacattttcagtaacgtcctgtctaaacatcccaccagactctcaacgcaacatagacaattagcgaaaggttagaaagtcatgcacccaagcttggcccaccacagttagaggaaaatggcaccaccttaaaactagtatgtaggtgttcgtactaaatacgtgagaaattctcccaaaggaaggtgaagctggagagagtcagggtcatccaactactttttgccctctcagagcattttcctccttgccaatgctggacaatgaaagcactagtttattcagggaaatcacagtttcctttttagaagagcaggatgctaagaagggagcaagaataagttgaaaacaaatggagtaagattcagcattgtgcacgcacccccagcccagccacccaagagattctcccaagccaggcagtgatgctcacatctggtccttcaccaccaggaccaagtcagagcaaaggagaaaagaagagaaggaagagacaggagcgcactggatgggagagtgaagggttggagaagagagggatcccagcctactcccaagcccagtgggatcatcttcccctaggaactcccatctgatattggctctggttggggctgcctctctcccagcacctgctgggtagacttccccatgtttggtcctgggaggtgctgtagcagctggagctgtcctctttctgccgctggaagcaactggaagtcccaggggccctggcgctccctctgggatttcaccctattctttcctgtctcgctttctcttttatctcctggattaacttactgttgtgccatctacccagttgtcagtgtgcctgtctcagctttgtgatctcacgtagatccacagaacctaagagctggaacgggccctgaaaacattctggagcaggcgtctcggcagactcaggcatgcctctccccagggaaccaggccgcgtctgggcagaagcaaggcttgggggagtggcaaggattgtgtgtactccctcgaagcacatcttcagaagtggagcattttcaaggtaggatgttgacataattgttaggtccatgaaggcagatgctagaagcagtgtgaaaataagactctgaggttgtccaggtggggggctatttttatacatttccccccacaacccaagcagtacatgggccctagccctcaagcttcacctcccagatgtaagactccaaccaagattttggagtcaggggcatacaaagcccactcaggggacacactcatagagtattcaactgattcagagatgtgggaagaacgctattcctatttatttttttgtagaaacagggtcttgctatgttgcccaggttgctctcaaactcctaggctcaagtgatcctcccacctcatcctcccgagtagctggaactacaggaacacgccaccacacccagctaccactatttttatattaaataaaacatgtatcatggagtgacaggaaaaacctatgcaagtttaagtaaatattgtacttaaagtgggtgactttaaattatgctcttatatgtacaggggaaggacagaggaagggctcatttaccttcattcttctctctccctagagaattctgtgtatccaattttaaaaattcatcatatgtcacagacagaggcacagaccccctgagccatggtgggaagatacttctggacaaatgtatacccagcaaaaatctcaaaagctccaactttctaatggcttcattttactgatgagaaaactcagacctatagaaagaagagcagaaacagactggatcccaaatccctgtgccccacagttgatgctctttccacctccaatctgaggcactgctctccatgtggccaggaaccgtttccaactaaactggtcctgcctagggcctggaaaaacacactgttaatatgcagccttaattaaatatttctgatgagcacaatgatgcttcaaaattctagctaggattcgactgatgctgcagcctggagccatcaaggaagagcctctttcccctaagcatggtgtgtgtggagcttgctgggaagactgagaccttccaatccaacctggccagcacatctattcaagccatcaaccagaggacagatgtagaagtcaccttctccttccagggaccactcttggaagcagatttccacaaaggggaccgtacagttctaagcttacagatggttagaacagaccagccccactggaaggccagaagtgacgaggatgaggtcaaatgtcagtgacagagaggctcagacctctctgagccatggtgggaaaaatctctctgacccatggtgggaaaaatctccctgaactaatctgcaatttccaggcatttctgaccagtaaggaaaggatttggttgcagaaggctgggaagctagattgtagaccaagagatggagaaaactcttcaaggggagagcccagccactacaaaggggcccagcatgaggtgtgctggaggtaccctgagggccgtggctgcctgactgacttatcctctactttgggaaaaggcaactcagtgcctggattaaaccattagctctggaggatgcctgtctggtttgaatcttaatttctccatttcccagctgtgtgacctcgataagattacttcatcctctgggtctgcttcctcatatgaaaacaggaacaagaagtgcataaacacatttcagggatgtagggaagactaaaagggttaatatagggcaagcacttagcacagtgcccagcatagagcagtactgtctaggctgtagctaccacacatacccagtgaaggcactcaactaccaggtggacaagcaactgatacatgtgtgtgctgctctctgctcccctttggacatttggaatttcaagtactgggacttaataccacagagggcagagttttgtttttcctgcctttgacatgatgtttatgatcttcttttcttgtgaacaccccagacctagggaccagcggtggcctggcttcctgatgcagcccatgaacacatttaagaatccaaaaaggttagccaggcgcagtggctcacgcctgtaatctcagcactttgggaggctgaggcaggccgatcacttgaggccaggagttgaagaccagcctggccaacatggtgaaaccctgtctccactaaaaatacaaaaattagccaggcatggtggtgcacacctgtagtcccagctactggggaggctggggcatgagaatcgcttgaacccaggaggtggaggttgcagtgagctgagattgcaccactgtaccccagagcaagaccctgtctcaaaaaaacaaaaaacaaaacaaaacaaaaaaacgccgggtggcggggtggggaggcggggagaaagctgcctctgcattgcaacttcccaaacagcacagacattaacattttagtgatgaaataacaaagctgatattctcagtatcattcctttattgagtgaaatcagaaatataactttttcttcttttttttcccccgtgggactccataaaactatttttgttgtaaatgttttaaaaggcagcctgtcaatatttcaaatgttcctgaattggagctcatggataaatgactcttcccccattggccaagtctcctctcctgctgcagcaaggaaaggggcacttgggagctgagaaggcaggaaccaggcgccgttgacactcctctagtgagatgaatgttccctccactgggtcagcagtgagcaccagcccaagaagtgccctcgcctccctcctgctgggcagtcaccaggcaaccctgcaggcagtgcaccaagctgttcctccataatgcacacccagtcagggcctgggcacctctagttactcagcagtgagcccacctgctatgtctcaggggcatcccacacccagaaagctgcttctacttcaagcctactcccaggggatgccccatcagggactagagggtcctgctgaacccaccccaggttcaaggtcagcagcaggctgtttcaccaggaaggccaggagctatgctcaaggtaaccaaaaggacagaaggccccacccaagtgtcatcttgcccctcctcccagcttccccattggctagtaaatgagtaaacagacatggttctaaaacctagaagagcatcagaactccctgtggatctgggttcaataacacagatttgatattccactcctggatattccagttttgtaggtcttgagcagggatcgactttttttttttttaaggttccaacagatgatactgtggctacgatgggcagctcagatgtaggccactggcaacacagagtggaaggagaagcccacagggttcctcactgggcgacacaagctcttcaaagcaagctgagtaaatctcttggtaacaagccaagccggactgcccacagctatgggcaggtctgctgtgtctttcgcctgctgaaagcccaggttgcagcacagggaacagcagagacaggatcaaaggctctctgaggacagtctgtggcaacaaagtagcagctcctctctgatgaggtaaggaagagtccaaagaaattacttttgggctgggtgtggtggctcacacctataatcccagcactttgggagaacaaggcaggcagctcacttgaggtcaggagttttaagaccagcctggccaacatggtaaaacctcctctctactaaaatacaaaaattagctgagcgtgctagtgtgcacctataatcccagctactcaggaggctaaggcaggagaatcacttgaacctgggacgcagaggttgcagtgagccgagattgcaccactgcactccagtctgggtgacaagagtaatactccatctcaaaaaaaaaaaaaaaaaaaaagaaagaaagaaaagaaaagaaagaaagagaaagagaaaacacttttgaaatttggaaatgaggaagactaaggaagagtccaaaagaaactttgcctctgcccaaggagcccacaaactttccaaggccttcctgttcctggaaacggtgccatctccaaagactcctccgcacatggaagagcctgatctctcgggcacagtcaaccattacggcccattttctcaaactaggccctcctgggggtcttagggaaagggggcaacattacacaaggcaggtgaaggggatagccaatcacagaggggtgcaggttggcattgacctcttcctaacttttctcataatatgaaagtgacttctcttctcagaagaaccgttcataatgaaattcgagctgcctcaatcttccttgatcatctcttcactcttaccacatacacacacgcacgcacaccacaggaaaacgcatcagatgaagaacttccccagtccagtgcagatttaagaaagaggacactgacatagggaggtgggctggggagctggggagggggcagacaaacaagggcatgtgactgatacacttcagggcgggagtcagacggccccctcacaggccagggtgacatgtgacaaagtcacaaggccctgtggtatttcttgaaacttgatttcagcccaagtcaaactccatggatcaagggtcatttctggctattataggatgagagtatccaggactgaagacctcatggggcagaaagaaaaaaaacagaaaggtagctcttggagaaataacctaaagattagaatcaaggaagagccaacctctcttctaacagggaaaaaaaatttactaaaatgacacttcagcatcacctattttttcaagcttgtctttctgaacagaacttgaaaacacagttgtaaaactgttttactagttcagccgacttagaaaaacaaaaagagcttctcacagctttaaacagagtcctgtgctgaagtgttccaacactccagccccactctggggttaagaatgacagatgatgcaatgtaaaaacatcattttccactggacacagagaacatggtacaatactttggaggttaaacagatgagaagggaacagtacagagacccaaacttagctcctccatgcctctagcacacacatatgcctcatggaaggcatctggagaggttagtgctagagaggccagaaatcttgtttctggttctgtgctggaattaactaggtaaaccctggatgaactgttacatctttgatcgtcactacctgagaattaacttagacaaacattgacactctataaagcagcaattgcaaaatgtgggttttcaaaagcactctgagttcttttcaaagaggatggcataagaatcgacacagctgacatatggtgtggacagagagaaatagcttgggcttggatttccggtcagttcccctttctgccagttaccatcagaggaaccatgggcaaattacccaatctctctgagcctgtgtcttcacctttaaaaatggtattatagttctcaaagtaattgcgaggaattaaaagtcaattcagggtcaggcgcggtggctcatgctgtaatcccagcactttgggaggccgaggcaggtggatcatttgagtttaggagttcgagaccagcctggccaacatggtgaaaccccatctctgctgaaaatacaaaaactagccaggcatagtagcatgtgcctgtaatcctagttactcgggaggctgaggcaggagaattgcttgagcctggtaggcagaggttgtggtaagccgagatcacaccactgcactccagcctggacaacagagtgggactatctcaaaaaaaaaaaaaaaaaaaaaaaagggaattctatgccctgtaaagtgcagtctatggaagtgatgatgatgaagaccaggatacagtacaataaggactctttatgctttcaaaaccgtgattatgctgcatctggtggaagccaggactctggaaatatggcccagacacacccagaactgaggatcaagatgagcgtggatccctgggtcatgagcatcccaaccaagtgcctgatgcccaactccagggaaccatcttccctccgcacacaatagtcattccatggtggtgcacacctgtgagtcaaaaacaccctaagaaaatgtaatccttggggcatttcctcagctccagcctccggcccatcaatcacaagcacaatcaaactgcaatgcctcaaaccaatctcctaggacccctgccagggcagagactgaaagtcactgaggcaatagagcatgtattatattgatgatcctctagctgcaagacctgattggtttgagactcccttggataatgctggcaattaattttggcaaaagagcaaaagatagatgtgacatccattgaacacagagctgcacaggagtcaggtttctggaaggtaggaagaatgcaaggaaattaactccagagtggtttgcagggaatgggggctccaggctcattatttcaatcttgaaagctgtcaatcactgtcaaaaggcagtttaatctcaccctgaagctttcaagaacactatgaatccaggcctacaattagcagtccaatgttgggctgatgagttatgggcattttccatctgggagggcacaagcttctcctatccagggcgtgccctgggcataaaggatgtgtggacaaatacaaacactccaccagccagaggtgacagaaataggcctataatatttgcccaactgggtttatgagacaagcatgtagttcaacactgtttatacagttcatgagagaatcttgggcagtgacagagaatgtaactctcatcctccttagggcttccagaaatgaacagaggatatatatatttttttaaaaagtggatcctccacattttctaaagtttttaagctctctggggcaggttaagaaattcagactgcccaggaagtgattttttttttttttttttttgcatggaatttcgttcttgtcacccaggctagagtggaatgcaatggcatgatctcagctcaatgcaacctccgcctcctgggttcaagcaattctgcctcagcctccctagtagccaggattacaggtgcccgccaccatacctggctaatttttgtatttttagtagagacagggtttcaccatgttagccaggctagtcttgaactcctgacctcaggtgatctgccggcctcgggctcccctctttacaccattctctaagcaaataagctaacatcccagaatggaattatagaaagattgcaccagtcaaaaaaggcatttggtatacatattctaagaaatgctacataataacaatatgaattaataataaattaccttctttcaccttgaactgaaggatttgcaaattttctcaagttctctttcatttgaccttcacaacaaacctgtgacatttcttaccccctatgaatggttaaggaaaagactcagaaagtgggttcttgcttcttcagatcccagatgactcctgaaatattcataattctgatcttaaaaaaaatataacacagatggtaggacatgcctcgtgaatcaggtaataccctggcagcatctcccttagagcgtagaattccacaggcagggatgtgccaaacacctctgcacgccaagctgggtgtagcaactccatcaaatccattggatcacgatgatcctggtacagggagaggggacaatggaacaaccaaggccctggaagacagcaactgaaaattttgacctgtggttcaccagcttgaatccagcactgggatgtcgggggtggggtgttccagggaaaaagaccacagcttctggatggttccaagaagataggttccctcattaaaactggtatcaaccaaccctcttgtacacagacccctgtggtgggtgtcaaggggaaagaaacagatgggcccaggatagataacacagatgcccagtccctgcccccaagaaagctgcccctgccagttgagaacactgctgcatctcatctgaagagaagcctacacagcagtcctggaattccaaatcaggtggaagaaggcagatggcgcaaaataaactcaagaaacagacaatgggaagtaagcatcaagccaggtaccttgacacagtacctctggcatggtccccaacagctggcctgttggcctccccaaacaatgcctctttctaatgagtctttctttaaagtggtcaccgactatacaccttagtgtagagctgctggtacaacttcctgtaacatagcagttgcagtgaagctccagggctacgctgggagtatgagtgactggctcagccccagaaggcaagtcactctccgtgtcctggtcagcccagcccctgtcactgggcaacatgtggttgtgttcagacatctcccacctgtccataaaaggtgaggtctaatggtggcctctttgggacaaccttagggcaatggggcatacgtccaggactgaggctgagaagcacacactggtgcatccctaccagggtgaaaatattgaaatcctttttacatggtggtaagtagcagcttccctgaattcctgcatgcctactaccaccacccagcctctacaatgggactccatgcctccccatgatccagcgactgaagggttggacctggcacagtcgacacttctctaggactctgtcggtgcccaggcagctgtgtaattgtgaaatgctttgaatatcctccccacacgggcccagtcaatggtgctgcaccttaacccaaacacctcactagtagaaaggctaaggaactcaccttcctaagaacctgttgaggccacaccaccagctgtcctccactgggcaagaaggtgtcacccccagctctcctctctagctagggatcctccattcctgctgagagggacaatcctggaaaaagaactatagcccttcaggtattgtatccatacctctgagtctatgtgtgtttttgagaggaaaaaaaaatgcttctggtttcacctttagaactaaaaatctggttgatctaatatgctagacatttcagcaatctctggcccaacacagagtagggtgccactgttctctatattcctggcccagctgaatcacagcatcatagcatttaagcaccctcaactatattcagcccgatatgtttaaaactgcaggttatggccaggcatggtggctcacacctataatcccagcactttgggaggctgaagcaggtggatcacgaggtcaggagtttaagatcagcctgaccaacatggtgaaaccctgtctctactaaaaatacaaaaaaaaaaaatcagccaggcgtggtggcgggtgcctgtaatctcagctactcaggaggctgaggcaggagaattacttgaaccctggaggtggaggctgcagtgagccaagatcgcgctactgcactccagcctgggtgacagtgcgagactctgtcaacaaaaacaaaacaaaataaaacaaaaaccctgcaggttatgacccatcagcaggtcacagaatcaactgaatcattcacaatcagcatttttcaactgaaacaacagcacagaaaacagagtactgcatattaaaagggttgctgcatggaacttttgtttaattacatacatgaacataagtattgggttgagaaagaaaaggtatttcttattctgggtttcaggggaaaaagcttttgaaagcccctgatctagctaactccactctatcattgatgaggaaactgaggctcagagaacagcatggtcaaggccactcagagaatgtgcagccaggtgaggtggttctcagtccatgcagcctgcggactttgcttttcttctaagcagctctggctctggccatgggcattgggattctgggatgctaagtagctggctcctcagttcctaagagctgtgctcaagtggtctctagtgccattgagattttccccagcagagtaacccttagcactagatctcctgaggctgaccaggaggccctgagaagagatgccagccaagcaccccatcccccattcccacagcctggtagtgggtttgggcccagcctctacatctcattctctctttataaagtctcaagcaaactgtgtggctgggactttataataaacttggagccttcttcaagctgaggctccagcaaacaactagatctttctgagcagatgcttctgctctttaggcaggcttcctgtctctacaggtggtctagccctgggactactggaaaaatgagggagtgagggtgtgctttgtgagaggctgggacaggggaacggctcctcctgacaatgtatggaaacacttttttttttcaattaaaaatagcatagatcacagatgagaaactaactagaactatataaaaatacaactttttttttttccaatgggacctgcttagatagaagctaacattccctgaaaactatttgtcaagcattgtgctatgggcttcacacacattatctccctggatggtatagtagttatctcacttgatataaaataaagttcagtgataccagtgaatgtattaatgacatacacagagctatcacttctacagtgcttattctattctaagaattttgtgtgttatttgatctcatcatcagcttgatacagttggtgctattctcatccccactttgcggattatgaattgaggtaagaaaggctacctgacatgcccacactcacatagatactaagtggtggggccagggtttgaacccagatggtccaagctttggaccctcctaattacctccactacactggttatgattccttccactttctggcgcagaagcagagactcgggaaagttaaatcatttgtgtccactccacccagaagctctccacgtacaccagagggatggaaaacatttaacaatgggtaaggcaggtccatgaccttcacaaggggcaccattggctaggctggagacctcctgctatgctggaaactgagccattttaggggctgcttcaaggggaaacccagagggtttcagagaagggataaggtaacagggacactcacagcacttagggcaatgtctattttaatcagcagggaagttttccaatatgttatcaattttggccactgcaaacagccaagataagacagtgctaaagctcttagtcgaaactgaatttttgcatgtttcggggctggaaagaactcttgagccatatagaattcaacagcctcattttaccaatgaggaaaccaaggctgctatgcaaagcatggtgcccaaggtcagagaactagtaaatgacagagtcaaaatgaaaatccagggtgcccagatgcccagattggtacttagggtgtttggtggtggtggtttgtttcttccctatctgtgctgattatattcaatacacagatgctgatgtgcatgcacggggcccagcccccagctgctgtgccacaccctgacaacctcaggatcttcagagaggctcagctgctcaaagttccaccagggaccatacaagcttcatggatattcagattttttttagtaagcacctgaattttgtgtaactgatttccacacccattgaaggcggcttctaaatttagaattaacatccaaagcggtctgttgcacaaatgtatacttcctcgcaagctgttgtcagaaacagtaaaactgacatccataaaacagtttcttcataccttaataatattgaactataaaaatagaggatctcaagcaaacaaagctgtaaccataataacctttacaaagtctactaccacagtcaagtactgtccagatctttttttaatgaaaatgtaaaggtggccccagccttattctcacatgacaatgcaattccctaggcccagcattccctctagacacttgtcactgcccaatccagaactttagtaattgatcatttggggtaataacctgcaccttatacaataaagccacctttgcagaaactgcagcttcactttcatcacttcctcctttgcctattccaattagttgcttagattcagttagacacgtctccccataccaagcacattcagttgtgccaggaggatggaagaagtctttctttcaagacatcttaacaaagtagacattgcaacgcaataaagtagtgagactcatggttgatgcttacacacaatcttccaacagaatgctttatcatcccttgcccagaacagatggggaaaaaattacgctatgccctgaaattttccattcttgatctcagcccaaaggtgacttttttatttttaaacttgagacttgagcaaaaaaaaaaaagttcaactatttttgattcatgcccaggctaaagaaacacatggtaagattctttttttttccaaacccgtaggtagctcaaacagctaagcttcaaaagctcaagctttccaactagcactaatagtgttcacagaggcagcacctctgcagtaattgcaaggccaaaaatcaatagccggggtgagaaggagctgggattccactttctggacacattgtccccagtacctctaaatacttaaaagaaccgcatagaattctcaaatgtttaagcaggatggttgggcctgaagcttttcctcccttctgggtgataaggcaacccgtcctcatcaccattttttcattacccatcctttgatgcatttcagtcctctcgagagtccaggctacccagagagaactgacaggtctcctgactgccctctgtccccagaacttgctctcttctaccccgtccctcccagccctagccccaacactgactcctctactccttctaccctccctccatcctgctattcccagtctccatagaggaaaaagggagtgtcatgcctagatgaaaagatttggggttcaagtcaccccatgtacctccctggttccaacgaacctccggaattctagccacagatccccctcttgccctctcatcctcccctaacacatccctacacattgcaggcccaggggggagtccacaaaatgggactccatgcatccatccttctgtggggccgcgtagcacacccacggcaagactccagtccctggtcccggctctgccacttatgaactgtgtgcccataagcaagtcgtctcttgctctgcagactggggcttatcacatttgtcccacctgtcccagagagctgttatgcaaagtaaggggaatcacagatgtgaacaggcttcagaatcagagctcaatataaatgtacctccttattattaggcacatggcacagtgccaggcagtgtggtatgttccttggggctaaagtccaagagatattggcaataaaagaaagtgaattataccgggcagaaaacaaggaacaaaaagagaagaacagagatgaggattcaccagcctccagagaagagtgaattcacagtgacagtgcaatcaataaaggcttcctgcaagaggaaggctttgtatgcagcctgaagtggctctcaccacgctgatcaaaggtgatttcatggccaggcatggtggctcatgcctgtaacacgagcactttgggaggccgaggcggacagatcacttgaggtcaggagttcaagaccagcctgggcaatatggtgaaaccccatctctactaaaaatacaaaaattagccaggtattttttttacaggtggcacatgcctgtaatcccaactactctggaggctgagacagaagaatcacttgaacctgggaggcaaagattgaagtgaaccaagatcacaccactgtactccagcctgggcaacagagcaagactctgtctcaaaaataaatttaaatttaaatgtaaaaaaggtgatttcatgcatgccccttcccaagaccaagcgctctttgagggcaggtgacatgtctttatgtctcagccttcgcagcttcctcctggcatctaggtgaaagaaagaatgaatggagccttgaactaaccaggaactcaactaagtggaaaagaggagagactcccagatagcagagggaagacaagctggggtcagagggcggactctttggcttaggagtagaggagttcagaagttcaggcttctgatcacaaagggaggtaaaaggagttcagaggagtcagtgacatcatgaaatcagtatttggggagcttaattgggcagctgcatgcaggatatgcagcagggggtgaaggaaagctggcagagtggccaggaggcaagggcaatgagtcaggcagacggtgagaagggaagccactgcctctcggccaaatcgccctctgggagcacccatctctgtcccagtggaagccccatcaagggccactctcagtgactgtcctctttaggctggaccttaagtgtcccctagtcctcctgccttgcacccagcactggcctcctgcaagtggttaccttccccttgtgaatccctccaggctcagggattccagggattccagggattccctcccattcccgttttagaggacaacgcggatggtaagcactcccttaaaggaagcacagtgatgcagcagcgggcggggaaacagggagagagcttttacttctgagcacattttcccaaattgctatcttttcaacacttttataaggtagtatgttaatatgacagttaagatgatgataaaaagaaggtagaggaaaaaaatgtggaagacaggaccagtgcattcaacacacagctcagacatgattgagaaacagatcctggtgctgaagagctggggacaggagcctggtgatgggcagcctcggttccagggcaggccctgccaccaacgcactgtgtgaccttaagcagctgtgctcttcccagtcactctcttccacctgtaaaatgatgtcagagatagttcccacccaagagggtagttgtaagaaggaaatgagttgatctggtgcagtgcttagtacttggcacaagataagtggttagtaactggtatctgtgatgggcaccaggctagcagttactgcctctaacatctggagacgcaaaccctagcactgcagctatcccacaggaggtgtcaaatgtgagcctcccaccccatccccctgagatccccacatgaatgcacctccccacagccctaacgctctcaccagggacacacagaacaagccagtgcctcctcgctttacagaccatcagaaatgcaaaggcagttgctgtgcctccacggaatattctctcccctaaaatcttcatgtttttctctcctcttatttctcttctattcacctactgcacaaacaagatcaggcagcagtgataggcaaggaaagatggaaatattctttaagtggaatagcaaaaataggctttggaaattaatgcctagaaatttaccctgtgggctctctggagaccaacccaaatgaaatcccattgacagaaagctgcagccctctggggaatgtccccccatcccatcccccaggatccttggtccaggaaacatggaagttggcttctgatctccctggtctcccagggatcctgctcggggcaccacctgaaaagtccctcggcagaagcacttctcgccatgcgtgaatgctgtggaaagcatctgaacatgaagtttccaattactgctggcatttctggagtgtcctgatgctggctgcagctgtcccacggaaggccagtgatgtcatcagcaagcctgacagcactgagttccaaggctggctgggaagaaaggttccctgcaggctgagcccccatcactggagagggaggaacctgccatttcccccgcaaaggtgggcactactcaggtttgctgcttcccttcctgggtagaattccattgccataacttggactcacaccaggaaaggttcagaagctgcaccaatgtccaggatgattccatctgactgcttctgaaaacttactatgtgtccagagttgttccgggtggaggcaagcccaggtgagacctactttccaaatgttcatgtactcacttcgtggcatgaaaacaaaatggtcttgcattcttcggctacagagagacaataagggaagtaaaaaagggaaagagagaaacggagaaaaagcaaaagaaggaaaaggtgggaaggaaatgaaaagaggaaaagagagagaggggaagggaaggaaggagggagaaaaggagggaagaagtttttgtcctgtggctagttttaccttgaacctccctactcaagaccttcccagttcctctctcctcctctcccttgctcagggagctcaggccctgggggagccctggcagataccgtcctctagaagagctgaccaaggagacagagcacgggatgcctgcagagcgatgtaacagattgggccctgagccctacagtagagttcaagctcaacgcaatgttcagatttcccaaggcgggggattagattaattggaatttgcaggctgtgcccaaccaagatccatatctgtcaccatgttaaccacattcaggcccctcttaaaatcagaaccccgccatccatcaccaccccggtggagaggcacggccagagcctcgcagtccaagactgaccttctggctggcagcctaccttttagccgccagcctcctccatgggcttccagataagcgtgtgtaactcttgagcaaatcctagcccctggaggaactaccggcagttatgaacacagtccctttgttcatctcaggagctgatttaattaaacgagaaactatggacccttcctaagggagaaactatttagtatccagaaccaaggaaagtaaaggctaaagggaaatccagatcctttcaaaaactatctaattgaaccttgggagcaaaaccatgcagtcaaattacacaagaggatccaaggggctgcagtgtaacccaaggtgacacagccattaagtgaaacactcaggtctgagctagggcaccctttccaatgcattatgacacatttaatctgtaaaactgtaaattattttttttaaaaaaactgtcttgggccaggtgctatggctcacacctataatcccagcactttgggaggccaaggcaagtggactgcttgagctcaggagtccaacactagcctggccaacatggtgaaaccctgtctctacaaaaagtacaaaaattagccaggtgtgctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaatgaaaaagagtccaagaccagatgcattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaagagagaattttagaccaatatccttgatgaacattgatgcaaaaatcctcaataaaatactggcaaaccgaatccagcagcacatcaaaaagcttatccaccatgatcaagtcggcttcatccctgggatgcaaggctggttccacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattagaaaaagaggaagtcaaattgtccctgtttgcagatgacatgattgtatatctagaaaaccccattgtctcagcccaaaatctccttaagctgataagcaagttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgctgcatatctacaactatctgatctttgacaaacctgacaaaaacaagcaatggggaaacgattccctatttaataaatggtgctgggaaaactggctagccatatgtagaaagctgaaactggatcccttccttacaccttatacaaaaatcaattcaagatggattaaagacttaaatgttagacctaaaaccataaaaactgtagaagaaaacctaggcattaccattcaggacataggcatgggcaaggacttcatgtctaaaacaccaaaagcaatagcaacaaaagtcaaaattgacagatgggatctaattaaactcaagagcttctgcacagcaaaagaaattaccatcagagtgaacaggcaacctacaaaatgggagaaaattttcacaacctactcatctgacaaagggctaatatccagagtctacaatgaactcaaacaaatttacaagaaaaaaacaaacaaccccatcaaaaagtgggcaaaggacatgaacagacacttctcaaaagaagacatttatgcagccaaaaaacacacgaaaaaatgctcaccatcactggccatcagagaaatgcaaatcaaaaccacaatgagataccatctcacaccagttcgaatggcaatcattaaaaagtcaggaaacaacaggtgctggagaggatgtggagaaataggaacacttttacactgttggtgggactgtaaactagttcaaccattgcggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatcatgagttcatgtcctttgtagggacatggatgaaattggaaatcatcattctcagtaaactatctcaagaacaaaaaaccaaacaccgcatattctcactcacaggtgggaattgaacaatgagaacacatggacacaggaaggggaacatcacactctggggactgttgtggggtagggggaggggggagggatagcattgggagatatacctaatgctagatgacgagttagtgggtgcagcgcaccagcatggcacatgtatacatatgtaactaacctgaacattgtgcacatgtaccctaaaacttaaagtataataataataaaaaaaagaaattacttttgaatgggaaaaaaaaaaattagccaggtgtggtggcacatgcctatggtaccagctactctggaagctgaggcaggaggatcactcgagcctgggaggtggaggctgcagtgagacaggattgcgccactgcactagaacctgggcaacagagccagactctgtctcaaaaaaaaaaaaatactttctttgatatatctttatgagaattgctatcttaatgttgctcataaaaataacttacacaaatgtgtgccaattgctgaagatcttcagtttcagttattctattttttatttctggaagtcctatttgtattcttcaaatctccacggattttaaaaattagtctattgtttcttcctcatttgtttcaaacatttaaaatacattacctattccattggaactatatctgaaaccctcgggaatctgattcttctgtctgttgtttctgctgactttcactcgtggtgactggtttcctcatctgttttggattttgagagtgaaagctcatgcttgaatggctgggttttacctacaggaatccatcaaggcttgagctacaagtatgtccctccagagagaatgtgcatttgattctgacaggaactctggtgtgaccaaccccaaactacctccagttaattttgcagcgtggagtctcctgggtcacccaggcagtacaaattcaaaccccaaacttgcatgaaggcagacttatgattacaaattctcacagcaaacattgttccatcctttggcaagccaaagccaaaacagataagggcccctgtcttctccctttgcccccctgcagatgtctgctggaccacctgtctgtcccctagggatatatttctcctgtaggggaaagcttcagacagaaatctcatttccaactccccacctggcaagggtcccaggtctggctccctgggtattctaaaggccatgctttcaatcctggcttaaagcctgacacgccctcaatctgatttattgtaaacacagcgaagtctttcttagagcctagatctgtgctttttcccgtacctaatttaaagctagatacacctttctttggtctttggagcccagagttcccagggccttctaaggaataagctttcaaaactttgaaatgtagatgtatttataggaaaaggaaagcagcagcaacaaggttttaatgacctataaggctaatggaagggaggaaaaaacgcacacgcctgtgtagtcagcagttccaattgaggagcatctgaaatgctgtaagaaggtagaacaaagtgggaaatattagaacagagcagagtggatggggaaagaatctacaaagactgtagagacatttctctctgtctccgtatctttctgggtcattcttcgtcacaggatgtcaacataagaggtatattttaccctatacacacatgatgtgggccaaaagttgaaaatgagtgtaggattagaaactacaattcagaattttaaaaagaaaccagaccacacacaacaacttatccaggtagtttccagaaggcttcatagccatcactcagttcgtcctcacaaaagccctcaaaagtgcattttataaccagtaatggccaaccttctgataaccagtctactgtactttctcacatctgtcactacttcttatcaaaaaaaaattcattgattaatcaataatacgtttgggaggctgatatgtctggatcacttgagcccagaagttcgaggcagcctgggcaacatggcaaaactctgtcgctccaaaaaaaaaaaaaatccatatatatatatatatatatatatatatatatataaattagctgggcatggtggcatgtgcctatagtcccagctactcaggaggctgaggcaggataatcgcttgagctcgagaggtcaaggctgcagtgagccatgatcatgccactgtgctccagcctgggcaacagagtgagatcttgtctcaaaaaaaaaaaaaaatcaataacatgcacacactgcaaatatatctccagctctatgattcctcactcaaaatcttcaaaaccagatgtgttttagaattccaattgtttcgggttttaggaaattattaaggtgaatctctgaggtttgggctgcacatcacagtcacacacactaacatttcttcaatgacacacgacaattcagactaagctggatgaatgaagaccataaactgcctcgcagttcagggcagcttccactcaccaccagcccctccatgaattaggtaaaaacactcacttttcagagtttgggggacttcaggttgggaatgagctggtgtagaactggatacataagtcatctctcaaaatatcttatatttaaatccatcagcttaaaagtccttcccactaagtctcaaaatcttcactctgattctcagaaggggcagaaaagaacagtgatcagaagaggagaggagcatgaaacagttgatggccagagagagcccagtgggcctccccgggagccatgatgtgtagtgtgtgcatgggcggtggggatgtgtaggcataaaaccacaggataggtcagacatgacccaggaagactcttaacaaagcctcaggtgtaacagcaggggcaggctgggcaggggtggccctcagtacagttgcatttggcctcagatttgtgactaagagaagcataatatgaggcaaaacctcagcatcctcctctacagcaggagagctggactacaacagcaatttcagatggcaggcctcaaccccctggttgaccaggaaatctatgtaacaggttataagcaattattttttaagaaaatggaatggaatggaatggaatggaatggaatggaatagaatagaatagaatagaatagaatagaatagaatagaatagaatagaatagaatagaatagaatagaatagaatagaataggtctgtacctcgctcaacagggacagaagcttctgtactcaggacccttccagactcaccctgtatacctgtccacctgcctgttcatttatatcctttataatactctttttttttttttttttctgagacagggtctcactctgtcacccaggctggagtgcagtgacacaatctcagctcactgcaacttccgcctcccaggctcaagtgattctcccacgtcagcctcccgagtagttaggactacatgcgtgtgccaatgccaggctaatttttgtatttttagtagagacagggtttcaccatgttggccaggctggtctcgaactcctggcctgaagcgatccacccatcttggcctccaaaagtgctgggattacaggcatgagccactgtacccagacctatcctttgtaacattctttataatgaaaagattatgtcaagctgcatctcatgtggtaaggacagccattgtttcaggaacttttctttctataagatatatatattaatatctatgcgtgtgtatatatatatatatataaaatctagcagaatgtatccacatgtatatataacacatagatataatacacatgtatatacacaatgtatgctttgcacacacaatgtgtgctttaactgtgggatgtggtctaaaaaatttaggatttactgtgctagatgactgcctctgaatctttttaacacaaacatcctgtggattgttttttctggtgttactgaatccaggcattctgtattaaaatcatcccagactgaaaatcaaaaagaagtctcgttaaattctctctttttcaggatgtactttagccactgggacctgacttctaaggtctctgccactcactcattatgaccactagggcatttatctaatctctgagcctttagttccttatttctgaaatgcagaggctgaccatcacagacctctgaagagcaactgctcacataaaattggagaaatgacgactcctagctcatagaatggtcgtgaggatcacatgaggtcatactttgaatggtgcacccaacacactgtaagtgccatataattttgcctctaagacaagactatgaatgctttccatgtctggtgcttcatgatgcttttgaatccagtattcattttgcacatgcagcctgcttggagtgggagctgatggctttcaggaggccccagggcctgaccactgcaggggctgggaccacagatcgtaccaccaccctttgttcctgcctcctcctagcccttgggaggcaaagcttgtcccctcaataaatgatgaccagaaccctgtgtttgttgcccagcctcctgggagatgggcagtggcatagcaaagggattactttgggtaaatatttctctaaacctcattcttgcctccaccagtgcccagaacgagccggccagctccccaacagccccaccgttccaatgctaggacagtgctgacagcatcagctccctgaatacagggcaaatgacctcactaaaggtaagccccagaattaagcagtggtggcagaggctgggaagcacaagaggaggagaatgcatgaactgttctctcaaggcactagcgatttccttttccagagcaggttatcgtctttacagcacttagtacttggaccaaacagccaccacattgcaattccacctgaggccatggcgggcatccaatcctgcctcctccaaaacgggaatcttggctgcacctttctggacagatggaagcccactttctggtgtgccttccagaacccagggagctaagtcttaatgctccccaaggcaccttcccatcactggcaggcaaacagaggttagtctacccaactgatagctgagaacgctgagatttagttcacaggcctaaaatgctggttcgcaatattggctgcacattaggatcacccggggagcatctgaagttcccagagtccctgccatacccagaggctattcggatttgttccaagcatttgctttatctccccaggagtttccaacgtgcaggtgctctggctcttggttatcgatctcactggtgcctcagagccactggaaggccagttaaaatagagccctgggccccacccccagaggggagtccctgacttgggggttgggcctctgaatttccatttccaacaagctcccaggtgaggctgatgctactggtccagagaggaaactagagctttgagatccagtgctcaaggcccatgtttctagccttaggcttctcagccatggattggggagaatggctcctggcttgagaagctctgttctagaatagcactcctcagtcttctgtgtgcacatccggacgcatctagattcatgcccaggaggtttgggtggaacctgtgctgctgatcctctaaccaccgtctgaggaacaaggccctagactagcaggcctgactgccaaatctacattcttcccacttcaagcaggtctagggccaggcaactcgcccttccctaacagagatctgcctccttgaaacctccactctgagagacttgctctgagccacaggacaaagaaaaagacttcctctcccagaaaggcacccaggtatcctgtccccacctctacctcttagcctctctttctccctacgaaacaatcccccatcctttaactcctcttgctatgtcacaacaaacaaaacctcagggatcttggaagcaggcggactctcggcctctcccagcacttgatggggcagtactacgtgacatttaagtcccctccactggagacgtgcttcctaagtgtccaccacatgctgcatatggtcctcagggcttgggacccagctggggcacaatgacagaaacacaggaagcacacagccgtgcaagaaagctcaccatgggattctaaaaggagtgacgctaacagctggaacaagaagactgcaaaggaagaagatccagttcccatctgcaggccaggggtctcaggactgctagccttctgccctctaagccactggtcccattctctagcctagagagctacaggatatcaagcctcgagatgctggtaacctgtccaagtcatttaacgggaggaggaaggacgacaatggcttacactgtttcccatgcaccatgtgttaggcactgtgtgaaatgctctgcaagtattatttcattcaattctcactgaaatcccatgaaatgctcattgctatggcaccacagtttaacaggaaagaatggagaagaatggagaattacagatgtgaagtagcatgccaaacaggaggtaacagcagtaactgaccccatgttgacgagcctacacactctctttttttttctttcctcggctcactgcaacctctgcctcccgggttcaagcaattctctgcctcagcctcccgagtggctgggattacaggcgcccaccaccatgcccggctaatttttttgtatttttagtagagacgggggtttcaccatcttggccaggctggtcttgaactcctgaccttgtgatccactcgcctcggcctcccaaagtgctgggattgcaggcgtgagccaccacgcccggctcacactctcttaactgccatgtagttgaagcagttaacttgccttaactgcctaaagatgaggcacttaacttgcctcatcaaggaccgggagagaccgagactcagcctccttccaagatccaggtttctatgcaagatggtcccgtcctcaggccatttcatatggtaataaataacatcaagcaatataattgcacttaatacaccaggcaactctaaactacatgtgtatacacatatatacacacatacgtaacttatgtatagataaaaacatacactcattccatcctcacaacagccttctttgtaaatatctagatttccattgtgcagatgggaaaactaaaggacaaagagcttgggtaactagggtctcccagctagttggtggtgaagccagaatttgaactctgacagtctggtttccaggttgtgctggtgacatccccctgccccctccacagttcacattggctttggtgcctaaactgaataaagagcacagttcaaggtgctttctgtgcccacattgcacccagtccagtggccaaatcctctgcaggtaccttgataaacatccagtaaggaccaaacaggtgcctcctgccctatttatagctcccagcatggccagctagctataattagcaaagctcccctaggactggagctaaattaaactggtgggattagaggccagcagcttcggacagtgcctctggacacctccagcaacacaccactggtgatactaagagaagcctcttcaaagaagtagtttggcctcaccagtgggcctttctcctgagtggtgtgtggacccaaggggttcctttaatggcctcctcccaattctagtggctgatctgtcctgagatcccccaattaaatcagaagaagatgagtgatctcatgctctaagggtcagaaaaccagaactctggtcccggctgtgccgctgatcagcccggtggccaagggactcaactgctctgggtttcagctttgcttcttgagatgaagacaggcctatctctgaagtccttcttggccggaaaatcccagacatctcacagatctcaaaaaggggcttccagttaagtcctgtggtagggatcaaatgccctctagagaagggtctgagggaagcctgcagcccccaacgagggaggaggactctgacttgaaagtctggtgtaaactcttaggctgctggtgctgtgagcctggaagaagagaagtgacaacctctcaccacctcctggagcctgaagaggacaaagaaagagatctcatcttccctctcgctccagagtatccagccgccaagggctctgcctctctcgggactcagatgtcacctcctcagaggccttcctgggttccttatctagaaaatccacctgccaccacttcctagccactggccagggcactcccaagacatggactctcatcccctatatatttgttaaaatgtgcattaactgtctgtatctcccactgggatgtgagccccacagaggcagggcctgcatctgtgctcttcacatctagagcacctggcatataccaggcactgggtctgctgactcagtgagccattttggccccaggcctcctttctctgtgctgagcgcccagctgccaacctcccggagtcgttgggcttctgtttttcctgtccaaacagggagggagccactaaaccaaacaggatgaaagggaaagaggggaggtcaggaagccttcttggagaaggggatttcttcaaggatgagtcagtgatgtctagccaaggaagcagcaaggatggagagaagagaaggggcaaagcacagaggtggaaatggcccatgcagggcatctgccggcagctgggagttgctaagagcatggaaggttatcaaagcaggagggatcagggaggcaggggtgtcagtgacaaatggccacaggtgtgtgcgaagaagcctgaattttatcctacagctcaggtgtgggcaaacttctctgtaacaagctgtcaatctgtcacaattactcaactctgccacggtaagcttgaaagcagccataaaagatacatcagtgaatgcagatggctctttcccaataaaactttatttatagatatttgaatctgaatatcttatcatgttcatatgtcgaaaatataatgtgtctattgtttttttcaaccatttaaagagatagaacccatccttagctcatggactatacaaaaagaagtggccggtagactcctgctgtgggcaatggggaagttttgggaggttttaagaaaaagaaagacaagatctgggttacgtcttcaagaggcctctctggtggccagtaaagaacggaccagtgaaggtgttattccagaggctgggagaccctcaggaggcccttgtgatggtttaggtggaagacagaagggatcccagcaaaggaaatgagtcacagaagctcccctagaaagtgatttccatctgacccattggggcagtgaggcaggtgtccccggatgtttcttccatgaacagcaattgaattgaatgccaaatttgaatttggataacagcctctcgtcctagcaaaccagattaatactaatcactttccctccccacacatatccagctaactttccataaaatgctatccttaataaatccagaaaacaaacaaaaaccttcaatgtctacaataagattatagtatatatataagaaatgtctggccgagcaccgtggctcatgcctgtaatcccagcactttgggaggccgaggcgggcagatcacgaggtctggagatcgagaccatcttggctaacatagtgaaaccccgtctccactaaaaatacaaaaaattagccgggcgtggtggcgggcgcctgtagtcccagctacttgggaggctgaggcagaagaatggtgtgaacccaggaggtggagcttgcagtgagccgagatggcgccactgcactccagcctggacaacagagggagactccatctcaaaaaaaaaaaaaaaaagaaatgtctttattttcagaaatgcaaactaaaatctctagggatgaaatcctgtgatattggtaactgactttcaacatatttcagcaaataaaaaatgaacgcatcaaaaacagctccaatctctactgccttcctcctggcccatgacttgggaaatgcagggcagggtcagcctgccccaggatcccacacacacttctaggaggtaggtgtctctggatccatgtggcctgtgcatgtgatgaggggcctcttgctcctgcagaagagccatctgtgctttgcaaaagaggtcagagtcccaagccatagcagccaagggcagagaccaaagtccagacctgttcctgaagctaaaccactgttgcaggtacctttgctctccgtgatcttttgccaatgacccaaaaagaagctgtgaatttctgaccctgcactcataaatgctggtgtccatcaagcccttaccatgtggcccaatactttatatgcattattatctttcctaaacttcacaacaagcctatgggaaatatactattttctccactttgcagatgaggaaactgaggcttagagtacaacctgtgccatcatacaggtccccacacctgggaagaatccatgcttggcttaatgctctgctatcaccatcataaaattcttcatacattttataggaaccctacattcgcattctgcacaggaccctgcaagttacatagccaatctcactcaggtctcacggctcactggtggtgacatcaggggtaatgcaggcagtaggactccagcacctgcctgccatccatgacagtgttagaaatttcatgtaagtggctatttgattccaggctgctaaaagccaaagccaggacagacaccaggctctgtttgatacccaattctcaacacttttttttttttgagacagagtctcgctctgtcacccaggcagagtgcagtggcgtgatctcggctcactgtaacctctgcctcccgggttcacggcattctcctgcctcagcctcagtagctgggactacaggtgcccgccaccacgcctgtttaattttttgtatttttagtagagatggggtttcaccgtgttagccaggatggtctcgatctcctgacctagtgatccacccacctcagcctcccaaagtgctgggattacaggcgtgagccaccacacccagccccaattctggactcttaactcaggcaggacaaacagttggtggcctgggcccacccaactgccgtgctcagttgccttactccctccactctcagcctccttgagaagcacctttcctctctcggccacttctgtttcctccacagtgaccttggaacggtgactaggagtgctgcaggtggtggccttagaaggacaggggccagcccagtcccactctccggctgtcactgaagaagcacatgctcctcaatggaggaagacagcttcaaagagcatctgagttttaggaagggtaggagacagctggaacagaggccgattctgccagctgtcatcggtctctgatctcctggcaagaaagctggccatagagtaaaacctctttttaaaaattcagcaaaccaggagacataccctcagggtgtagctctgaggttccaatatacatattttcccagggctgagaagactggaaatttctccagcaagatcaaatgcaatgcatctcaacccagacccaccagggcaaaagcagaatctgtccccgaaggtcaacgacatcatcactgacattgagtctagctcaggctctggagctggtctgcctgggcttgaatcctagctctgatgctcgctagctgattggccttggcaagttatttaacctcttcatatctttgtttcttcctctgtaaaacagaaataatgatgcctgcatcagggttattatgaggcataaacaacttaatatatgtggaagaggagcttaataattgctagtgattaaagttgatatcatcattttcaagctctgcttagggacctgaagaaatgctcattccctacctaatgcaagcggggcttaaaacctagatgacgggttgatgggtgcagcaaaccaccatggcacgtgtatacctatgtaacaaacctgcatgttctgcacctgtatcccagaacttaaagtaaaatttttaaaaaatgttcattcccccggaagtagccccaaccttgccatgccctaaatccgctgctctaaaatccctaacacaagcaagaagtattgcctcttcttgaccaactgcaaggaagtgcctgcttctccaggacacctacaagggcagctcacagagccatgcccctcgggggacttcttgaccttggtggtggaggccttggcagacgctcaggtgtttggttccatatttgcttccagataagactgtttagtagacatgcaactgcttagctatgccccaaggcatggggcaagccaccagccagggagggcccacttcctctgactcatctgcacacatgacaggccaccagccccatccgccaatagcaaggcaaagctgactcaggcaacatgagattacgagagcatctccctcccctcctacttcagtccacagcaatctgtgcctccaaccttctttgtgctacaaagataactcactggtccaggattatcatggtacctctgtgacaggctcatcagcagggctgctcttgccaatctcttactgctcagagcctggcccttgtagctctgcctgctcttccctggtcctgaaccttgcttctgctccttggactcccaggttgggcttcttcctggtcagtcttatgcaggtctgaccacaactagtcccactatgaagcccatcagaaatgaggtcaatgcatcactggcccagtttcacagaaagatggacgggggcacaaatggctgctggaatccaggtcctgacaaatagagacttgatagagcatggttgaatatttctcacatagggacacaagtccagaaggcatatggcatctctgagtactggatgtcataccaggagagtctcatctcaaaaggaggtgatgatcatgtatttggccttcaaagcccatgctgctataattttctaagatctgaaatctgagtaatacaacagcagtcagcttcatgaccaagagcccatccttgagggaaactgactcttcctcctctgatgagtgacttgactttccaggcaagtaaagcaggattgagcttactcctgggtctcagggttgcctccctggcctggggcagagcagatgaagaggaagtgggtgttgattcttagtggtttggggcttcaaccttgtcacctacctttcaggcctagcctcagtcctgactcaacaggagaggccaacacacccaactccacttcctaaaggctttggtgcccaaccccaagtcctgatcactactcaggaaggaaatacaaggaaatgccttccaggtaggaaaggaggtataaccatatgtagataaaaaaggaactttccatttctgtaaattgaagtcttattcacacaagagacagattgcagggggctggatttatggggtaagatgattaaattctgtgtcctctttcatatgtcatgctttatcacgcattactaaggatctgatttggtggcaatttgttgatttcttcagttcttagctcagttacaaaaacgcagtgagcaggacttgggtaccctgccagtcagctccttagggtcagagaaacaccgtcagtccacagtgctttataaccacccaaccaccttagacggggccttggtattcactacccactcgtcctcccctagcaacaagcaccaacaatccaacatatacgtaagacttgtgggaagcccttatttgtctttatagccacagaatgtggtacatttaagttgttccataaatgtttttgtttttgttttgagactaagtctcgctctgttgccaggctggagtgcactggcgcaatctcggctcactgcaacccctgcctcccaggttcaagcaattctcctgcctcagcctccagagtagctgggactacaggtgcatgccaccacgcccagctaatttttgtatttttagtagagacagggagggtttcaccatgttagccagggtggtctcgatctcttgacttcatgatctgcctgcctcagcctcccaaagtgctgggattacaggcataagccaccacgcctggccttgttccataaatgtttttaaagaagaacatgctccctgaaatccagcccatacgccattcagtctctgactctgtctctgacagagacactcaagagtgagctgggagaaggcctggctgtctgacatcacctaggaggctgaggtctgacccagtcttccagaccctaagaagtctcacagagaacccagcactcggctgcacttaaggcttccacagcacgctgttccagcatcacctccagctccctatgggaagcccacacacctggccaagggacactggagcatgcactccctgcacagtcctctcagccactctagccctttgctcacgttcttctctgaccccagaacaacctccctacccttctccaagctgtccctcaaaacccattgatcacttaagaatctccatagcagatcttttgtacttggcatactgaactctgaccacatgctgggcagtttgctggatgacaggagtaccaagaggacgaaaacacatgcctgctctcaggccactcagactatcgggggaggtgaacagaggaacaaatggctgcaactcctgcacagtcagactggctggggtgagtctcagccccacaacgcactagccgggtgacctgaagcaagtcgcttaacttaaaatgtctgtttcctcttctctcatatgaggacaagcatggtactgatttcaccaggccgttgtcgcagttgtatgaattaatataattaaagacaacatttattttactcaaaaattactggagtaagaggagtgaaggtaatgcacaagctatattacttggttttgtaccaagctcttatcagattgctttcactagattggtgccctgtgcacatggcaggccctcaagaaatgtttgtaacccttccttgaacatgctctgcactttacccagcttttctgttctcatcacctcttcaacattgtttgtataaaaattatgtattctgcaaggatgagatcagatgccacctcccctaattaggtttacatgcttcatgattcccagacgaacaacttccctgtcttgtttttggatttctcaggcatctaaaaacaggtcctcaccaccttcagttatacccatccatataggtatactatatgctcctatcagaccacagctccttgaagacaaatactgagattcatgcattgttatttggggccaaggctctagcgacagaacaattaaaaagcagtgctatttctgtaggggagcactccaaaactcctttccaaaacctttttctcataagcccatgagccagaatggctttccagaacctcatttttatcaaaaatagaaaccaatctgaccacgcacactttatatcagagtgaaatggaacatcccaaacttttatcaacatgcattttctgttcccggtatataataaagggtcccaatgtttatctaacatttttctgaaatcagtatgtaacactctccacttctgaatctgatggggcaccagtcagtttcatagtcatcactggagagactctgtgccagattttgtcttcagttgtaacacaggatcacatggtcactctactgagctattcccacccacactcttggttctagggatgatgaagggaaaaacaaaatggttctagcacctggatgcagaccgttgcatgttcgacgtccttttcttgtgctccatatgaaacatgtcccagatccttcacgagcaaccctccactgttcagtttcataggagcgcagaaaacaagtccagtttcaagtaggtagtaatttctgtttcatttcatgaacaaaatagagatgcagcaataaattacatgatttgagccctcattagtagacagtaaatgtcactgtttattaaaaagctaataatccattcaattttttaaattaagcaataagactctaatataataaatttgaataattaagcctaatattaatggagtgaaaacatgagggaagaaagaagttctaaaatctttatttttccctccacataaaacatgttaataatgatcccacaggtgaaagaagtttctatgtgcataccagtggagtacttatttgtcaaagcaagaactcacacgtatgcttagatggctggaaatctctagggaagtacagagaactctcctaactcagccctcactattgactcctagctctatttttacctgatctgtttttattgctggactccactctctttccattacatacagcctaagaattttctactccagctagaaagagctctgactaggacacaagtttacaaccaggatggttggtctgtacgtgctgtcttctccctgctcaataaaaggagagcatccttgtgttagaaatagcttggtatctgcggccataccaccctggacacacctgatcttgtctgatcttggcagctaagcagggtctggcccagttaatacttggatggaagaaacaactttgcacaacagttctaaacaaagcacagtttgaacttattcttcctgccacacagccttcccaccacgtgaggccgtagcatcatctctgcttggaaactctacaccaagattgcaccatcacgccctgaagaaggcaagaagccttttctcaggccactgaatataggcttatgtaaacaggcagtataactcagtaggcggagatgaaacatttgcacttctctccaagcattataatgagaaagcaaaactctttatacaagctaaacccttttctacattcttaagtgtccaaacaaacttttccccagcagcctgcacttctatggctttgcattattgggataagccaagagggagggaacaggagcctttcctcctaagctcagagagatcaaagaaaacaaagctagagagtgtgagggattctgcttggtgagcatttctcagcagagtggactttctgtgtctgggctgcgggcccctgagtgtccggtgctctgaggacaccttcagtggaatctgtggaaggtacacatcagatctgctcccagtaataatgccctgctttgcagaggctgttttgctttcccaggtgctttcatgtcttttattgatcaacaagcaaacacttactgagcgcctatcagatgcagggccccaggtggagttatctcaccgacagatcatctcacggccccagtcttcagatatatgtgccactctgaaaagaaaataaggcccagatctgccttcaagatgtttatagtttatttggagacataagcagagtcccacagaaagagaaataatactgcaaagcactctattttaagttagtcttcctcaaactttgatcataatcacaaccacattaggagcttattaaaagtcaaaggggcctggatcacatctttggagattctaattccatgggaatgaagcctgggtccctgtatttttaacaagcagccacaaagattaaaaatttaaaacctaagacagtgcctaagtggcaaatgagacagtcactcctgttggccgaggtcaaaggactccagcaaggtcagacataaaagagacctgcaagggcagacaggaggctgagagcagaaaggcagaaaggggcaaggtaggaagttaggagggagagggggatagggtcccaagaacaagtgcaatattcatgtaggggacagaatgcagaaaattctggatgtaggagaaggctgccctagaggattgagagatcaagacagacaggtaggtctggagtccagggccgtgggactgcagtctgggccctgatattttatcatatcaaagtaaggaggatcatgaatgacaggtgtttactttagcctggaggcaaagggtgcctcaggaatggcagggccatgagagcagagaattttagacagaggtcccgtgctaggcctggattgaaaccatcaggaagaccggaagctgggcccaaggttctagtaagatattttaatatcctgttctaccctcaccacagatcaacgaactcagcaagatagataatattatcttctttctgtagagagaaaactggagcacaaagtggccaaacagcaagaggaaacctggggaagccagaacagccatgtggctggcgctcatctttgacaaatcaatccactgcatttcaagcctattcaacatacatttattgagtgcctactaccagcaagaaacaagaagcagcaagataaacggagtgccgttcctgccctcagggagctcacctcccaggggaggagctggcaaacattttctgtgaagaaccggatagtgaatacttcagactgtgcaggccagttagtctctgtagcaaatgctcacctctgacatagcacaaaagtggccatgcacaatacacgaacaaatgagcatatctgtgttccaataaaactttatttacaaaacatgcagtgggccggattcgacctgtaatgtaccaatccctaatctagtgggtaaaacaaaccccttcatggctacttataaaacaagagaggtgtgttataaataaaacgactttgcagcccaaaggaaagatagagtaatttagtctggccatggatgactggggaggcagcactggagtaggacaagtacttagttttctaggtctcagttaaaacgatggggctgaatcagaagcacatggacggcccttcttgttcccgtgttctctgacttggatgtggtgctcctttcctgcccagagtcttccaactgcacaaacaacgtggcctctcccaagctccctgggcctctcctcacctctaccatcaagttttgaatgtcaattaaggaataaaaattcctaaatgatcctggaaggctgaacacacacacacacacgcacaaagtgtgtgtacatcctactgtgtccggaattggtgggttcttggtctgacttcaagaatgaagccgcagaccctcgcggtgagtgttacagctcttaaggtggcgcgtctggagtttgttccttctgatgttcggatgtgttcggagtttcttccttctggtgggttcatggtctcgctggctcaggcaggagtgaagctgcagaccttcgcggtgttacagctcataaaggcagcgtgggcccaaagagtgagcagcagcaggatttatcgcaaagagggaaagaacaaagcttccacagtgtggaaggggacccgggttgccactgctggctgcggcagcctgctttcattctcttatctggccccacccacatcttgctgattggtccattttacagagagccaagtggtctcttttgacagggtgctgattggtgcgttcacaatccctgagctagacacaaaggttctctaagtccccaccagagtagctagatacagagtgtccactggtgcattcacaaaccctgagctagacacagggtgctgattggtgtgtttacaaaccttgagctagatacagagtgccgactggtgtatttacaatctcttagctagacataaaggttttccaagtccccaccagactcaggagcccagctggcttcacccagtggatcccgcaccggggccgcaggtggagctgcctgccagtcccgcgccgtgcgcccgcactcctcagcccttgggtggtcgatgggactgggcgccgtggagcagggggcggcgctcctcggggaggctcgggcagcacaggagcccacggaggggcagggaggctcaggcatggcgggctgcaggtcctgagccctgccctgcgggaaggcagctaaggcccggtgagaaattgagcacagcagctgctggcccaagtgctaagcccgctgagcccacacccacccggaactcgcgctggcccgcaagcaccgctggcagcccctgttcccgcccgcgcctctccctccacacctccccgcaagctgagggagccggctccggccttggccaccccagaaaggggctcccacagtgcagcagcggtctgaagggctcctcaagtgccgccaaagtgggagcccaggcagaagaggcgcccagagcgagcgagggctgtgaggactgccagcacgctgtcacctctcactaccaccgccagatgctaagtctaaatttatttaaatttctaaaggttttctccctccttcccagaacctctccctcctgaaaaaggtccagctgcttctgtaccagacactctagcgagactcaaatgttcttcctgaccaaatgcccacctcaagaagaacctggagccaggaagaaaccaagggtggccacacacctcatctgccctgctgtgctggtgccaggcgagaaaacagaaatagagccacggagctcaacagcaacacctcatatggtgccagcagacagcgagcaaggcccaggcagataaacacattaaggcaggctgtgcagcgcaggccacgtccaggcctcagagggacttcatctcagccagccaaggtcaactccattctaaggcttagtcagcctcctcctctgggggctcagactcccctggccaagatcactcatgtaccaagaggattggacaaggccacgagtgaggccaggtgccagcagggcaaaggcaggcaaaaggcaccacagatcgcatgtggtggcagcaagccagctgtgtatagattcaagcctcagacccacctctgaaaatcctaccctactcaagcctgaccacctcctccaggaagccctcctggctcttgctaattagcagtaaattgtgtgttctcttaacatctagagtaatacttctcaacatagggttgcgagaccagcatcatcaataagcaccacctgggaagttgctggaactgctgttggaagttctcaggccccacccaggccaagcaacttagaaactctgagggtgggacccagcaattggtgttttaataatgtcctcctagtgattctaaagcaggctgtggtttgggagccactaatccaaagtctagattctaaaccactaactggacacctgtgttttacatgcaatccctgtgctcctggcttccctgggaatgtggttgcatttcagagcctggatcgcacatgcccatcaatcccccaccttgcccagcccaggatgccacagcaagtacttcctcagcaaacacctgtggaatttaattagcttgagttcagataccaccatcaggttacaaaatcacagaacctgaatgctgaaagaggctttagtgcccatccagcccaactgcccatcaaggctctgccaggacccagcttctccacgtttctctcaggtcaggtcagatgctccactaatgcctgggagttcagtctcattcgttcgcccagcaaatattgactgagcatgggtgcgaggcacacacagatgttcctgcacacaagtgaacgagaccaatgagaatccttgctcggagggagcagatattccagtggcaggagagacccaatcaatagcaataaataaataaaacaaaaaaaaacccatatgctttaaccattagaaaacatcagacacaccaaaatatacagaccgcctatgaaaataactaaccagcactcttcaccaatgtcaaagtcatgaaaggtaaggaaagacgagtcacaaaagcacactaaggagacatggtgggtacatgcaatgtgggaccctggactggatcctggaaaagaaaaacagcatcagtgggaaaagtgatgatatttgaggaaggcttaaagtttgacatgcagttttagaccaacatgaaacttgttcttttctatagtgatgtaagatgtgaacaattacgggaaactggctaacaggtagacaggaattctctgtactaatttgcaaattttctgtataatattttgatggcaaatccagttgggaaagatggtccaaataagaggtgaggtgcagttggcatccttaaatagagaagtgacatgtgggcaagatgacatttgggcaagacccagaggcaggaaaggggccaaccagtggcactgtgaatgacatgaggccaaactcagtcttgccaggatgtttacccgtttgtgcttgttcttctatccagatgaattctgaccacgctttgaacacttacaataatgctggaggaccctcagtcttctctttagaggaggcctcacagtcctgcagctgtgcccactgagtgtgccccggcagcctgagcccctggagtggacagtaagagagagcgcacaaaggcagtggggtccaataaagaccaaggttgagaccaggagcacctccaccttctttgttctggaattgccctggtctctttttcttgccagcaaaccactttagttcctactttctcctctctttgaccctgtgcccaagcttctcagcatgtgagcttctcctctaagcactgtccacatgcgcccagaaccttgagcagtggagctcagagcagggttgacgtgagtaagcagacatgagtcaggctgagactccacctaatgactaaggatcaacgtcccacccaaagttcccatgtctagcccttcagaaaggacagggaaccataatccaaagtaaaacagcctactccctaggaatgacagcccacagtcctgagttctagggacctcaaataagtctctcccttccaggcgccaggtcaccatctataaagcgatacatttggattagttaatcctcaagatgctttccagttctaacactgcataatcagtaatgtatcaaatgaaattgtgcaaggtaattgcagctttgaagtacaatgtggggtagtaatggtagcagtgatgagatctatgggctcctaccccaagtgaatcaccagaattggaaatggtaattgttactattaatataataatgtcttaaattgcagagtgcttttccatttacaaagcatttttatacacattatcttgtgtgatcctcataagaacccagtgaaagtggtaggaaaaatgttatttctttggcatagatgaggaaacaaagttcagtggccattcaattaggagtgacggtgctcagccctgagcgtaggactcaatgcctcatcttctttctgctgcttggtgctgtctttgctactccaacaacctgtgcaaccatctgtgattttgtctctctagtttttgaccaggttagttcaaggcatctgcacaataaggaaacccaggcattcccctggaggggaaagcatccaaattgtgcccagagctgccttggctcggtccatccattgggctcctgggagcacagtcctcgccaggaggggaggtagcagtattctccatttgtctccctgcagctcaaaatagaacagatgatgtatcacagctgatctcactgcagcatcagatgttttaaaataattaaataaagagaaatgggagtgtgaagaaaaaggccccaatttttcaacgctagtgtcccatgaaagtgaaaagaaagggacaatggtcaaagtcaaggtgagggggcagctcccccagaggtgccaggtttacagccgttctgtccctgccatccaagctttcctaccagtagcaatactgtcacccctcaccattcggttgcaatttgcaaaaggcaagagacaacttcctttcttgccacactctaggatagaagaagcactccagccagccaccaatttcccctcgctaagcagcccttttctcccatgcccactacatgcagagggtgacccaggcacacccagagtgggtgctcttgtgtcctgtcggatggggccagtcagcatgagagctctttgttcaaaccccgtctccctaccatttgtgtccctacctaagtgcctacccttgcccacgacacttatctccctagacctcagtctccacggttctgaactgggagttagaagcactcatcttacttcctcatagggttgtcagtgctatgaggatggagtgagatcacacttgagaagacacttcaaaaacttacaagtcccacagggcactaagagaccatggttcaccaagcacctggtcaggactgataacaatggcgtatggctggcctttcccagcctccctccagttagatggactggaagatcaagttctggccagcagaatgtgggcagagtatctgctctataaagccttcacacacgatcctgctccctctttttctcctctgccagctgaagacccagaggaggattctgggtacctagaaagggcagagccacagacacaccctttgattgtgttacatggctggagttgagggttgcttgctacagcagctaggccacctggactagcaaaatgtcccagtggagtagctgcctagaaaatctcacaatgaggttgtaaattcaagtgagtggaaaaaaaggttttagtggtcgggcgcagtagctcacgcccgtaatcccagcactttgggaggccaaggcgggcagatcacgtgaggtgaggagttcgagactagcctggccaatatagtgaaaccccatctctactaaaaaatccaaaaattagccgggcatggtggtgggcgcctgtattcccagctactggggagactgcggccagagaatcacttgaacctgggaagtggaggttgcagtgagccaagatcacgccactgcactccagcctgggttacagagcaagactctgtctcaaaaaaaaaaaaaaaaaaaaaaaaaggttttagtagcaaacagtcaagtttcctcataattcttccacccagtaataggataaaaatgagaccatataaaagatgtaccccggcacatggacttcggggccccatagttctgtgacgtctgtgttcaacctgtttgtggaacagtcagtacagcacacaccaaaatgcagctcccatctagattgttgctgaggtgctcttccttttctcaaacacctattaatagatttacactcctgacaataaagaagcgcggatcaacctctaactagccagacaggctagtttttgttttgttttgttttttgagatggactctcactctgttgcccaggctggagtgcagtggcgcaatctttgcctcccaggttcaagcgattcttctcctcagcctcccaagtagctgggactacaggtgcgcgccatcatgcccggctaatttttatatttttagtagagactgggtttctgacccatattggccaggctggtctcgaactcctgacctcgtgatccatccgcctcgacctcccaaagtgctgggattacaggcgtgagccactgcccccagcccagataggttagtttatccaatcacagtatcaaatgccctcctaatgtggacaggccatgctgggccacataagagactaataagccactagaaaaaaagtgggggacaaaggacatgaaagacaattcacaaacataaaacaaatggcccccaaacatgtaatgttcacccttactcatacaaaataaatcacgtctcacccattagactggcaaaaatcaaaaagggtggcaagatctcgaattgccgaagaagcagggaaaaggcactcacttgtactatctgtggacagggacactggttcctctccagagatcaatttcataatatctatcaacttgtaaatggcaagtccctttcaattcagcaattccacttctagaaatctatccaaaagaaatcctcatacatgcataaaaagactcatacacaagattattcattgtttgaagtgcaacagatgggacatggcctaaatgtccaacagtacaaatcacacaaatacatttggctactaaacagatgaaaagtctaccccaaagtttacacgatcctgctccataacatccggagattgggggttgggggaactggcaatcaagcgcatacccacagaggttgtaccaggatttacatgcgcacaagaagggatgctatggggaagcattatccttaagatgctacgggagcacaatccaatgttcgacaaggtgtgaatctgtttccatgcagttccttggtgttgtgcttattttaaacatatggaaaattagccataatgcaaataacacagcaacagctgtgttttcatcttcttggctattttgacgtcacagccatcaaatacaagctccaaaaaagagcgaatgatattgttcccagcagcacatgccaaaaggccacacaccttcccacgggatgaaggattccagggacatctctttttataggtgtgacttcccctctttgcagagtagctatttagcaactagagggcaaagccaggcaactgagacttaggaacagaattatatcagagaaattggcgacaacctttctggagcgaaatctaacagtgtctattaatattctatatagacatacaccttttgacttaggaattccgctctctcaacaccagcatgaaaggcaacatatatgagatgtagtggagaaagaaaccataccctgacaacaacctgaaagtccatcaaaagagaatgattgaaaaaattatggtacctctataccgtgaaaattctgtaattatattttaaaatgagatctatatctacaggaagatatagatctcatctctcctgcctcaggagagatgttcaggatgaaaaacgtagttatcaacaatgtattgtatatttctaatgcatatttcaaagtagctagaagagaaagaatttcagatgtccccaacacatagaaatgataaatactcaaggtgatggataccccaaattccctgacttgatcattatacattccacacatgtaacaaatatcacacataccccataaataggtaaaatattatgtatcaataaataataataaattgaaatttaaaaagaaaagcaagaggcaggggacaagaatgtaataagatcccattttcattaaacaactgaaaagccatatacaaggctcacaaggccctacccaatctgccctcctccaattccttcccctccttctgtgacttcatttcctgcctttattcctgtcacatgctctgctctgtcccattgacaggacacatttctaggtacatcctgccccagggcctttgcacttacccttggcctcagtgctccttccccagaaagccatatggctttctcccaagttccttttggtctctgtgcaaaactgaccttctcagtgaattctaccctgatccctcctttaaaattacaaaacagggaggaactttatcctgttttatttttctccatagcacttatcattggctgcattcacttctctgtaagatatttttgttttgttttgttttcatttttattgagactgagtctcactttgccacccaggctggagtgcagtggcgcgatctcggttcactgcaacctccgcctcccaggttcaagtgattctcctgcctcagcctccccagtagctggattacaggtgtgtgccaccacacctggctaatttttgtatttttagtagagacagggtttcaccatgttggccaggctggtcttgaattcatgacctcaagtgatccgcccaccttggcctcccaaagtgctgggattacaggcatgagccactgcacccggcccactgtaaaatattttaatcccctggactgtcagctccaagagggcaagggtttttccctgtcttgttccctgtggcatccccagcacctagcacacagtaaatatccagcaaatttttgctgaatgaatggaaaacctgtttgcctatcttgacccgggcctggggaaataagtggaagggtccaccctaggccctaagcacttggccaggaaagctgcaggagaggagtgcatggcatccgagagccatcaaacagtaaataagaaagactttctttttctccatattatgattccaccagttgctgtgaacatatgctatttttataacttttgaacacacattaaataaaacaaaaaagcaaagatgtaagtcagactcagaggagcagtgtggaggggaggggagacaacgcaaagagagagggacccaggccacgccaaacaaccgcctggctctctcctccctcagaagaacccatccctgccccgcatccagtgcagcaagcgtcctgggaaggtcaggctgtggctcatgaaagacactacagagtagatgctaacccaaatccgaacactcccagactctccctcccacccagctcagctggtactagaggcagacaacgaaaagctggcagaacaagacaaatggtggagaaagtaaggtctgaagaaggtggggtgggtagaaagcagcaaaaaggaatgagggttggtccagggggccaggccccagctcagcctcctagtcactgagtcagcttgggcaagggtgctctaacctctgagcctctggttcttcctccctaaaagtcaaaataaaggtatctgccttgccccagtgggctggatgtatacgatactgctttatcatgctgtacaaatatcattagaaagagaatcagcagcgtggatgcctcactggataatgcaaaaccccgccccacacggagccttggtttcctctattgtgttttccaattatttgctgttggtctatcaaaaatgcatttaatatgcattttaatatctgacctttggccacctggctcaactctgttgcttctaataatttatacattcggagtctacgatttcctccagccagatgatggctgcaccagaaaataatgatgccttcatctcttcctttccaagacttatgtctctattggttttctcttgtggtattgcgctggctctgacctagggtgcaaggttgaataagagaggtgatagtgggcgttcttgtcttctttttaacctgaagggattgcatctcatgtctatctatcaggaataaggtttgctagagatttcagtagctatctgtcttcagattaagtaagttcccactgcgcagagttgacgatgtgtgatcatgaagcacctactggatcatattgaatgtcatttcagcaattagagagatcattacatgattgttctcctttgttttaatagaggtctgcaaaacaaggggatgcctctacccaatactgcctttcagggtcaggaggaacaaggcctgggacccggaagataatgacaccactcccacctcagccgccagcctgagcccctgatggtccgtcctcctgtgtgccacccctcctctcctcaactctgtagctctctgggccaatctccttcacctccatcctgaactctcactagtccttaaaatgccacagacttgtccctgtgtgaagtcacaagagaaagctcactgccaaccatctccatgtcacaagaagtcaccctgagcatacgctgtgggaagcaggctgatcgcatcattttttcaggatgagcagttcaggattctgatgcaaagactccacatccaccttggcacatgctaagattcacatgaagctattccaaaatggaacaacatacctaggaggcagtgagctccctgctaccaaagatgagaatgtccccatgacatttgctacagaggtatttctacaaaagatgaagagtgacccagagtcatctgtaaaatgaaggtaatcagacctatcaaaaggtaatggaggaggaggaggtggcagcctagtggggagagcaggaggtgggatggactgacattccaagcacctgacatacacctcgtcacttagtcctcacagcagcccctgtggctatcaggacacagagaagttgctacaaaacacacacacagaggccgggcacagtggcttatgcctataattccagaactttgggatgccaaggcaggtggatcacctgaggtcggcagtttgagaccagcctgaccaacatggagaaaccccatctctactaaaaatacaaaattagccgggcttggtggcacatgcctgtaatcccagctactcaggaggctgaggcaggagaatcgcttgaacccaggaggagaggttgcggtgagctgaggtcacgccattgcactgcagcctgggtgacagagcgaaactccatctcaaacacacacacacacacacatgcacacacacatatgcgcacatgcacacacacacatacacagacacaccttgttcaaggtcacatagtcagtaggtgacagcgcccaggcatgcaccaagggcttctgttccagtccttaagctcactccactccaccactccccctcccaggctccagggtatgcttgtcaaactgcctaacacagtgacagccacataatgggcacttaatgattctccccagattcagatggtcagacatccctcccactgagcaaagtcaattttctcatctgcgaagcaaaagagagacttcatcttggcccttcacaggcaggaaggtctgactgcctggcttttacggtcagcccttgccacctttgcaaaatgtattcagaaacatgatctcctttgagcttcacacctctaagaggcagggtctcggcagagaaggtcactggggctcacgtggggaaggttctgcctgaggtcccatgctgaactagcacactcacatccagggacatcagccacctttactatctccaccccaaagcctcatgagtgaaaaggacggacgatctctaagatgtcatgaaaacacggagatacaattgaacctatcttcaaacccaaatgtgtgccattgactaatgtgtgatgtccactctctaaatggtgaagtgaagaagcagtcagcataagattccgccaatcaagcacaaataacaccatcgccttagactcggaccatgtgatgacctttatacccgtggattacatattgactctcctttcataatctaggcaccaaaatatctgctggcagcttattcccatcagctgcaggacaaagtagcttctgcatttggttccaagacaggagtcagcaagacactggaggccacagtccaatcccaatggtctgtttattgtctgaggtcattaccatggtgtctcctctccccgggccctggtaagcaccaaggccactttatttgtcagtgactcaaccaggaaccacatggacttcaaggcaacctcctggccctcaaggacacagagtagctaagccaaggatacagcaaattttttggaccaagagccaaagcaggtggcgcagactctgctaatgatcagatccaggcagtacagagttctgagcaagggatatagcaggagtccagctccagctcccttgatttcgagaagagccacaccacctaagaaactcaccttgctcctcatcaaaactgccctattctaaatggcactgagaatgagactgtcctttatacttttcaccatcccagttggtgggaggggtcttttgaatgtattcccacttgtgagggacacaaaactcaccaatgcctgacagcaaaatctgggggcaggcttcccaggtctcccatgtctgccctggcactgaagcctggtttgggggagacggggatgcgcttgtgataatgccaactcttcaggttctgagcactctcatgtctgtcatagaataggataggggttcactattgtagcatgacacgggctcagaaaggccacctattgtatgagcacatttagatggaatggccacaaggggcaaatccgtacagacagacagcagttcagtagcgtctgaggctggggaaggaggggtgtggggagtgactgctcatgggtatggggtttgtttcttttaggttgatgaaaatgttctggaattaaataatagcaatgattgcacaactctctgtatatactaaaaaccactgcaaatgagtaaattttatagcatgtgagtgatacctcaataaagctcggtttttaaaatttgatggtgtagaagaatatggaggtagcacactaggaggtgcttccctgccccacaagctgtctgtcatttgtcacctgggcactgggcacatatcagtcctacctagcagcccttgcaatcctaccataggagaccagcaccccacacgggcatttgttcagccctccagcagcccctcctgccagccaaccaccctcatccctcccgtggatttcggggttctgagtaaccaaagcaagcatgggaacattctcagagcatgtccaggggacacctccgggaatatgcattcatctcagaggggagctgagtgcttatttgacaagcacaatgtaaccaagccaagaatggggaagggtatgaaacaagagaggcggccctcttccttctcagggaagccggggctggcaggaagtggggctgcaagtccaacagctgacaccatcgtctatgttcctctgagctgtgtgcaaggaagagtacagtctggggctgcaggcatgacagacttcagagggaaacaaatcaggcataaaaactgctagaggttccattagcaagacagagcaaaaaataggattcccacatcccccctggtgccctcagggctccttgtaccactaaaaataaagcaacaggcaatggtgtttttaatgccagcgttcgcaggacttcctgcagagtcaggcttgcacagcttccttcggtcccccccacccatctccaccccctcagccatggatttctgcagcaccaggggccagcaaggagcccaggactgaatgagatgcgtccatggatcatgaggctgagatagatttccctctgttgtcccacttcaaggatgcagtctggagcttgcaatccaaacagggagacaggttctgtgtcccttcaggagaacagggtctgagcatttgtgtcataagcagggaaggagagggacctcagatccagtccatgattggacacacctccctctaacctctggcatcctggcaggcatctgggaggaggagttagaagaggaaacagctggggccgtaagtcaggcgagttcacacccaaccacctgccccattacacagcagaaagcacctcccttactccttccacagcccacaccccacaacccagcccccagggctgcccagtactagctcttgacagaggactctagtctctcagatcaagaacagccctcagaaaggcaatatggctctcagtgattctaagtgcagacactggcattgggctgcctgattcaaatcctgcctctgccacttgctacatgtgtggccttagacaagttacttaacctcagttcccctacctgcaacatgaggttaatgacatttcctgcctccaggactaatgtgaattgctcacaacggtgcctgacacataaaggtgtgtgataaaggccagatattactggggaccaactaacactatctttcctagggagccactggcatctgaggctggcagccttctcttgattctccaggttgccctgtgtgcagcaggatgccaacttgtcctggccccgaggaagtgaatgctaggagttgctcctctagtctaggtgacaatcaagtcagttcagtggtagggacaggattcaaaccaagctttgtctgaccctaagcccatggctttcactaccattctacactaaactatcacctgcaaaacccacagtgggcataaaaagcctcttttgtcaaggacagtgagggacatagtaacagaaactgaaagagaagaaaaaaagaagtctcaagaaaaaacaatcagcaggcatgatatttattttagtttttaaaagttgttggccaggcacagtggctcacttctataatcccagtactttgggaggctgaggcaggaggatcacttgaggccagcagttcaagaccagcctgggcaacagaatgagacctcatttctacccccaaaaaatttacttaattaaaaaaaattagctgggcatggtggtgtgcacctatgtcgcttgaactcaggaggtggaggctacagtgagctatgattgcaccactgcactccagcctgcacaacagagcaaaaccccatcccccgccccccaaaaaaaagagttgcctaattcttcatctcaggtcccttttagaaaaacttatgtcatatcccataaaccaggctatcattccttcctaaagattagtagacctaagtaggcaactagaaaaacaacacatccgtctgaggtctcaggctcacctggaaatgcaggtcctggcctccctgcctccaccctcccccaccccttccttgtcaggcagcttgggccacccaccatatgccgctgcagcccataaagactctggaacatttcaaaggccttggcccccatcaggtgtggctccaaaaaacacagggtcacctataaaaggttgagcacaaggaaacagccataaaacccgcagtcctaacagcagacacccagtggccagaacaaagcagccagctgccgggctttccaggaaccacagagggacatccctcccaaggaccgcgcccagccgcagcccaggggcacatggctgaaaggtcctcagaggccacctggtaagaagggccctgtgttgggtgcttgctagttgccagggactgtcccggatgccctccttgaagagggttaaggaggtaacacaggaaagagctggcatggtgcctgcagccctgagggcctctaaaagagatgcttcatctttcctgagcttcaaagcacccggcaagtgggacgtgattcccatcttttaggcggcaaaactgaggccctgaggagtaacacaactaggaagtgagcttcaagccaagtctgtctgttcatctcatgctttctcgtgggttcctggagaggtcagatgatgggctgtcagtgctcaaaggggcctggagacctcccagccctctgctgggtaccctccctacacagtgcagccaggcttccaaggcagcctccctcctctgctgggacagtcgtcaggggtgtttcagaaggagcaagccccgagcagcctccccacactctggcccagttgagggaggtgacagggcgccatctcctgctccctttctggaaagctttcccacatcccaggccaggccctgcaggccctcaggctggctgatacatggcaatgacaacagaaatggctcacacttggtaggtgcttcctaactgccacatcctttacacacaactgcacaaatgctctacatcagggatgcccatgttatagaaaactaggacttatggaggatgtgcaacttccccaaggtcatgcagctatcagcagccgagctggaactgaatccatggtcctcaccatgccacgctaccctgcttctgcctgaacgcaagcaggtgcagataagccgcaacacccatgactatacccacacactaccatcttcccagccgcatggcagtgctgcggcctagacccatggctcaggctctgccatccacccttggtgcagccctccagcctcccagacacccctgcatcagcctctctctaggtaacagataatactgctgaaataccaggctggctttaagttttgggtcccactgtcccactgtcctaagtcccactctgacctgtgggactaaaaggagggatgggacaatcattgctgtacaagcagctcctccagagaaatgcccagacccagagcagcaacccctcatggccctcaaaaaggcatctttggccaggcacagtggctcacacctgtaatcccagtgctttgggaggccaagaggggacgatcgcttgaggctgggagttcaagaccccatctctacaaaataattaaaaaattagctgggcacagtagtgcgcacctgtagtcctagctacttgggaggctgatgtgggaggatcacttgagctcaggagttcaaggctgcagtaagttatgaccatgccactgcactctagcctgggcaacagagtgagactatctcttaaagaaaagaaaaaaggcaccccttcctagagtccagaaagacgtctgtatctggcagtgcccgtcttcctaagtcctttctgagggtcctgagctgaggggagccaaggatgcagcttcactccatcactgggtggtctcctctgggaacttggagtattcccttcctgcagcaggaagagccaccaagagtttatcgtgttcagtccttttagtcacctaatgcccacaggcaccttgacaccatacaaagaacccctctggggaagccaacaaccccaaaacccgtgcaacccttgcaccctctgcagccagcccttggtagtggccttactgtactctccctctccatgactcagtttgcctccaataagccctggggcctcaagttcagactcacccaactagacagaccagaagtgagcctctgccctgacatcttcaggcactcttttgtcaactactcacaaggatttatcagataggaagggaaaaggacagaaagaactgtgggataaggaaggctctgaatgtcagaaaagggtctgagtaggatgatttgagactgaagaagctacgtggtatcacttaggagcaataaaggaaagattagggcaggtgaggaggataatggacagtggagcctggccagtgccagctgacggactagaccgatcttcctacctctgcttgcaaaaggcattgcttcctgcttagcatgcctcactgattcccataaaaatggcattcatctatatgctgaggtgggctgaatcatggccctagaagatgtccacgtcctcatccctggaatctgtgactgcgaccttaactggcacaagggactctacagacataatttaattaaggaccttgagatgaagagattagcctggatcatccaggtgggccctaaatgcaatcacaaaggtccttcaaagagggaggtagagggagatttgacacagaagagaaagtaagagatgtgatgatggaaactgagatggagcaatgtgctttggatacggagcagaaagccacaagactggggatgcaggtggctactggaagctgcaaaaggcaagaaaaacgacttgcccctcagagcctccagaaggaaccagccctgcagacgctttgactttaaaagcccagggaaactgatttccgacttctcgccttcagaactgtaggagtatatttgtgttatcttaaggcactatgtttgtggtcgttacagcagcaagggaaaactgacacccacactcagccactcgagaggtcccttctcctgctcaacactgctagccattaggggttaagtaattcacaaaagagacccatccctgccttcccgtaacatattgtcatcctctttcctccatcctctttcctagggtccctgtggcctggactatgctgctttctgcctaagtcctccccgtccttccagctctcattccttccatgaagctttgttccagcctcagagtcttcaaagacaccattcctctgcacgtccccctgcacccacccctggctaatgcctcttcatcctgtagatctcatttcttttttttggagacagggtctcactctgttgcccaggtaggagtgcaatgatacaatcttggttcactgcaacctccacctcccaggctcaagcaatcatcccatctcagcctcaagagtagctgggactacggggatgtgccaccacgcctggctaattttttgtatttttcgtagagatggagttttgccatgttgcccaggctggtctcaaactcctgggctcaagcgatccacccgccttgacctctgaaagtgctggggttacagtcatgagtcaccatgccgggcctgtaggtctcatttctgcagggaagccttccctgagccccggccaaggagaggatgcacccccacacacacacgcattatagtccatagtctctcatcacactccaggctgaagtgtgcatatacgtgtgtaagaggggattatctgttcaatctagtcactgatgatggaattgctcagacctctgagggcagggaccttggttgtcctgttcaccagtgaatcaactctcagcctgttatagacacttgcattgatctccctctgcccagaactgctttatttaacatctctatcaaaaagaaccgttgcatagacatttttccaaggaaggcatacaaatggcccacaggtatataaaaaggtgctcaacatcactaatcatcagggctacacaatcaaagccacgatgagttataacctcacacctgttaaaatggctataagcaaaaaaagagagagagagagagcaagtgctggtgtgggtataaagaaaagagaaccctgttacactgttggtgggactgtaaattgataaagtcattatggaaaacagtatggaggttcctcagaaaaatcaaaaatagaactaccatatgatccagcaatctcactactggttatatatccaaaggaaatgaaatcagtacgtcaaagagatgtctgcattccaatgttcacagcagcattattcacaatagccaagaaatcgaacctatctaagtgcccaccaacggatgatggataaagaaattgtggtacatgtacacagtggaacactattcagcctttaaaaaagaaggatatcctgccatttccaacaacatggatgaacctagaggacagtatgttaagtgaaataagccagggataggaagacaaatactacgtgatctaatttatatgtggactcttaaaaagttgagctcataggagcagaaagcagaacagtggttaccaggggctgggatgggagaggaatgctggtcaaagagtacaaactttcagttaaacaggaggaataaattcaagacatctattactgtacatcatggtgataacaattaataacaatgtattgtattcttgaaaactgctaagaaaagagattttcagtgttctcaccacaaaaaataggtatatgagataatgcatacgataattagctcaattcagccattccacaatgtatacatatttcaaaacaacatgttgtatacaataaacaagtacaatttttatttatccagagaaaattttaataataagtgttcattttaaaaaaaaaaatacagccaattggcactctcaggcctgcgtcaggaacaagaggaagtcagggctcaagtttcaaaaacacagactgaaaataaagccccaaacatactcaaggatggaactccccacagcctgtcagcagtggacaaaaccttccatagcagaagctgcaagtaaaagatgtctgtgtgggaggaaccatttagaaaaagcagtaacaaggcgatgaaaacagaaacaaggcggccagtcacccaccatccccaattcgcccaaaggccaggtcaccctgttcccaccctgcaccagctgctcctctgcctgcggctttctggcccaaatcctgtgtggccctcactttctcctcagtcctgcctctgccatatgaccatctcctcctcaaaagaggcttctctggctacccaccaaagcagcccctctaacacacacaatcccatcccctgttcagtggtctcatggtgccactgtaaattatctcattcattgatttactgaagtgttgattatctgcaccccccaccacacacactgaaacccaacccagccctttctgttgcagtttcccagggcttcagacagtccttggcacatagagggtgccggagaatccagaatgaccctcactgtgcatatccatagctgccctcactgagccgcagcctcgggctgccccaaaaggtaagcggagtacaagggtggaggctctctctctctctagcacagaatctctttcttccagagtcggccagcggtgctgtctcttttctgctgggaaagataggaatggagattccttgaggtcagacacagtagatcctagtcagaaactcccattggctaagtgagagaagccagacacaaaaggccacatattgtgtgattccacttatatgaagtgtccagatcaggcacatccagagagcccacacagagtagaccagccagggactgggagcagagggaatagggagtgactgcttaatggtacaggacttccttttggagtgatgaaaatgtagataataatgatggttacacaactttgcgaataagctaaaaaactaccgaactgtatgtacactttaaaagaaggaattttatctcaattaaaaaaacaaaaaagcacttattgaaaaatgccatggagtggttagcagagcaaagctctggagtccaactgtccaggctcaattcctggcttaagccatgagctatgtgaactgagccaaattacttggcctctctgtgcctctgcttccttgtctgtaaatgggggtgataatcatgccaatttcacagggatgctatgaggattaaatgcaaccacccatgtgtaggggactttggctaactcctttccaaacttccaccttccccattccttgcagaccttgttttccatttgagatccataaggttctgaggatactgacaataatccctggcttcagccagttcagttacagcaactctcagaacctgtgctaggaatgctggtgcaaaggtgatttatttcctgacaaggttgagcagatcagcatgtgccctccagagctgcagcagccatgtgtgaacccagaggcaaaccagcctcaggacaaggccaactgtaaggagagcagattagagtgacagaaagaaactgggtccatggagacatcgttgagccaccggatcaaggctcatctgaagtcatccacctttccaactatatgagtcaatggagtccctttaatgttaagcccattgaagtgagcatttctgctacatgcaatcaaaagcttatcactgattcagctacgtaaagtccctcatacccagcccggcacatagcgagttctccattaagtgtgacttattatcatttttttttccaagcttctctgctgttccccaaggccagtgttcacccagatgtctagatacagaaactgttctactggtttatctagatccaatcctatgtccctgtaatggcaagccacagacaactttaccaaaaacccttgctgtgtgcaaaatcagtgcacacagcaagcattcatggggcgaggtactgtgtgctcagacaagactaggtacgcaggggacagcacatcagggaaggacaaggcactctgatcataagtccaaagaggagttcataatctaatcagcaaggcaagatcaaggtccacaaaacagtaaagtatatatttgactagtgacatgatttaagaaatgcaacagtgcaagctaaaggagtccagagaagaaagagatgggaatcctggtggcattctggtttctcctggctcccaatgctcccaacacatggacctaaccagatccaaaaacatcctcccaagaacatatggaggccacaggacatcagagcccagcaccagaccttgctcctgcaaatcccaaagataatgtgcacatttcacggacatggccaaagacccaggcacattctaggtcatggtcacgaaactggctgaactagtcaagaagtcctatcatcttttcttctcccaatttattttctttttccctctttttctcccaatgcagtaaaaatgtgatgcatgaaacaattattcttcagaactcaggggcaggtggggagcctcaaatctggagaaagcaaaatgtaaatgatgcaaaaagagatcaagatccatgaatattcatcttcctctcccttctggtggaaactagatttggaggggttcattgcgctccatttcctctgaattcctaggagcgcttgtggtcggcatctcctcattctgcctgaagaccacatgcaactcatagggctcttgcctccaagaacaggcggctgcacaggcgcatacattgtaccaacctgtacaccttatgtctgtgcatgccctacatgtatgttagacttcaattttaaaaaatgaaagtcaaaagactggtcaattccttctggtcctcaaggcatatttccaatgtgggggtaccttcctctcttcacttcacggtggaggatgattctctactctacctcctcacctccctgacacacctccttgccccaaaacaaaacagtgaaaatgaacaatcccctctaagccatttgcttatggaagacaaagctggagctgactcctttctggattctctctccctactccccccacccccactgagcacaggcatgcaatagatgctcaataactgtttattttgggaataaattacaaatggtatggaactatctcacacacaataagtctgtaagttcctggatgtctgagcttgtcttctacctcttgggatgcctgtgtggccctccccaaaaccccaccaccaggtgatttcttaacctctatgagtctcagctcctgaaccacacttgtccttcaggatcactgtgagaattttaccagctaagatgtaaagtggccagctcagaatgtgatatattgtaagccctcaataaatagtagctccctggacccaaccttcccccacaaccttccccagttgcagcacagagtttaaaacctcccaggagccccataaactgtggccgaccaggactgaccagcttcagctctgggtgctctgtgcctctctccaatacacacagtgcttcattaaagaactcaaagcttatctggcccaaaagcaatgcttttatctaaaatcagaccacatgggcaacaagtgaagcaggaagcctatcaaggcatttgggccaactggttttggctgccaagggagccctccttataggaggcggttcagaccgcaggccggctcacatacaacactggtgtacacggaggggttaattagcagtaaacagatgccatgattcacctctgtgctgttatttccccgtgtgcagctaaaactataatcactctgttctccgacaggatgtttgcgttcaagccaaaactgcctcctctatccaacttgctgcagttcggttcagcacagggcaatgaggaacttggctcctctcacgatagctggtggctggcctgacagaggccccttcagacagggaaggaaagaggagatggatggggtagagaagaaaaaaatgaatttgtcattttatcaaacacaggtgaaggctgtctgctggtgggaactgctcctcaacacttaacacccacagagctcacaaaataccctttcttctgaggcagtcaggcatgagaggcttcaggagccctgtgacaagtcattggcaagaaggagctggggcaaatttgcaggccaatgcctgggtcacaccctccctaccactgcccaggcctgggtgggtgtctagtctacttggagcctgggacctggtaaaggtggcctgaaaggctcaacctcagcttccagaaaaaattaaataccctgagagagccagaaaacaaagagattcagtgcccaaaatataaatgtaaccagtgtggagtattagtcaattcatcagcaagaggttactgaatgctcgtttgttcattcattcgcccaccatctaccaaatgcccaccagagacatgccacgtgtttggtgctgggaatacagaaagaaatgaagaagatgtatgtcctgtctcagtggcccacagaccagagtgtgccaaatcctgaaggatccagttaggagcttacaatctagctggaaagctaaagaagggaagcatgcggaattctccggggctcatcgccatccctcacctaaccagtgctttgtgtaagatagactcaaaggtgagcttgaataaactgacttctgctaaatgccattattctacctggatacatcacaaaaatgggagccattacctactgagtatttttcatgtgctaggtggaactttctctgtggtcttcaccctacatgtaatggaaactgaggcatgaggagggtagacaacttgcccaagaccacacaggggaggcaagagaggaacccaggtccttgcaccccaaccccatgccctttccacctcactgcatgagcagaggaaggagcccccttgtccatccctcacccagccccagctcagcttgggctcccccaagcaagcaccacatgactgacactcttggaatcctcttcataacctggcccaggtatgggacaagttgccaatgagcaacatatttgcttaaccaaatgcctgtggcagaataagcttgagataaaagggagtgtgaagtggaaagaagacccggaagtcttcatgaaggaacttggtgtacagaaagatgttttgggtgcctcagaacacataatccctgatagagaaaagagtctggagacaaataccagatgttaagcaaccttaacacaggcgcctgggctgcctcagcctatcagagtagcacaggttcctaaataggggaaagtgccaactaaaaagcccaccaggcaggagggctgggtctggagcctggcctttcttctttgttcagagcccaaaaggtgcctctggtccattcaccattcaccaggccccagagcagccccaggatcaccagatgggtccaccaggtccgtcctgctctggctaccaggcttctaagcctcttttcagaccctcagccttctgggagaaaccattccatgccctccagcactttccaccccttctgttccttttgacatcatctccaactgcctgaggctgcagaaggtgggtggtgtaggggcagaacaggcaggagcacaatcacaattcttataaaaatgcaagggactgctggagccaccagggaccctcagaatggcctcatccaatcctccgttttacaggtggcaaactgaggcctcgcccctgagttaaccctttcaatgcctgacatctcgtactgcaaaattcttcctttcctctctctccattcccctctccctcgtccttcctatagtggtataggggtgtgccgtgggtgatgagaggcagagggaagggagcatttctcaccccattttcctccaaccctactttctgcctccatctttagcactacctcactgtccgtcttggtgctcactgttggcccctggctaccctgccccttccagtggtctcctgtccctcagttcagcacaatcctggttatattgacaaaggagagggatctaaaataaaggccaacttcatcataacagggccatttattgaggacttacaagatgctaaatgctattatactcacaaaacctttacgtggctggtatttttagtattcacagtttaccaatgaagaaagtgagctttgcaaggttaagtaaattggccacaaccaccaagctaatgcaaggtagagccaggactcaaacccgcctttgaccaattccaaactaggctaagagcctcacaagactgaatttaagagaccaaaatgaacattcaaaatgttgcactgtggatgcaaagatggaaggcacagagtcctaggcttcagagatgctacattccagcagggggtggacattccacagacgtgcaatccaacctggatggactagagtggagacttaccagaaacagagtgaccaatgacctaggaggttattgtcaatgcccacattaggggaaaatgtcacagtctcccaaagatgaccaaatgaaagtaacagtaataactaacactttcctagcccttggtttgtagcaagtgctaccctcagcatttaacacatgatcctcccaacaaccccaggcagcaggaggataatgtggggtgacatctcccagcatttgaaagtcaatttgaagaccgggtgcagtggcacatgcctgtaatcccagcactttgggaggctgaggcgggtggatcacttgagatcaggagttcgagaccagcctggccaacatggtgaaaccccgtctctactaaaaatacagaaattagccggacatggtggtgcgcacctgtaatcccagctactcgggaggctgaggcaagagaatcacttgaacctgataggtggaggttgcagtgagccgagactgcaccactgcactccagtctgggcacgagagtgaagctccatctcaaaaaaaaaaaaaagccaatttgatactaggaactgtttgagggcgttttcagtattattttattcccactttccaagtgagtgaactgaggcatgcagaggtgaagtggcttgcccaagatccaaaggtcagcaagcaacacaactatgatttaagcctgagtaggctggctccagagggcatgtccctgatgaccacactgaactatctagaatgagagacgttgctcattgagacattacaattctggtccattggattttagaaaggcaaccgtattacttatgttactactcacgtttgagaccctgttttctcagcagtgaactgttgaacttactttgctgagacataaaattggacatgggtagaaggggctacagtgaagtgcatttccaaggtgaagcacatcaccacaggagtgagacaagaaacccgggaagcagcctctgtcatccatgagccttccactctcaatgctccaggcaaagagccacgccaggtaagattcaaagtgggagagggcagactgggagatgatgcattcaaatcatgagggcaggctcaggtaactactgtcaattcaccacccctgaattagggccaacgtaaaccagtgacaatctctttgaaacatgaagcagggaggcagttatgccccttagtccctttatcctgaaggtgtttaagaagctgagtagctttcaagctgcagacagggataagaagaggcagagctgaaggcactccagagcagcataggaagagggtaagagttaacaatctgaagacagaaaaccctgggttctaatgctggtactgccacttattaaggatgcctcttgggcaagtgacatcacatagccattgcaagccccagtttttgtacatctgtaaaatgggaaaaatacagatagtatctacatcataggctgatttagaggattgagataatgcatataaagtgcttgacaccatgtctgacacctagcaaatacccagtaaacattcagttttctcattgggtcatgataatggttctggcagagccagctatggacagcagaagccctcagtgtgggactcgggagccccttcagcagtccaggtgttctccaaatctatttcaatctcctgggtgcagtgctacatttcccaggatcccttgcagttaaaataccatgtgatcaagttctggccaatgaactgtgtgggtagacgtgatgtgaatgacttccataactacccctacaaaactacccctcatgatccttacttctcatcccctatcatccggacagatgcagagggtccagcagagaccttcaggggcccctagaagatttcaggtccacaagtgaaaggagccggggtctttaatgactgtctgaagtgtgtcttcactgcaccctccacacacaccatcaatggtactttgtatgagcaatacgtaaacttctgctgtattaagtcattgacatgttgacctcttgttacagaggtggcctagctgactaatacacagtttatcaaacctcaagatggactcacaggtccctgttgcctcaatgattccatcgccactgcacacaccagagtctagataccataaatatggtccaggagagaaaccagcagcgtggtgtggtaactggcaactggccaggtatggtaagcataaggtaaagcctgcagcaactcaagaaatgcagagggaagactactcgtctagaagaaacaggatggcccagcagcaatattacctgtgctcatagctactggttcttcaggagaacaggaaagagcatggtctcaaaggccaagcatatcagaggccatatctgcctgggatctacccagaaaagtgactgaactgctctgggcttcagtttccacaactgccaatcatggataacaataccctatgttctgtgacatcacactggtatcttcaaaccagccagggcaggaatatttataccataggaattgacgaacaccgtacatagggactttcttctctagaaatcccgttgttaatcacttaccagcacatccctggataaacaggagtcagctaagtggaaggggagaaggaggacaagaaaagagaagtccggcagtgtgaacagcatgtgtgaaggcccagaggtaaaaatcaaaaggtttaacgaaatgaaggaagtcctaagtggctgggtgtggagagcttgggaagatgttaagaggaacctagaaagagggcaggagctggaccttgtgaaaggacttcactaaatagtaattatttgttccagtcatccatggctatgtaacaaattaccccaaaatgtagtggcttaaaacaatcatttcattttgtttatgacttttaagtaaggaattcatagagggatcagctggtgggttcatctccaatctatgtcaactggggttggaggatccacttccatgatggcatcttcacacatatgcgtggtgccccagtagtgtctctctgtctgtctgtctctctctctctctctctctctctctctctcgtatgcccacgcacatgcttcctctcactctcgctcttccccctgtagtggccaacttccctaagaagtagcattcccagataacaaatgaactgccagggttcttccaacatagcctcagaagtcacatagcatcatttccaccacaatccatgggttacaagcaacccatggattacaggggctagctctgccccaaagggtacaacccaagaggatgaacgtgaggagtcgtggttcactgagggcctgctttgatgaccagccaccacattgagcgacccctggtcactgccctctaggaccacctgccaggcacagatccagaaagaaaccaggaccagccctgtccacaaggagctgtctgcagaggagacaggatgcctgtatagaaaatagggctgcagcatcagacggctgctccccacccaggatggaaggacaaacagagaggacgcatcagggaagggagaggcagagaaagctgactagggtaggtagagaaggcttcccaggaaggcggcattcccagcaagatgagctaagacttggaggatggaggaggtggagggttggaagggaaggagtaggccatcactggggccacccccagccttctatcacatttggatcactatggaccacgccaggtcatctccgcttttcccagcagggatgttgatcagacctgggcactctgcagtgatgatcagcagctcaagagcaagggtggctcctgaccgtgaggggtcagcaccaggcccacaagcctgtctgttgcaccagtgcccaggaggggctgtcgactgcagaactgttttctctggctcgacctcacccagaaccagcggcagaaaggccagttatgcaaccatcctcaccacagcctgccagcctcagaggctgggcctggccgccgggcctggccgccaggcctggtaaggagactgctgtggcctgcacagcacaaggccatcctgggccccaactgccactttccatgcaggtgcaagacgctctgctgacaaatacctggggaaagcaggagctgtgggagggaggtaaaaatagcacagttggcaacagagaaggcttttctaagtcctcagggtcctattagtccttgtccatgggatacacatgagctggcactgagcattctctcttctccaaggctcatgcttagaacaggcacagaggcctgggaggcctcttgtatcatgtcaggagctgcacagtgatcagaagttagggagagcgcctgttgcagaggctggatttggaggatatgctggggctgccgtcataaccccacatccccagtgggttctctctggccactccctctacggccagttctgttttctccccatttttggaaacccaaattcttgatgtttctgttattcacattgccattaagaattatgggctttgcactgtgtttttaatttgttgtgtaagggttttacacaaacacagctagatgcctagaaaagacaatgtatatgggcatgcaggctgtgcactgcacaactccagagggcttcattcatgaccaggatgtgagtggcgccctggaatcatgcaatgtggttaccggtattgccagagaggaaatgatgtcttacatgaccccatatccccgggaaaaggccagccatgctaataaagatttgctaactaaccaatttgtctcctgcttccaaatattccatgcacggggtttggcaggcacacggccacaatgcgcaatggcctagaaagagagccatattgaaatataataatgtatttccaggccacggaggtggagaggcacaaggaattgatctttctaaggcaaggaagattcataaccactgaatgagttaaccactaccttcttctgagtgtgcagattaaattctctgtcgcaccaacatccaagtgcgctaaattttaacagacctggaatttggatatatttatttctctttcacagaattcccattcttttactaacacagtttcagagtttgagatatgagcatatctcatgtgggataataaggcatcattccacaccaggttgcacaggcccatggtttaatgatgagacttcgctggtgggtgcaaactttgctggtcccccatgctctcttgaatctgtgtgcatctcacacatacgtacatgtacacacacacacacacacacacacccctctctcaagtttttaaaaacctacttaaattctgcatcctacctccaatatactctgtgtacagtgtaagtgttaataccaaaaatagtgtttttctgctgggcacagtggctcacgcctgtaattccagcactttgggggccgaggcaggtggaccacttgagctcaagagttagagaccagcctgggcaacatggcgaaactccatctccaccaaaaatacaaaaaattagccaggcatgatggtgcatgcctgtagtcacatgcctgcaagtcccagctactcaggaggctgaggtgggagattgcttgagcccaggaggtggaggttttagagaaaaatagtgtttttctccaaaacttcatggaagactgttgacactcagaaaaatgacccaatattgattctgtgcctccacataccccccagcacagagatgtggcacatgtgctgtggttcataaaatacatttatatgtcatctgatgtgaatctcatagcagtcctggagttgtacattgagtaacctgcatgactgtatatagcccactgcctgtcaggtagagaaaaggtgattatcccattttccagcaagaaaaactaagactcagggaatgtaatagaactagacaacatttaaggttccttctcatcctgggaattgacatacctgagaattcagtagtacaaaactctctgaacttgtcaagggacctcacatctctccaggaacaacacaccactcctcttttcagtcctgtctatgtcatcagagtttccctcacactgtggccaggaagagctaaggaggtataaatgaggtgtacagtgtgggattaggtgcatgggatccacagcccacctgcctggatttaaactggctctgctcctcacctgtgtgtgaccctgagcagttactcaacctctctgtgcctcagttttctaatccataagtgaggataataataccaccgaattcactgggttgttgtgaggattatataatacatatagtttaaaaacaaccagacacacagtaatcactcaaagtttgttatccaaaaaaagaaaaacattctcattctctatgcatccattttctaacctgtaaaatgggaatttaaaaggggactacatcacaggattgttttgaggattaaataacagaataaacataaggagcttaaaacaatgcttaatgcatagaagccactcaaacaagtttgttctgattttttttcccctaagaaaatagtaactccaattcccacagaaagacttcccaaaacaaaagtaccaataagtctgaaaataaatgcaagacctgaggaggaatcattgctgttttctaaaaccagtgatagacaggctatcttagagaccggaggttcttgctttacattcattttctgaggtcaggaagtaaaaaggaacatgggtgaacaggcactggtgagatgaggaagaaagaacaggaacatctcagttgctagtttctgttttcaccatgaaaatcattttaaagccctgcctagaatttaaatagcatcatccctggagatagctgttttagtttcattacagtctgtgttcgtagagtacaaatagaaaccttcgtgattttattagtttccatgcaacttaggagagatttgcatgataacatttcatctcctgactttaaaaagggaccaattaaaaatacagcacttgcattgcctgtcacgggaaaatgaaaaggttcacagagttttaaaaacctctgccatatctagtccatggtcataaatcaagtattcagtactacggtggcaatcactattgtctaaatttttagtttattttgtaagaagtacttggaacagctgggtgcagtggctcacacctgtaatcccagcactctgggaggccgaggcaggtggagtacttgagatcaggagttcaagaccagcctggccaacacggtaaaaccccatctctactaaaaatacaaaaaaaaaaaattagctgttcatgatggtgcatgtctgtaatcccagttacgtgggaggctgaggcaggagaattgcttgaacccaggagacaaaggttgaggtgagccgagatcgtgacactgcaccctagcctggacgacagaccaagactccgtctcaaaaaaaaaaaaagaaagaaagaatatttgcaggatgtttgcacccctgaaaagagttaaactatagtacagaagaaacaaaatgtacaagtaagtatttttgcctggattgcagcaagtcctacacaattaccaacaccccaaagctacctggtactctgtggatttgtgaagtgttaatgtaatgtatctgtgacaagttaaaatttaatgcatggctccggtagcataatcgaatcgatgttatgtaacctaagagaactattccagtaagttctgatgtgctggctgcttacggttcagggggagtttttttcggaggttactgagtatttaggaatcatcccttcagacacttgctcttttgccacagaagctgcagttatcttatccctgctttcggcagctggaatgctccgtggaacagggctgagatgaacgttctatctccaaggctgcgttttggggcaagttaaggaaaaggatcaaagtaagttgatttgcatgaccttctctttaatcagatgtttctttttatgttcaacctcaacaaagccagcctatcatagcacactatttatagtctataatctaagatgttctgaaccattcccccacaccaaaaattaaaattaaaacctcaatagtggtgtggctatatcattagaagtaatagtagagtcacaaaaacctatttctgagactttttttttaaatgacaggtttgatggtatttccaatggggcctgtgtccctagattgtaattcttaaatatgtcatcaaagtcaatattgaagttctggggacaagtcaatcaaatttcactcttgtgttttatagtagaacaagaacttctccctggattcactgccctcaataacttaatctttggttctttatcaggtaaaaatgatagttttaaaatctgacttaagaaatggctttatattgaaatcatgaaatcagagaatttgttatatgcatgagaaaactaaggcctggagcctatgacttgtctaagacactgtagctagtcacttgtcatatgtcaaaatcaaaaatccggcgctcccttaacttcactctaagagtagacaccattaaaccagaccccacaggcagaaagagggttgttctcttcatttgtctgctctcaatgtgggcagggcctacatcaaagtcagcctgggtgcttctagaggggctgcaatctttagaggaagaatatcagctgcccaccgagaaaacaagaacgccaccgtaaagaacatgtcagggaaggaaatgtgcccaaagataatgctggtcatctcctggagggggaatttggaggaatgtttttcccttttctcaaatgtttatttataattgtggtgaaatacacagaagacaaaaatgtaccatcttaggctgggcacagtggctcacgcctgtaatcccagcactttgggaggctgaggcgggcggatcacgagatcaggagatccagaccatggtgaaaccccgtctctactaaaaatacaaaaagttagctgggcgtggtggtgggcgcctgtagtcccagctactccggaggctgaggcaggagaatggcttgaacctgggaggcggagcttgcagtgagccgagatcatgccactgcactccagcctgggcgacagagcgagactctgccaaaaaaaaaagtaccatctcaaccatttttaagtgtgtagtacttcacacttaaaaatgtgcatgtttcacattgttgtgcatcccatctccagaactttttcatcttacaaaactgaaaccctatacccattaaacacttccctccctctggccctggaaactacccttctactttctgtttctatgagtttggcaactctatgtacctcatgtaagtggaagttatccttttgtgactggcttatttcatttggctgatgtcctcgatgttcatctatgtggtagcacgtgtcagacttgccttcctttttaaagttgaataatactctgttgtatgtacctaccacaattcgctaatctattcatctgtgaatgaacccttgaattgcttccacctttggccattgtaaataatgctgctgtgaacatgggtgtacaaatatctccttaagaccctgcttttaagttttttggatatctaaccagaagtggaattgctggattatatgataattgaatgattaatttgttttgagaaactgccatactgctttccaccgcatctgtaccactttgcattcccacaaacactgcacaagggttccaatttctccacatcctcaccaacactggtgattttctatttttttttttttacagtagccatcctaacagatgtgactgtgtcctttttgtttaatgcccctgcacggcctacgttttctacaatgaacatgtagtatatttgggattaaggacaaaatataaaatactgaagttaaaaagtaaatcctatggagaaaacagggttgtgaaagaacttaagaaatgattgggttttttttttttagactgaggcaaactgttgagccctcttgtgggctcagctagagacatcattcctatactcttcaagaatctaccacctgatcggctgtggctgccacaagccacaggagaaacggccataattcatgggcagctgaaataattcctctaagctctgggaggaaagtgttcccagatgcaggaaggagaacaacaatgtatattaagctgttgccagctaatgttggtcataaaaatccctagcacttgggtaaggcctttcatcttccaaatctttcctccaagccttagaacacttatctctgagttctccatttgaataactggaggcccatttttccccttccagagccacaaagggtccactttccaaaaccacataaagagaaaacaacgtcaatgtggcaacttctcccaaagaggagcagaattctgctcttggttaacaagcacacaaagaacatctcccacaaacccttccaacgcttcacctctgagccacacaggccgcgtgctatcagttcattccacagaatgtctcgtttgaagagctaaaattttccaaacgtgaactcattctacccactggtagaatgctttactccttggaggtgaagtcatttgacatgatttattcattaagacaaaggtgaggtaactaaaaccaaaatccatccaattagctatttatccaacctctaactctcagaggagaaattcttttttccttggtgtcaacctctccctctacctcctgccctccctcaccttcttcctttgtgtgttttgctctcttttcttttctggtttctttctgttcagcaaaataggggagatgacagcagaggcatacaggagccccagaggaaaggagacccaatgagcaggtgggaaagaaacagcctcctattctaagaagcggctgtattcaagtgatgcaaaaagaggttcaagagcactgtctgtctccctaggtgaaaaagagtcaacacctagaaaatggaatccaactcgagtttcctaacaaaggctctgtaccctacatccaaattcttggcagggcccccaaattacaacccccacgtgaaactgagaagggggctaaaccttggagatacaaggcacgtgacattgataaggaggtgaatttatggcccagcaacagtcaaaagcctccagtcacagctgctgacaagaccgaagagacctcagaaggcaaacttcaagaaacaaccagaatgggtcgttttctgaactctgggcaaaggggcaaagggaaaccacactgtctcaggaggacgaagaacccagggaagccatcagggagaaaaataaagtggccttcatggaggaaacacaagttaaggttaaggtcattctacgtctcaacactgcggacatggaaacaccacccagctctgtcccttcctgaactggatttagaatttgaaatctaccatccaccaaggcttgttctgcatgtcccagacacagactagaagcaaacaaggactagtgcaaacagaaagatctttccaagttcatcgtaaggtgggtttgtccccagtggaatagtggcctcaggagatcataaacacactggtagggtgggcttccagcactggggaggaatcgcacagggcctgaggccccaaagcttccttccaccactgtgaatttatagttccatgcgcttctgcacttgttaaatcaggtcgctatttgttgtctactaatctacaaacctgaagcccccagccagcagaggccactctcgatcccaccccccagccccagttcactcccaaagatgaagacagagaggactgtccagtctctaaaagggaagaaggagcaagaacaagacatggaaccagaaaataaaataaatactcatcttatactcccaacttgaaatgcacatacaggcagcccaacagcctgtagataatttggtttacaatgatatgcaaagatgcagacccatcgtggctgaatagtttcgtacagttagaagtgaccctggaaagaatattactgacagtcttgccttaaaaactcttttgcaaaagacatcatggtcccagacttcagcagttaacagatggaaattaacttcacttcaagtcaaaaacctaaaatctcgccgggcgcggtggctcatgcctgtaatcccagcactttgggaggccaaggcgggtggatcatttgaggtcaggagttcaagaccagcctgactgacatggtgaaatcccgtctccattaaaaatacaaaaattagccaggcatggggcatgagaacctggaatgccaggtactcaggaggcactagaaccctggagggagaggttacagtgagccgagatcatgccactgcactccagcctgccagcctgggcaacacagcaagacggtatctcaaaaaaaaaaaaaaatctaaaatcctatttttcctttttaaaaaaacaccccttccccaagtaaaagtcaactctgataatggggagatctacataatgtttaccttaattacttcttccccaaattgaagtattcctccctattgtgctagaaaccaaaattaaacagcaccaactttccacagaaaccctcaggaatgacagccactaaggaaaaaaggatgtaaaagaaaggatggagcaagaggaggagggggagaaggctggaattcaggctttcctgtgaattcgctttgaaatgcctagaggccactggatctgagtccccaagaaaatctggtagagaggccagtgaaccagcataaagaatagaaaataaaggagatgtgttaaataattttgattttggccacgtgaagaagtattagtcatacaggtaacaagatcttacagggagatgattccaaggctcggcttgacaacgttaagtgtatatccattctgggcctggagtgccaattacatttccaaattggcaattagacacaatgtcccaagacaatcaccaaataatgccaaaaacaaagcaagttccatcttaaagcagccattcttttgaaactgcccttccctcccgtgcctgactcatccacctcacaaacaactgcccattatgaactaaatccttgttagctactgatcaagagaaaccaggtggcatgaataattaaaatccacgaatgattcaagcaccatgttgtcaacaaaccaagcccatctctttcaccaggagtttctccatagcatctaacaaattacccaaaaaagcaggaaaatatatttgccacccccaaccaatgcattctcgttcagcccccagctaactactggaaagagccttccaacatctacgtgtgtttacatttgcatgactcagttcctgccctcaaggagtttgcaggcaattcagagatcagatgttcatattccatgagaagataactgttttttcctctgctcagcctgtcaagtactaataaaagccctaacaagcagggagtcagaactgggtcttaattatttttcccccagcacctagcttggtttctggcacatcgtatacacttaatatgcaacaaaagcaaaaacaacaacaataattataaccagaagacttctttgagggcctactgtgtgcaggccgccacgatgctaggtccttcttcattctgcctgctgcagacactcatggtgctcccctctgatgatgaaacaacataaaaagcacatctcatggaaaaagtccctgacagtgtgagctgtgaaaaaccctggtatggtgagaaaaggagctactttcactttcatcttctggaattcttaagaagtgcattggagggccacacagcacggtgccacgcgtgtcccccagtcactccacgggcagctcttcagccaattctttgaggttgaaccctccatttgggaaggcccacccaggcccctacagaaaatcaggctggcagtcttaatgcccactgacttcaaacactccagagggagtggtccccagccagcctggggcatcaccgcagtgcagccctggtgacaccaccagcctttaattttgcaaggaggtagtttggctgggttgccctcctggacttcgggaagtcacaccctttgcagaatgaccaactggcacgaggaagagcccacacattggtgggtaacacacagaccacaccctgtaaacactgctctggccaccacaacccaaccctaaatccacaacgctgatgggttccttaggagcaggcacctggaccatcagttttcgcaaataagagcccagcccgaaccacagctaccctggtctgaaaggagttttctccacccaacgatctggcagagcaaaccttctgcttctcatcccttcccccttcaagagctgggaatttccacatttaaaaataagcctgtcttcagggatggactgcacggaggctgagggatggaccagatccttgatactcaaagtgtggtctgcacagcatcagtatagcctgtgtctcgccagaccagcataatctcaggtcccacactggatcttctgaatcacagcctgcattttaacagctctcggtgattcctgagcatattaaagtttgactaagccaggcacagtggctcacaccactgtgggagcactttgggagaccaagatgggaagatcacttgaacccaggagttcaagacaagcctgggcaacatagggagaccccatctctgtaaaaaatttaaaacctagccaggtgtggtggcacacacccataagtcttggctacttggggagctgaggcaagaggatcacttgagcctgggaggttgaagctgcagtgagcagtgatcatgccactgtactccagcctgggcaacagagtgagaccctgtcccaaaaaaaaaaaaaaaaaaaaaaagtttgagaagcccaggcctagagacactctccagtccttggagataaagatgtgatattcccactgaacattccccaggttttctgtccaaagtgctaggacacccttgcctccgagggtccctgggtttccttttctaggtgcctaatgcgtggggttccacccacccaagaagcagttctaaaagagacatccttggtctgctccctgactgtgcacagaaaggcatggccctgtctgatccccagggatgtctccaagggacccagtgttccccacacggcccagggcctggcatcacagcacaaacagccctttcactggaaccacaaaggcgaccttccaggggatctgcagcttggcaaggtggtattggctgctgtgattcacagattagcatggtcactgccagtgtgagccgggacgcccactttgggaaggaggtcctggcattgcaatcgaatgccaatgtaactgtttctgcaccaggcctctcatgccctgatgagagagagagaaagagagagacagccccaaagcaagcacttactcctggctatcagccaccaatgaatgtccccatccagggaacaaaatagctgtgaggcaaagagaaggtccatttggacttaccattggaatgctttatcccccaggccaaacagcagggggcaggcagctcttcttttcctcctgttgtatgtttggtcaagtttcctgggcacctagaagcagggctagcccaaggctcccaaagggaggccataggttctcagtgtcctcctaggaaatgctataaaatggggttggtgaaaaaaaccaccccatgaggctgtgctctatcacagacctcaatttgcaggtgaggaaactgaggcacaaaggcatgacgtctttgcccaggatcacaggctgaaccttgggcactgcacagcacccctgacactgaagcaagactgctcacaggtagcacatttgagggcattttaaccactttctctaccagcaggatgccgccaagcctgtgatgtggccctccaaaggggaagctcagccacgccatgcctgctgattttttttcacaaggtaatttaaaaggcaggtgtgccacagaacacacttggggaaacctggcctagggggtgtcttggaaaagctggtctgggtagacagtgagtgtcctggccaagagaccgtgacatcacttgggagacaggtctatgagttctggacttgggataacagggatggaatttgtccctcctcaagggtacaatgctggacaaccatacctgcccaccaaatgccacagtgtttcccttctgccagcccagcagctcctggtcccccatactgtcgatgttcgtccactgataccccaccatcaaaactgtaaccatcctgccaggaccccatccgtgaagcctacctctgctgccctgccctaactttccagccttgcaacagccaagagccataagcccatgtctcagtctgactctaaatggttttttgatctatgacagtatacttcaggatctaaagcctccttttggctcaaaaactttatttgttatagtctgcgcccttcaggggctataagttcaatgaatcaaagggaaaataaactcagcacttcatgaagctatgatagttaccacttacaagaggcctgctaagtgtctggcatttgcagggtgctatgtgcccattattcctgctccctataagaaccctacaaagtaagcatcagtatgctcttggtataggtgatgtaaccaaagctcaacatggttggcagtcaaagatgccctgctaataaatgtgagatccatgatttgaacttgggtttgcctgattgcagagtcttgtactaaagtgtgcatttccataaagagggccaggggctggacgccgtgcctcacgcctgtaatcccagcactttgggaggccaaggtgggcgaatcacaaggtcaggagatcaagacaatcctggccaatgtggtgaaaccccgtctctacttaaaatacaaaaattagccaggtgtggcagcgtgcgcctgtagtcccagctacttgggaggctgaggcaggagaattgcttgaacccaggaggcgcaggctgcagtgagccaagatcgtgccgctgcactccagcctgggtgacagagcgagactccatctcaaaaaaaaaaattaataaaaggagagagagagagagcaaggaatgaggagcacgagctctctggacaagggcaggtcagctggagctcccccgtgactaggacccaagaactcctccaaggccaccccaagtgatctgctcaaaaaggagtatctcaaggtcatctggtgcagccaatccccaggacaggatgagatgaggcacaagggccaatctggaatcaagagctccacggcactgaagctccagccctgattgactgcgtcaggccagaccctgggtaattaccaagctgtaatgggatctgatatttatattagtcacgagcctgacagagaaaacgtgttgttttctcaggcacagccatggagacaacatctcgataattcattacacgcagaccatccttgatcaagcccaagcttctacaaggccaacagctcaaactgagaatggaaataactctatgcccagccacactcaggcccctcaacaaaccacagctccaacaggaagttggcctcagtttccccagttatttaaagagaagtagaccacatgctggaagacgagcagaagatggaaataaagatatgtaactgtcccaaggctgaattcctaaaggaattgctagggaactgcaaaacacattctgagctagaaactttaaccctcattcctcaactcctccctctctcctatatcgaatcacagagcaggaagggacattagaactcacagaattcaatccccacattttatacacaaggaaagatagacaccagagaggttaaataacttcttcaaagtcatggctttattcaggctaccagagcagctccctattcaatatagtctatgacaggattgaacttcacaacgtcacacccaagtgaatagagagctctgatgaaatcccacaaggaaaaaaacaataatgtgaaaaagtacagcaaagaacacagtactggaatgactgtgaccaagttcccaacaggaggaaattgtaatgttttcttcttcactttctgaaaaagtccacatgccactcttttcaaaagactaaagtcattcactgtttgagattcagaggccaaaggtactaatgaagagatgtcccacgatgcatgtccacagtcttgggttcctttgatcaaaaaggtttggtgcgatcccagagaccaaacgctcatgaaattggagctccttgctgaattttatctcccacagaatttcagacctgctttcctctggactccagctcttgatcaaaccatcttggggctgaaggagggtgagggtgaacccatctgagggctggtagaattttctggaaaggcagcctatgttttcttgggaaatctagcacaaaaattattattctaagcttaagccaaatacatgcctgtgtatcgagtcttgacaaaactaccaaatacttggaaagaaaaaagaaaaaaagacaaacacacacacacacacacacacacacacacacacaattgcaataaaaatacagacctcaagcatagaaagaaaagcttttaaaaggcctaacttaccgttactgcatataatgagctggctacctatggcttaagtgagcaaatctaggggcaggtatcaagagattctaggtgtgctttaaaatggacttacggtatcaaaaggaacctgcactcattctatactggcctcacatcttccaaacaaaccaccatcacctctcatccctggcagatttcttacagcaactcacttccagttatgtccactcagcaggtcttggggctacaaaacatagccaaatatttacgaattgttttttctaatcgttgccaaaaacctattttcttgagtaaactgacagaagttatgcttgctcatcatttaggagatcctttgtgtgtgcgatgggattagcatttcattacagacactgcaattgcatttatgtaccccctaacataaaaagactttggaagctgtgtttaggaccccaggttcacaaaaacaccacaacttattttcaatcatggaaaaagttttcattatgataaaaattgccccctgcctgaaagaaagcaagctgttaaaaagttcacccagatcactctatctagggaacatttcagaggcacacaactatgagctatctttcccctaaagacagtcgctgaatctcagtaaaccggggaacaaaattcccgagactgttgggggaggtggaggagaaggatggagagagggaatgtgggaatttgaaggctccaggaataagctgttctcagcaggaaggctagtcagggatctggtgtatagggctttgcttaacctgagggcttctctggaaggtgggaggtttgcctccttaacaaataagaagaaacctctacggctgagaaggtaattccaaagaaaactctccgaccagcacctgcaggcctccggagaagccagagaatgacgaagagaatgatggttttcatatttctccctttgttccaatacaccagtattttccaaaacacaaatgtgctgccacaaaacacagctgagctccagcacccaacaggatgtataattaatgatcaggagagacaggctccttcccccctggtgttttcatagccagccttcacccatagccccaggcttccctacttctctcagccgccaaggaggctgctacaagttgctgtgccctgtagaagtttgaggggtcctcggtttaactttactagaaaagatgtgaacatgtggaggctgcaatgtgtatctaccctgcactattcccctggatttcccttccctccaaaacggttcgcgcgtgaagtcccctaggatgggaattactcagaaagaaggcagctggctcactctcttttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtgaggaggaccccacgccaggatacacacagctacccacccctacttcgctcttcctgctacctatgtgcccagggtcccgcgtgtggctggagggtagagtcaggaaggccagcgggtggtctgtggcctctgacagcagcaggtggtttctctcctttttccttattagcaacagaggctgcccaacaaagagtaggcagaaatgatcaaggacgacctggcctggggatagtgcaggccccgatagacaatagagttccctgaagggttgctttcctctcatatagtctcagactccatccatcccgtgaggagggcagatgggggaagagggactccagacttcattctggctcaccgttccccatttagggtcttcccttctccccacttaagatgaagaaggagtccgtgtttgttccgtagcgtgtctccgtacaccaccaggggaatcccccttctgacactttcagaaactttgcgccccctgaacagcgtccgtcctcgtgctaccagctggaccccaagtttttccagcgctaattaaatcgaggatgatcacgctcttccctcattgctgcagtggtttccccaaagtttccagctcattagtttaagcctaattggaattctcaggttcctttcagctcttcccatggaaaaggcccaagttagcatccttagctttacacctgaggctgtctccgtgagagtcagatcagccctgcccttgtccttggaggtctctggaaggaagagcgagcaagggaggctgagctgggcagagaggctgaagaggatgtttgaagcttctctcttgcttgattcggaatacattcattgggtttagagtacacatccactaagaaagagtcaaggccaaagtcaaaggagaaaatggaatgaggtaagagttcttgagtatttggttctcaaaaagaagtgtatgtaaaagggagctgcagaaagtgtgctccagaaaatggaattgtctgagcctcctctccataccatcccatagtacctccaacctcggcctctgtgttcagccactctgaatgcatccctgccacaccagacccaagcatgcaaaggccctgggccttttctggtactgggttgggggagcgggacccagaagtgctgtggggatgcgcaggaaggtgactatggcattgaggttcctttattagcctctcaatggctgtagtttgctgcttttgtgcctcagcaatgccaagaaagttaaggacattccttaaatcaaggccaagatttgaaatttaaaaataaaacacccagaacataaaaagggcagcaaaggataggactgtctccccagtgggatatgaaacctccagaatggattccctcacccacaaaattgaaattttgcaaaccagcaaatcccctctggggccttcttagacattccctacagcctggattcccctgaaatgccagtctggggtctactggtaagcagccgatggccgtgacttctgtcaccccaactgcaggatctatagctttttctcctccatcatcaccttcatcacctcagcatctttggagagggtgcttggaggcccctcagatgccatctcctgctctcttcatcacccctgcctctgctgattgaagcttttagcaacttctgtgctgtccaaagcctcggcttagtcaggaatcatcagaaactctcagtgttgatgtcaatatcctttccttcctacaatccccagtctctcacctcctccctgaatggcctggctggtaagcactgagagagtgctaccatccaccagaaatagacattcccaggcctttgcccagttctctctggccatttccacattgttcacaaacttttgcaccacttccagaaaacttggcccctggcattacaaatttaggaaaaggctctgcacagacagaacctcaaacttaaaaggaaccttaggtatctttgatttgatgtgtttcttcatttatacaatcaaaataaagccagaaacttccctgcctacctcgaagggttatatgtgaggatgaaaaagaaggctgggcatggtagctcactcctgtaatcccagcactttgggaggctgaggcggtgggatcacctgaggtcaggagttcaagaccagcctggcaaacgtggtgaaaccccatctctactaataatacaaaaattaactgggcatggtggcacatgtctgtaatcccagctactcgggaggctgaggtataagaatcgcttgaactcgggaggcggaggttgcagtgagccgaaattgcaccactgcactccagtctggatgacagagtgaaactgtcagaaagaagaaagaaagaaaagaaagaaaaaagaaaaaggaaggaaggaaatattatacagatcttaactataattactgtgaccccaaaaatggacaggcaagtctaaccagatcttctgacccctgagctcgtaattgtatgtgcacatgcctgcatgtcatgctgtccacagcatgtccacagccagactgtggccagactccagggcacagcagagcccctccagcctaaatgagctctctgactacccaacaccactccttttcttgccagtccctggacagccttggaaatgggaaaggtatagagaagcactctaagcccagcacatcttcccctaatgtaggtgtgtctgcaggctggaaattgaggtccattgcacaagaactgaaagtctcaacagaagtagaaacttcaccctctgttctgaaaacaccacgagccttatttttatttctaaattcattcaaaagcttcccagagagaagggcagcctctgtaccatgtgcatgtgtgtctatggcagctctcaaagcaaatcagaggtttcaagcttaaatattctaatctgaacagtcctaactgatttaaaagaagtaaaaggaagtgcataaacatacatactaaaaaagcagagtgactaaggtaaaaggagaacaaaaaagattatttgctaaaatgttggccagcatcgcaattaatgtgcaatggattttcttttcctccaacctggacctagttccaatactctgacatcaatcttcgcgattttgcgatggagaagccaggtggtgactctttaaatgatctagcgccctctggtggattttcctggcacatgacattatttcatgaatgttcaaaaaagggacttaatttaacagtctgaaatttgagatatgaaaattccaagaggaaaaccctgctggaaaaaaaaaactacagggagtaggaaggaggcatggatcaggaagatgttggtccaaggatacaaaaattcagttatacaggaggaataatttcaagagatctaattgtgcaacatggtgactactgtggataaacaatgtttttttgtatacttgaaaaccactgagagattttaagtcttctcatcacaggtaaatgataagtatgtgaggtaatacatgtgttaatttacttaagttagccattccacaatgtatgtgtattttgaaacatcatgtacaccataaacacactttttgtcacttaaaaaaataagaaaaattgataaaaaaacaacaaaaccctacagcttcaacagtatgaattatctagttaccagtcctaccagcatataagctgttgtggataaaggcagctaacaaagttcatgttattactatgacttgatgtcagatctcaactgttactgccaccagtaaccctgcccttccttgaatcaccactgtgttttcttttaaagtcagcagtatccctctttctaaccacccttggtcttcacagtctctttgtgaagtaaaaaagtgcagtagtggccaggcgcggtggctcacgcctgtaatcccaacactttgggaggctgaggcgggcagatcacctgatgtcaggagttcgagaccagcctggccaacatggcaaaaccccatctccactaaaaatataaaaattggctgggcgcggtggctgacgcctgtaatcccagcactttgggaggccaaggcaggtggatcacgaggtcaggagatcaagaccatcctggctaacacagtgaaaccctgtctctactaaaaatacaaaaaattagccgggcgtggtggtggatgcctgtagtcccagctacttgggaggctgaggcaggagaatggtgtgaacccgggaggcagagcttgcagtgagccgagattgcgccactgcactccagcctgggcgacagagcgagactccatctcaaaaaaaaaaaaaaaaaatagctggatgtggtggcgcatgcctgtaagcccagctactcaggaggctgaggcaggagaattgcttgaactggggagatggaggttgcagtgagtcaagatcgcaccactgtactccaactggcaacagagcgagactctgtctcaaaaaaaaaaaaaaaaaaggctgtagctattttcccactttacaggtgagaaaactgaggcttagctctgccaggttacttggcacgacaaggaaagtctgttacctctgaagtgatttatctgtttgtaatttataatgctggagagtgggacttacagaacaagctttcacatgcttacatttttatagatatttattttatatttacttctgcttgtaagaataattcatatgtattataaactttggaatataaaagtttcatataagcttcaagtcagtgacaagaaaaaagaatatgtcacatagaatcttaccaccccaaaataaccactattaatatttttatatatttatctcataccttttccttgggtgtgtatttctgcaaaattagggttagattaaacatctaacttttatcctattttcccttaacatgaaactgttagcattttctctaagtcattaaatatcatggaaaacactattttaaaaaatgataattggataacatttcagtagatggcatactcctggcatttagatgattccaaagtttaatatgttttaaaataaattataaaactgtgtgcaaatgacttctagttgtcaaaaaagatgtccagaagatttccactgacatgcttccatcctgtctccagtgcctcgggagagcaggtgtgtgtaggaaagaggtgcctgtggcagtcagtctggccgtgggatacttcccagccctgccccaggtcactggcctcagatcagccaattgtgatgaagaagctttgagccagggcatgttacccgcaaagtaattctcttcttttctaacacatcaaagccagtgcattggaagaaaataatgctgtggtctcatcgtatcctcctcaatcattgcgccacctgcctgccaagatacaaacttgcaagaacatcatcttcattccccaaaggacatccatggctaggtcaaagaaggcacagctcaggcacaatgccctgcctagaattcacctttcaccaccattctgcaggatttccagaataacgattctgcagattcctgtgtccctttcctctctgtgatcagtgtcaccccccagcagaacaccactactgtgggccttgcctctgggaggtaggcagggcaaaaatcagtccacccatttttgctagtgggagaagaaggcaccaaaaggaaaaagattttcctcagtgctacagaacttgtcttcctgactgacagaccaaaaagctttctaatccttttcttagagtattcctgatttaatctttgcaaaagctctagttcaatgcctgggcagtccaggacttgacttcttactcctagtgctccaaaataatccaatgaccgcaatctaagggactgtgcagatgaagcagggacttactcctgcctcttcctggtagcttttgcaatatttgcaagtaagaacaatgctgagatcatccttcccacttacaaaccctcttgggaataaggagagaagtcaggaagtacaacatctctaagagtttcatttacttccaattctgacttgctttcctggtgtctgcttttgtcataatgttctccaaaacaaggtccctttgtttcaggaaaataagtcattgtaccaaaaaaatgcatgcacttttatgttcatcacagcactattcacaatggcaaaggcatggaatcaacctgaatgtctgtcgatggtgcactggataaagaaaatgtagtatgtgtacacagtggaatactatgcaaccaggaaaaaaaatcacattctttgcagcaacatggttgcagctggaggctgttatcctaagtgaattaacacagaaatagaaaaccaaatatcccatgttctcacttgtaagtgggaatcaactctcgggttcacacagacgtaaagatgagaacaatagactcacactggggactccacaaggaggagtgaggaaggggagcaaggactgaaaagctgcctattgggcactgtgttcactgtctggatggtgggatgaatagaagcactaacctcagcatcacacaatatacccttgtaacaaacctgtacgtgtaccctcaaatcaaaaataaaaatggaattttttttaaagccctttgtttcacagtggcctccctggaaggtgcatcccttcttcagccttgttatcccacagttgccaagcaccctgcttcccaaagatgatcatttgatggtttaaaaaattataaaccatgatgcttttatgaaaggtaaggctctttctgtgaaaccaggaaattctgcttttgctatatttttgcaaagataaacatttttttttttcagagcaggagtgaaagtttatttaaaagctttagaacagtaaggaaaggaaggaaaggaaagagaagaaggagagtacaacttggaagatggtcaagtgggcagcttgagaaaccaagtgcatagcttgacctcttgacttggggtttcatatggtttggctgtgtccccacccaaatctcctcttgaattgtagctccctcccgtaattcccacgtattgtgggaaggacccggtgggaggtaattgaatcatgagggtgtgtctttcccatgctgttctcatgacagtgaataagtcttatgagatctgatggttttataaaggggagttccgccacacaagccctcttgcctactgccatgtaagacatgaccctgctcctcattcgcattccgccatgattgtgaggcctccccagccatgtgaactgtgagttcattaaacctctttcctttataaattacccagtctcaggtatgtctttattagcagcgtgagaacaaactaacacagggttttatactttggcctacttccaagatcttgccttaaccctccccactcctgagatcttattgggaagctgctgatcagtttcagctgttttctatctgtcaggagactgctgttccctggctctggctgtgaccaattattactttagagaaacagttaaccccctgaccatcacctgatggttgcccaccactcctaagtgtgttgtggggagccctctcctgccttgctcatacctgactggctacctactataacacgtcccccctcaagagtccaagatcctaaacctttgggggaaaatggatgaaggtcagtcttctgcaacttcttcctgctgacagaggggcggtggtggttctgtgggtcttggcctcttgctagctgtcagggccgacttgggtccatgaattggtgaaagcggtatccagccaggtctaagggagacaggggcaggattttgcctctgtcgtgtcccactgatgaacaatctagaggttccctttagaaaggtgactcttgaatattgagaggacaatatctctcactgaggatcatctggagcttgatgtcctttccccttaaagaggaacctcagatctttcagggccttgcaagtgtattgaggagctgagggcattgcttccaactctggtgtcctgaagccttttcacggcttcactcgggtatgttgtatccagctggcaatctctagtactttaatggccctgggggtaaataataaaacagtgaaggggtccttccagaacaaaaacccaatctagcagtgtcctgcaaaaaagccataaatacagaccaataaactggtttctgggttcaagagggaagttcagtaaaggtcctagtagaaggtgcttaccatatttcagcagaatgctgttagagtcccagaatgtaagaatcaccattctaggaatgctgcctggagccaggaaggagaggtagatcctcacctttggctagaaactgagtctttgagtctcccaccagggaaatttccccagtggattttgcgtggacatctgactaatccagaaagagacctgaaggtgggagagaccctgccatcttcctggccattctagaaagtccaaacacaaagagaaatgacctcccgtttctctgagcactgcagccactacaatttcgtagcatccacagagtgcctcgccagctctttctctctgaggacctctgacatgggcttatttaagcgcaaactttagatgcttccagaaagatggcttgcctacagcactatgcagctggaacagggagactgttagaggcagacactgcccagcgtgtgtctcagacctcccttcagaaaaagcctctgtgagctccaggacactgtgctaaatgcattttctgcaagatgctacactgaattgaaagcgtgcaaaaacatccttttggttatctataaatttcattttgttcttctctcctaataacaaaattgaaagctgtaagttgaacaaagcaacctgcaaactgctctagcagccctgggaactccctgggtgatatatggtcatgggcttagagcttttcatttgacttgctcttggcttttctatcaagatctgtcttggtgacactctactgagatagatgagttggtatgcataagtggcttttatttca
